United States Patent 8,299,321 (NUCLEIC ACID MOLECULES AND OTHER MOLECULES ASSOCIATED WITH PLANTS AND USES THEREOF FOR PLANT IMPROVEMENT) - sequence listing, part 2

SEQ ID NO: 2647 - DNA, 1991 bp, Zea mays
  Clone ID: PAT_MRT4577_74831C.1
cctcgtcggcaccctccatatacacaggggtaacgctccgcctcgcagccagcaggacaccactcatcttccttcccccccgcctcgtttccatcgccgccactctcttgctcccccgtaccatccctcgccaccgccaccgccgtcgctatgcagagcctcctcatgcccactgctgcatcggccccggtggcggctccgcgggctcggcggaatctccctatgcgcctctccgtccgcgcctccgcgacggcggcagcggcaccgcggcgggagacggatcccaagaagcgggtggtgatcacggggatggggctggtctccgtgttcgggaacgacgtagacgcttactacgaccgcctgctagccggggagagcggcatcgggcccatcgaccgcttcgacgcctctaagttccccacccgcttcgccggccagatccggggcttctcgtccgagggctacatcgacggaaagaacgaccgccgcctcgacgactgcctccgatactgcatcgtcagtggcaagaaggctctcgaggctgccggtattgcccacggctccaagcccatggaaaagattgacaaaacccgggctggtgtgcttgtgggcactggtatgggtggcctcacggtgttttctgatggtgttcagaatctcattgagaagggctacagaaaaataactcctttcttcatcccatatgctataacaaacatgggttctgccctgcttggaatggatattggtttcatgggtccaaactactccatctcaactgcctgtgctacctcgaactactgtttctatgctgcagcaaaccatatccgtagaggcgaagcggatataatgatagctggaggcactgaagctgcaattattccaattggtgttggtggctttgttgcatgtagagcactgtcacagaggaatgatgaccctaaaacagcatccaggccttgggacaaggatcgtgatggttttgtcatgggtgaaggagctggagtcctggtcatggagagcctagagcatgcaattaaacgtgatgcaccaataattgcggagtatttaggaggtgctgtgaactgtgatgcttaccatatgactgacccgagatctgatggtcttggtgtttcatcttgcatcaagcaaagtcttaaagatgctggtgtggctcctgaggaggtcaactatattaatgctcatgcaacatcaacccttgctggtgatctggcagaggtgaatgccatcaagcaagtcttcaaggacccatctgggatcaaaataaatgcaaccaagtccatgataggacattgccttggtgcagcaggtggtttggaagccattgctactgtcaaagcgataactactggatgggtgcatccaagcataaaccaatttaacccagaggaagcggttgaattcgacacagtacctaatgtaaaaaagcagcatgaagtgaacgttggcatctcaaattcttttggatttggaggtcacaattctgtcgtagtatttgcgccatttaagccataaggtgttcctggcctcacaaaccttggtcagaacaacgaggatctttaggagtttctgcgttcaattttcatgtgttctctttaggggaagttatgtcagatctgagccggcaacgttacaaatgaactaaagctgagatacattgctttttagataactccaggttcacttaggttgtgcgcggctgtacaacgttgctttgaatcatttgtaattgattgtactgttttttcatgtaatggaagaggggttctgtagatgcacatttggaccttctagagttctagttaaatagcatacaaatgaatttggagggcaggaattgtgtccctgctgctggatctggacgctttatggaaacttttttttttgaaatggcaatatatataatttacacgcgcgcttgagagaaacgtgcgctatctcaaaaaaaaaaaaaaaaaaaaaaaaaaaaa

SEQ ID NO: 2648 - DNA, 2300 bp, Zea mays
  Clone ID: PAT_MRT4577_74832C.1
gccgccgttgggtgccttgaggccggccggggctcgcagccagcaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctcccgggacgcctctccgtccgcgcctccgcgacggtggtagcggcaccgcggcgggagacggatcccaagaagcgggtggtgatcacggggatggggctggtctccgttttcgggaacgatgtagacgcttactacgaccgcctgctagtcggggagagcggcatcgggcccatcgaccgcttcgacgcttctaagttccccacccgctttgccggtcagatccggggcttctcctccgagggatacatcgacggaaagaacgaccgccgccttgatgattgcctccgatactgcatcgtcagtggcaagaaggctctcgaggcctccggtatcgcccacggctccaagcccatggaaaagattgacaagacccgggccggtgtgcttgtgggcactggtatgggtggcctcacggtgttttcggatggtgtccagaatctcattgagaagggatacagaaagataactcctttcttcatcccatatgctatcacaaacatgggttctgccctgcttggaatggacattggtttcatgggtccaaactactccatctcaactgcctgtgctacctcgaactactgtttctatgctgcagcaaaccatatccgtagaggcgaagctgatataatgatagctggtggcactgaagctgcaattattccaattggtgttggtggctttgttgcatgtagagcactgtcacagaggaatgatgaccctaaaacagcatccaggccttgggacaaggatcgtgatggttttgtcatgggtgaaggagctggagtcctggtcatggagagcctagagcatgcaatgaaacgtgatgcaccaataattgcggagtatttaggaggtgctgtgaactgtgatgcttaccatatgactgatccgagatctgatggtcttggtgtttcatcttgcatcaagcaaagtcttaaagatgctggtgtggcacctgaggaggtcaactatattaatgctcatgcaacatcaacccttgctggtgatctggcagaggtgaatgccatcaagcaagtcttcaaggacccatctgggatcaaaataaatgcaaccaagtccatgataggacattgccttggcgcagcaggcggtttggaagccattgctactattaaagcgataactactggatgggtgcatccaagcataaaccaatttaacccagaggaagcagttgaatttgacactgtacctaatgtaaaaaagcagcatgaagtgaatgttggtatctcaaattcctttggatttggaggtcacaattctgtcgtagtatttgcaccatttaagccataaggtgttccttgcctcacaaatcttggtcagaacagtgagatctgatttctgcgttcaattttcatgtgttctcttcggggtgaagtaatgtcagatttgaaccagcaacgttaaaaatgaactaaagatgagatacattgcgttttagatgactccatgttcacttagattgagcgcggctgtacaacattcctttgaatcatttgtaattgattgtactgtttttcatgtaatggaagaggagtcttgtagatgcacatctggaccttctagttaaatagcatacaaatgaatttggagggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaagtttttccctcccgggggggcccctcaaagggcaaattttgaaaatttccataaaacgggggggcgttcgaccttccttttaaggggcccaattccccctataggggggcgtttaaaaattaatgggccgggttttaaaaacgagagagtgggaaaaaccctggggttccccaattaaaccgcttggaaaaaaatccccttttccccgggtgggctaaaacgaaaaaggccccacccaactccctttcccaaatgttgccccccctgattggaatggaacccccccttttaccggccattaaaccccgggggttttggggttttcc

SEQ ID NO: 2649 - DNA, 260 bp, Zea mays
  Clone ID: PAT_MRT4577_7483C.1
cctatagtgagtcgtattatagtgtctaccagaccatgcgtcctgaaagactcctgccggcgacagacttcggtgtgtggagacgcgaggatcttgagtcgaggaaggtcgcacgggaggcgcagtaacatgttcgagcccggcacgatggacctctgggacgcctgtcgacagcatgttgcgctccaacatcacgtcggcgacctcgatgaagtccgctactggcgccttcgggagacgccggcagctgctggaaggaa

SEQ ID NO: 2650 - DNA, 693 bp, Zea mays
  UNSURE (1)..(693): unsure at all n locations
  Clone ID: PAT_MRT4577_74969C.1
  unsure (1)..(693): unsure at all n locations
gaaaataagaagacgttttcaactttcaagaaactaggaatttcttgtactgggaattaaagataacatactacaagaccggttaatctccatccacacccatctacaacacatcactggtaatacgacggtaaacatcagataagcatagacacccttctatgccttcttgggggacttagcggccttcttgggcgacttggcctccttgctcccaccggggggacgccttctccgccgtcttcttgggcagcagaaccgggttgatgttgggcaacacaccgccgtgggcaatggtgacaccggacagcagcttcccgagctcctcgtcgttgcggatcgcgagcagcacgtggcgggggatgatgcgcgtcttcttgttgtccctggcggcgttcccggcgagctccagaacctcagcggcgaggtactcgaggacggcggcgaggtagacgggagcgccggtgccgacgcgctgcgcgtagcggcccttcttcaggtagcgcccgatgcggccgacggggaactggagcccggccttcaccgacctcgacactgacttcttcctcggcccgccggccttgcgtccggccgctcccttcttcgccttccctcccgctccggcggcggtggagtccatggccgcggctgtgctgcgagttgcttctcgggacagaggacaaagggctntgg

SEQ ID NO: 2651 - DNA, 225 bp, Zea mays
  Clone ID: PAT_MRT4577_75055C.1
agaagctgtgtttccgtccctaccgtgagcttctgctagcggggtgcctgcggaggagagactgggatgccatagacagtggtggcattgtgaacacgggcggagtcaatgactaccccgggaagcttaccctcttcatggagatcacctgcatcgtcgacgacaccgggggtctcattttcggatatgacatcggtatcttaagcggtgtgacgtgcatgaacc

SEQ ID NO: 2652 - DNA, 398 bp, Zea mays
  Clone ID: PAT_MRT4577_75338C.1
cccacgcgttcgctcacacgtccgcacacgcgtccgcccactcgttcgcccacacggccgatctttccatttccctatctgccactatacaattcgcgagttcttccttctctgccgccatggcgctctatgtggacaacacctcgtatggacgggagtacaacgtccaggatctctagcaagcgcacttagctcgccttgagattgatctggcccaggtcgaaatgcccgaactcatggcctgccccgcccagtttggcccgtccaagccctttgccggcgctaggatctccgcgtctcttcacatgaccattcacaccggcgaactgatcgagacccttaccgcgctcgatgccgaggtccgttggtgctcctgcaacatcttcttcacacaggac

SEQ ID NO: 2653 - DNA, 230 bp, Zea mays
  Clone ID: PAT_MRT4577_75455C.1
ctaggcataagcattgcaaccacagacagcgcgcgcttcaaggccttttttttttgagataacaaggacgagaggaggagatggctgtcacgatcacatgggttaaggccaggcatatcttgtacaggcggaggaaccccaccgtgtaggaggacttgtgccttaacgactgcagctactcgaggagggcgcgacccagcatcgcatccactggaatatatgaagccttg

SEQ ID NO: 2654 - DNA, 363 bp, Zea mays
  Clone ID: PAT_MRT4577_75495C.1
actgaagaagccactctatagcgggttctactactagtagctagcctgctgatctgggctgttgatcagttcgctaagccttctgtttctgcgaccatggtggatgagaggaacacccagcatcaccagtgcggtcaggtccagcaggacaccgatcgatcaggtggacgtgaatgatatggagctcctgaacagccttctcggcaggaataaccacgactacgaccagcacaagaagaagctcacggataaactggcgaccagcatggacaaggtcactgtgtccgagcccgataagcacggtcacaaggatgatgagcacgatgtcatcggcgataataatgagggccttattgacaatct

SEQ ID NO: 2655 - DNA, 1455 bp, Zea mays
  Clone ID: PAT_MRT4577_75511C.1
agggaaaagctgaccagcatcccgtaggaacaggatgcagagccatgaactctcaaacaaaaccatataataaagctcaacaaaacacgattaaagattgtataaatggcagccacgccatcagcctcacacctataggaagcacgaccaccaccaccaccacaaaacattgggtacctcgaggccggccgggccggggcggacctctctgccttttccttttccttcccccgctttctccttccttcctcctcctcccggctcccctcacccagccaccggccatgtcggtggagacggagcggagctccaccgagtcctccggggcttccgggctcgacttcgaggacaccgcgctcacgctcaccctccgcctcccgggctccgcgccttccgccgccgccgccgccgcggcttccctgtccctctcctcctcgtcgtcctccgccttccccgaccccgaccgcaagcgcgcctcctccgacgctgaccccggccgctcctccccgctcgccgcgtcctccgacgctgcaccggcacccaaggctcgtgtggtgggctggccgccggtgaggtcgtaccgcaagaacgcgctcgccgacgccgcgggctccagcaaggccgccaagttcgtcaaggtggccgtcgacggcgcgccctacctgcggaaggtggacctgcaggcgtacgccggctacgaccagctgctccgcgcgctccaggacaagttcttctcccacttcaccatcaggaagttcgccgacgacgagaggaagctggtggacgcggtgaacgggacggagtacgtgcccacgtacgaggacaaggatggcgactggatgctcgtcggcgacgtcccctggaagatgttcgtggaaacctgccagcgccttcgtctgatgaaaggttcagaggccgtgaacttggcaccaagagccgcccgatgaggcacactccgttgggcgttggcacgcacgcacgcactggcgtcttgaaggaaagggggaactctgctggtcttgatgaggatcttcacgtgagataggaacgtgtgtacagttgtcgccttatggtattgagttgaggaaacttggaagttccattacttgtctgtagtctctactttatatagatgcgaagaagcttgagatacacattgcctacaatgtcttttgatgaataagaccagacagcaccgaaccgaactcgtcctccacacggttgctttgccatctcggtggttttgtggtggtggtggtggtcgtgcttcctataggtgtgaggctgatggcgtggctgccatttatacaatctttaatcgtgttttgttgagctttattatatggttttgtttgagagttcaaaaaaaaaaaaaaaaaaaaaaaaaaaaaaaaaactcactctatcagcgtcgtcgacccggaaaattaattccgggcgcggtaccagcgaggc

SEQ ID NO: 2656 - DNA, 290 bp, Zea mays
  Clone ID: PAT_MRT4577_75526C.1
ggttggcttctcctcgccctccggttcgggttcggtttcgttaggttctccggtgttcggtttcgtgggtgggcggatcgagatgtcggcgtcggtatttttagtaccgctgcttcgtcgtcgtactcgtctgtaccactgacgaccattctctccacaacgccttcagcagtgacggcgatgtcctctagtccaagatcatccgcgatcgtgagaatcataggtccctcggcttcgtcttcttcacctgctccacggattatgctattcgtaacgccatcgaagtcatg

SEQ ID NO: 2657 - DNA, 405 bp, Zea mays
  Clone ID: PAT_MRT4577_75536C.1
acgaggcccagtcccgcagcggccgtggatgcttcggcggtgggtacggtggtggccgtgagtggggctgctacggctgtggcgggcgccgtgatggcagcggcggctacggcggtggcggcagctaccgtggcggctgcggctaccgtggtggtggcagcggctactgcggtggcaaccgtggcggcagctacggcaactcccacgggaactggaggaactgagcggtggggcccgcgcggccaagttatcctgttcgctgccgcgatgtttaccctagtgcatagggtttatcttcgatcgtctcgtgtttgttgttcccatctggggttttgacttgcaagtcgctctgtgacagatgctaatgctgtgttcattcttcgcttcagcagacccatgcattaa

SEQ ID NO: 2658 - DNA, 412 bp, Zea mays
  Clone ID: PAT_MRT4577_75564C.1
cctccttttttttttttttttttttttttttttttttttttttttttttttttttttttttttttttttttttttgggaaaaccccgctcacatttctgaaagaaaatgtgtgactagatagaaatattggtggcatcacaggtcaaataacaaccggctttgaaaaccggctaaaaaacaaacgggtggttgaaacaagcaaacataaaaaaggctagcgaaggtgaaaatcggcttccattgccactttccctaaagcaagcaataggcaaacccggataaaggagcctttgtgcacttggaaaactcctttgggggtggacgcaaggcgaccccttcgaactggtcgatggaatacttcttgaatacaaccctcagcttgctctcaggggcagtcatgtgcgcgaacac

SEQ ID NO: 2659 - DNA, 1819 bp, Zea mays
  Clone ID: PAT_MRT4577_75661C.1
gggaccctcgaggccggccatgaccccatttcatttctctacctctccagctgcccacttctctgtgagcgcgcgcgagtgtggagagaagggagggaattcccccctttctgttcggcgccgtgctcgcgcgcacccacccgcacgccccagtacccccacgctgcacagtgcacgccgccttttcctccgccttgctgctgcaagtccgcaaccactggaggaaaaatcttttccttcacttttcttccctttccccccgcgcatgcacgggctctgattgacgccatgggggacgccgcagccgccgcggcctccacgtccgctcccaccacgcccacctccatcctcatctgcctggaagacggcagcgaccttctcgccgatgccgacgatggcgccggcactgacctcgttgtcgcccgcgacgaacgtctgcttgtcgtggaccaggacgaggagtatgtagcgctgctcctgtccaaggagagcgcgtcaggcggcggcggcccggtggaggaaatggaggactggatgaaggccgcgcgctccggatgcgtccgctggatcatcaagaccacggcgatgttccggttcggcgggaagaccgcttacgtcgcggtgaattacctcgatcgcttcctggcgcaacggcgagtcaatagggagcatgcgtggggtctgcagctgctcatggtggcgtgcatgtcgctggcgaccaagctggaggagcaccacgctccgcggctgtcggagttgccgctggacgcgtgcgagttcgcgttcgaccgcgcgtccgtgctgcggatggagctcctcgtcctgggcaccctcgagtggcggatggtcgccgtcacccccttcccctacatcagctgcttcgcggcgcggttccggcaggacgagcgccgggcggtcctcgtgcgcgccgtggagtgcgtcttcgcggcgatcagagcgatgagctcggtggagtaccagccgtcgaccatcgccgtagcatccatcctcgtcgctcgcggcagggagacgcccgccggcaatctggacgcgctcaaggcgatcctgggctcatcatttccgcagctagacaccgggcatgtgtactcctgctacagcgcaatgattcgggaggacgacaagtcgccgacgcagtcgacgtcgacgtcgacgggggtggcgtcctcgggcgtctctgtcgccgcgcacgccggggggagcgggagtcccagccccccgggcgcttccgtgtccgtgggcgccaataatgccgctggcaccgccccgccggcaaccacggacaaccgcaacaagaggagacggttgcgctcacctcagcgacagtaggagcagctcagctgctggcagtgcattgcagtgcagtgcagtccagctgcgttttcttttttcagctcaccatttccttttgctgccgattgtttcttcaggggtggccgtagagtgatttggtaatttagtgccggaaagattagtgcggtgtcgcagagtgatttggtaatttagtgccggaaagatttctttgttttgaggagatctttcgcgggaccaaagggaggggggcagtgtaaagacgacagaacaagcgtgaaggcctcgagagtcgagacctcacagggtaccgcctagcgcctactggggtgaaagtgaagtcaaggagtcgggagggtgtgtgtgaataccgtttgtagcagctagtgcgtccgtctgtctttttttttttctttctgtttattaattattaatagcctgctagatttcatttaaaaaaaaaaaaaaaaaaaaaaaaaaaaaaaaaaaa

SEQ ID NO: 2660 - DNA, 1497 bp, Zea mays
  Clone ID: PAT_MRT4577_75907C.1
atacatactatcaggctagaccgggactgagtatagtacctctcttcccgctctcctctcgaggcggccggacgcctgcggcctgcctgcctgcctgcctgagtcctgacaccatactatacctccccctccccggccctgtcctactagccgtcagaggtttgccgcctcctcgctcctcgtcttcatcaccctctctctctctcttccttcgtcctcgacctgtggccacctgtggcgtcacgctttataagagcacgcggccggcaaccatctcccttgccacccacaagtagagaagaatcttttgttgctgacgcctgagacgctggcactgccgccgcgccgtctggagagaaagagcagagggacactgaagcagaggagccgaggggtagcgacgagagacgagcgagagcggccgacggagatggaagcaggaggagcaggagcggagggggtgatgagggtgctgctggtggacgactcccccgtcgaccgccgcgtggcgcagctgctcctcagcagcaactcctgcgccggctcattccacgtcatcgccgtcgacagcgccaagaaggcgatggagttcctcggcctcaaggacggcggcaaggagcaggccatcgacatggtgctcacggactactgcatgccagagatgaccggctacgacctgctcaaggccatcaaggcgctgaacccgctgaagccgatccctgtcatcgtcatgtcgtcagaagacgagccccagaggatcagccgatgcctgaacgccggcgccgaggacttcatcgtgaagcccctgcagagcaaggacgtgcagcgcctccggaactgctccacggtcgggaggcccagcaacaagggcggcgccacgttgccgtgcgaggagaacgccgtggccaagtggagtaacaacaagctgccgccctccgccggcgccggcgccggcgccagcgccacgtcgccgtcggggcggcgggcgaacctcgccggagtcgccatgcgccaggtgctgcactcgtcgagagtggagatctcgcagtacctgccgctcctgctcaagctcgtcgtgctggcgtacgccgcgctgtgcctgggcgagctcctgcacagatggtcgtcgggtggcagctgctcgctctccccgtggtgcgcctgatcaggaaggagcaagcagcgcaaaaggccagcaacggtgcaagagcccccctgggcaccgacgacaggagactgctgatgcaccaagcattatttcagaggctccaatagccctagtcttttaatttaggtagatgagattgtctgctctgagatcctaaccggggtttcgaccgatgatgagtccccccgtggcttttgttcgttgatttgaggggccggggccgtagacgtaggaaggagaggaacggaacgaaccccttgtatcctctgctctgtatagaatgaatgaatgaacgaatgaatcagaatgcaacgcgtcaaaaaaaaaaa

SEQ ID NO: 2661 - DNA, 2130 bp, Zea mays
  Clone ID: PAT_MRT4577_75935C.1
ctcgaggccggccggaaacccgggtctgggtggcgtcgcctttcatcattcccccctcgtgctctctctcgaaccttcttccaaagcacccgaaccctagtgatctcggaaccctagccgcgcgcggatctcggcttttccccttcctccacgccagccatggacggggacttcgagatgcctcccgccggcgccgatgacatgatgggcgacgacgagatgggcgacttcggcggcgacgagggcccggtgatgaaggtgggcgaggagaaggaggtcggcaaggaggggctcaagaagaagctgctcaaggagggcgagggctgggagactcccgaggtcggcgacgaggttgaagtgcattacacgggcacgctccttgatgggacaaaattcgactcaagccgtgatcgtggagaacccttcaagttcaagcttggacaaggtcaagtgataaagggttgggatcaaggaatcaagaccatgaagaaaggagaaaatgctatttttaccattcctccagagctggcttatggagcatctggttcacctccaactatcccacccaatgcaaccctgcagtttgatgttgagctgctttcatggaccagtgtcaaagacatttgcaaagatggcggcatattcaagaagatccttaaagagggagagaaatgggagaacccaaaggatcctgatgaagtacttgtgaaatacgaggcctgtctggaagatggtactgttgtatccaagtctgagggggttgagtttactgtgaaagatggctacttttgtcctgccctggctaaagctgtcaaaaccatgaaaaaggcagagaaggtgctccttacagtaaagccacaatatggatttggtgagaagggtagaccagcagctggagaggaaggtgctgtgccgccaaatgcttcgctgctcattgaccttgagttgatttcatggaagactgtcacagaaattggggatgataagaaaatccttaagaaggttctcaaggagggagaaggttatgagcgtcccaatgagggtgctgttgttgaagtcaaaattatcggaaagcttctggatggcgcggtgtttacaaagaaggggcatgacgaagagctatttaaattcaagaccgatgaagaggaagttattgccggtcttgatcgtgctgtgttgaacatgaagaagggcgaggttgctcttgtcacaattcctcctgaatatgcatttggttcgcctgcgtcaacgcaggatcttgctgttgttccacctaacagcacagtgatatatgaagttgagcttatttcatttgtgaaggacaaggagtcgtgggacttgaacaatgaagagaagattgaggctgctggtaagaagaaagaggaagggaatgcattgttcaaatcaggcaaatatactagagcttccaagcgatacgagaaggctgccaagtacattgagtacgacacttcgttcagtgaagatgagaagaagcaatccaagcaactgaagatcagctgcaacctaaacaatgctgcctgcaaactgaagttgaaggattacaaggaagctgcgaagctttgcaccaaggttctggaacttgacagccaaaatgtcaaagctctctacaggagggtgcaagcttacattcaacttgctgacctagagctagcagaggccgatatcaaaaaggcactggaaatcgatcctgacaacagggatgtcaagttggaatataagatcctgaaggagaagatcaaggagtacaacaagaaggacgccaaattctacagcaacatgttcgccaagatgacaaagtaactgtcactgccctaagtcagcgtagcttttggggtggaggatgttgtggtgaagcaaagggattaaaaacaccgatttctgctgccaaaggacttcgcccgttgcttaacttctcgcttttcgcatactttgtagtcaactagtgtgcacggatgcttggatatgtgaaactgaggaacatgtacttcgaggattattattggttctgaatttttatgttttctggttcttgttaggaccattgaatgttctctatataattttcggacgccaaaaaaaaaaaaaccacgggagcaaaagttggatgcg

SEQ ID NO: 2662 - DNA, 2187 bp, Zea mays
  Clone ID: PAT_MRT4577_75937C.1
ccggccggactcggggggattaaacccgggtctgggcggcgccggccgggatcatttcccccctcgtgctctctctcgaaccttcttccaaagcacccgaaccctagtgatctcggaaccctagccgcgcgcggatctcggcttttccccttcctccacgccagccatggacgaggacttcgagatgcctcccgccggcgccgatgagatgatgggcgacgacgagatgggcgacttcggcggcgacgagggcccggtgatgaaggtgggcgaggagaaggaggtcggcaaggaggggctcaagaagaagctgctcaaggagggcgagggctgggagactcccgaggtcggcgacgaggttgaagtgcattacacgggcacgctccttgatgggacaaaattcgactcaagccgtgatcgtggagaacccttcaagttcaagcttggacaaggtcaagtgataaagggttgggatcaaggaatcaagaccatgaagaaaggagaaaatgctatttttaccattcctccagagctggcttatggagcatctggttcacctccaactatcccacccaatgcaaccctgcagtttgatgttgagctgctttcatggaccagtgtcaaagacatttgcaaagatggcggcatattcaagaagatccttaaagagggagagaaatgggagaacccaaaggatcctgatgaagtacttgtgaaatatgaggcccgtctggaagatggtactgttgtatccaagtctgagggggttgagtttactgtgaaagatggctacttttgtcctgccctggccaaagctgtcaaaaccatgaaaaaggcagagaaggtgctccttacagtaaagccacaatgtgagattccatttcaagatggatttggtgagaagggtagaccagcagctggagaggaaggtgctgtgccgccaaatgcttcgctgctcattgaccttgagttgatttcatggaagactgtcacagaaattggggatgataagaaaatccttaagaaggttctcaaggagggagaaggttatgagcgtcccaacgagggtgctgttgttgaagtcaaaattatcggaaagcttcaggatggcgcggtgtttacaaagaaggggcatgacgaagagccatttaaattcaagaccgatgaagaggaagttattgccggtcttgatcgtgctgtgttgaacatgaagaagggcgaggttgctcttgtcacaattcctcctgaatatgcatttggttcaactgagtcaaagcaggatcttgctgttgttccacctaacagcacagtaatatatgaagttgagcttatttcatttgtgaaggacaaggagtcgtgggacttgaacaatgaagagaagattgaggctgctggtaagaagaaagaggaagggaatgcattgttcaaatcgggcaaatatgctagagcttccaagcgatatgagaaggctgccaagtacattgagtacgacacttcgttcagtgaagatgagaagaagcaatccaagcaactgaagatcagctgcaacctaaacaatgctgcctgcaaactgaagttgaaggattacaaggaagctgcgaagctttgcaccaaggttctggaactagacagccaaaatgtcaaggctctctacaggagggtgcaagcttacattcaacttgctgacctagagctagcagaggccgatatcaaaaaggcactggaaatcgatcctgacaacagggatgtcaagttggaatataagatcctgaaggagaagatcaaggagtacaacaagaaggacgccaaattctacagcaacatgttcgccaagatgacaaagtagcttttggggtggaggatgttgtggtgaagcgaagggattaaaaacaccgatttctgctgccgaaggacttcgcccgttgcttaacttctcgcttttcgcatactttgtagtcaattagtgtgcacggatgcttggatatgtgaaactgaggaacatgtacttcgaggattattattggttctgaatttttatgttttctggttcttgttaggaccattgaatgttctctctatataattttcggacacatgttcttaataaaccacgggagcaaaagtttatgctaaaaaaaaaaaaaaaaaaggcccctagggcccacccctgggggagagtttttctct

SEQ ID NO: 2663 - DNA, 301 bp, Zea mays
  Clone ID: PAT_MRT4577_75952C.1
gaacgaacgacctgccccatatgacctttgtttccagcagggatgatgtgggaaagtgcatggccttttattttgctcaggggatcctccaacatgaccccttcaaggtcctggaccaaaggggagtggccgacctgttaaattttgctacagaaaggggcctcaatgctagccctaacttgaaggtggccatttgtggaaaacacggtggaaagccttcctctgtggccttcttcacaaaggctgggctgaattacttatcttgcccccctttcagggttcctattgctaggctaacttc

SEQ ID NO: 2664 - DNA, 885 bp, Zea mays
  Clone ID: PAT_MRT4577_7601C.1
taattcggcacgaggttcccctcctccaagcaaatccgaggcccacccacgggccgctcgaacatctgtcaccgccaagtggccccaccccacccctcccctccattgccccttcttctacaaataccccggccggccgcggccgttcccgaatcgagcggtgactggcgaggcaaaagcgcaaacgcgaccacagacagagcgcgcttcaaggccttttttttttttttttgagataacaaggaggagaggaggagatggcggtcacgatcacctgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaacgtaaacaacattattggaccagcgattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggagccatgaagatgggaagttgaggtgtaccacaacctgaagagcataatcaagaagaagtacggtcaggatg

SEQ ID NO: 2665 - DNA, 202 bp, Zea mays
  Clone ID: PAT_MRT4577_76050C.1
ccaattctctatagtgagtcgtattacctgagcctccagcgaccggctccaccaccatctgcgcgcttcgcgcgcgcgcaagggaccggtgtggcatctgaggctccattgacctcttagcgggtgtattagcaatagtgacagccctggtgcctgtgtgcgccgatgcccatggccattgtctctatacatcctctagctc

SEQ ID NO: 2666 - DNA, 371 bp, Zea mays
  Clone ID: PAT_MRT4577_76057C.1
gtcattcattacggtttttttttcaaaacactgggggacatacaataaacgactggcaggcaaaatcggacatttccaatagaatggaaacgaattgtttgtatcgcatatacggattggccatttttttctcagttactttccataaataacaaaataaatcgcacttggggtcatactgtgggtataccaagtctttgttgcatagcaaacctgttgtaaccacggttaaatccctaaattgcaaagatatttgagctataaatatcaacaacattctgtaaagggttcctttttatccttatggatcctattggcaggagcgttgtatccacccttaaggattactgctttgtgaaaaccttacaaac

SEQ ID NO: 2667 - DNA, 384 bp, Zea mays
  Clone ID: PAT_MRT4577_7607C.1
cccgtacctctcaccagcggtgtcttctgtatgtgcaaacccaattcttggaccctggaggatccaacaggcaagcgcagctggcatcttacctttatcacccatgttcctccaacaattatcatccttattacaacagtcacctttggtgcatctattggcacaaaacatcatggcacatcaactaccacaacttgtactagcataccttgctgcctactatcagcatcagcagcatatttcattcaaccaactaggttcattgaactctggttcttatttgcaacaactgcaactaccattcaatcagctacctgcttgcctacgcttagcaatctactccattcaaccaactagcatcattcaactcttttgcttatttac

SEQ ID NO: 2668 - DNA, 817 bp, Zea mays
  Clone ID: PAT_MRT4577_76608C.1
atctcccacagcgccacctctcccttccagtcatctgacatctgctcccgtcctctcctcttctcttccccccgaagcagcagcgtccctcctctccgcccggatcgcgatggccgccgccgccgtcgccgccgactccaagatcgacaacctccgcgacgccgtcgccaagctcggcgagatcagcgagaacgagaaggccgggttcatcagcctcgtctcgcgctacctcagcggcgaggcggagcagatcgagtggagcaagatccagacccccaccgatgaggtggtggtgccctacgacaccctcgcgccccctcccgaagatctcgacgccatgaaggccctgctcgacaagctcgtggtgctcaagctcaacggaggcctcggcaccaccatgggctgcaccggccccaagtctgtcattgaagttcgcaatgggtttacatttcttgaccttattgtgattcagattgagtccctgaacaagaagtatggatgcagtgttcctttgcttctaatgaactctttcaacactcatgatgacacacagaagattgttgagaagtactccaactccaacattgaaattcacactttcaaccagagccaataccctcgcattgttactgaagacttcttgccacttccaagcaaagggcagacagggaaggatggctggtaccccccaggccacggtgatgtgttcccctctttgaacaacaggggaaaactcgataccttgctgtcacaggggaaaggagtatgtcttcgtggcgaactcagacacttgggtgctattgttgacatcaagata

SEQ ID NO: 2669 - DNA, 496 bp, Zea mays
  Clone ID: PAT_MRT4577_76677C.1
cggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgatcgcccacgatgctgccacatgtggcggccttaccgcctgccaccatcgttccatgtgccgccgccggttcgtctgccgcctccaccatgccactaccctactcaaccgccccgggctcagcctcatccccagccacacccatgaccgtgccaacagccgcatccaagcccagggcaactacaagaaacctgcgaacttgacaacaccccgatcctgaggaagaggggcaaggtcctgagaaatcaatacaggccaacaacaacagccta

SEQ ID NO: 2670 - DNA, 1956 bp, Zea mays
  Clone ID: PAT_MRT4577_76736C.1
accgcggggttcatggtaaccagagtgttatttaagactaccaccgtacaaaaaaaaaaaaaaaaaaaaaaaaaaaagaaaaaaaaaaaaaaaaacatcgaggcgggccggcgtttgggctcatatcttcttctcgtccgtctcgcttctctctctcctgaggcgcagcggtggggtggggtggggccgtagggggagcggcattgcgagctcacaccacctgcggcgcggcgatcccgggccaccggctatcgggctatgtgatgatccgggccgtgatctcgacggctattcgcggctgaacgggcggcggcgatgaacggagcgagcgccggcgccggcggggaggcgccgctggtgtacaaggcctggaaggggaacaatgtgtttctactgaaggggaggttcatatttggccctgatgcaagatccctgtttatcaccatgttccttattgtcgcgccggtatcaattttctgcgcgttcgttgccaaggaattgatggataagttctcttatggtctgggattgccggttatgattgcagcagttctattcacagcatatgatctgagtcttctgcttctaacttctgggagagatccagggatcatacctcgcaatgcacatcctccagaacccgaagggtttgatggcaatgcagaggttggggctaaccagactccacccgtgcgtttgccccgagtgaaggatgttgttgtcaacggaatcactgtgaagacaaaatactgtgacacttgcatgttgtacaggcctcctcgttgctcccattgctctatctgcaacaactgcgtggaacgttttgaccatcactgcccctgggttggacaatgcataggacttaggaattacaggttcttctatatgtttgtattctcaacaactttgctctgcctgtatgtctttgggttctgctgggtgttcattattaagatcagaaatgccgagcagataacaatttggaaggcaatgacaaagacccctgcatctattgccttaatcatctacacattcattgcagtttggtttgttggtggcctctctgtgttccatctgtatctcatgagcacaaatcagacaacatatgagaacttcaggtatcgctatgatcagcgagacaacccatacaacaagggagtcatggaaaacatcaaagagatcttctttacaacgatccctccttccaagaacaacttctgtggtagggtcgaacaggagcatggtctgaggccccgtccaacgaatggtttcatgagtccaaacatggggagagctgttggcgacattgagatgggtagaaaaccagtggcttgggatgagcctaggatggcggctgaaattggtgatttaggagcaggtctgagcaacctgttggaggacaaggatggcaggtttcgtaccacatctccagatctcagccgcgacgcccttgcggttggaggaggcttagaagagcacggatcctcggcgatgaaccctgggcgctcaagctggggagttgaagcaggtcgatgatggcaatggcattgaccatgtaaggcggatgtagtgagatgctcagggttgttagtgccagttcgtcgctaatttgttgttttgttggagatttgaggtcactaatgttattagacttatgacctgtatggctgttgtttctggactttcttttcttcttcctcttaatttggggcgtcttccatgtccattgtttgaagcagtcggtttgtgacgtctccagcttggtactgtcaggttttgtctgtatataatcggagcagtaagcctaaaataggtttcggttgcttgggtttggatggtaatggttgtgaacaatgttgaaccttcgcattgcagtaaatgaacatcgtttgatcggagtgcttaaaaaaaaaaaaaaaaaagcgaaaaaaaaaaaaaaaaaaaaaaaccccaagg

SEQ ID NO: 2671 - DNA, 818 bp, Zea mays
  UNSURE (1)..(818): unsure at all n locations
  Clone ID: PAT_MRT4577_76902C.1
  unsure (1)..(818): unsure at all n locations
gggccgcctctgaagaagggccctggacgtcggcggaggacgccatcctggtggactacgtgaagaagcacggcgaggggaactggaacgcggtgcagaagaacaccgggctgttccgctgcggtaagagctgccgcctccggtgggcgaaccacctcaggcccaacctcaagaagggggccttcacccccgaggaggagaggctcatcatccagctccactccaagatgggcaacaagtgggctcggatggccgctcatttgccagggcgtactgataatgaaataaagaattactggaacactcgaataaagagatgccagcgagctggcttgccaatatatcctgctagtgtatgcaatcaatcttcaaatgaagaccagggctccagtgatttcaactgcggcgagaatctttccagtgaccttctgaatggaaatggcctttatctaccagattttacctgtgacaatttcattgctaattcagaggctttatcttatgcaccacagctttcagctgtttcaataagcagtttgcttggtcagagctttgcatccaaaaactgcggcttcatggatcaagtaaaccaagcagggatgctaaaacagtctgaccatttactccctggattgagtgacaccatcaatggcgcgctctcctcggtcgatcagttcccaaatgactctgagaagctcaagaaggctctgggttttgactatctccacgaagncaactctagcagcaagactattgcaccatttgggggtgcacttactggcagncatgcncttnntaatggcaccttctctacttct

SEQ ID NO: 2672 - DNA, 275 bp, Zea mays
  Clone ID: PAT_MRT4577_76926C.1
acataatacaagattgtccttcgacaaaataaaaaataaaaaaataaaaccatgcgtggtatttgttatttcagtactatacaaaggtatgctcagttcagtactctagaaccatttagccactatatttacatgaactcgtaaggttaacagtgcccaaaacatactaagttatctcacttaacggcattactacgccaggggatgtgtctaagtattctcctcgagttgccactaccaatgcctcatttcctaatacgcatgaggtactctag

SEQ ID NO: 2673 - DNA, 1004 bp, Zea mays
  Clone ID: PAT_MRT4577_77005C.1
ctggtgggcttctcttgcgtgacctactacacgtcggcgctgctcgcagactgctaccgctacccggaccccgtccacggcgccgtcaaccgcgagtacatcgacgccgcccgatgctacctggaccggaagaacgtggtgctgtgcgggtgcgcccagtacgtgaacctgtggggcactctcgtcggctacaccatcaccgccagcgcaagcatgatcgcgattaagcgcgtcaactgcttccaccgggacggctacggcgccgccggctgcaacccgtcggggagcacgtacatggtggtgttcggtctcttccagctcctgctgtcgcagctgcccagcctcctccgcacgtcgtcgtcctcgtcgcccccgcccaccctggccgtcgcgccgctcaagctcgtcctgcgcaccatcgtcatcatgttcacaacgctcgtcgccatgctggtgcccttcttcaacgccgtgctgggcctcatcggcgcgctcggcttctggccgctctccgtctacttccccgtcagcatgcacatggcaaggctcaacatccgacgcggagagatccgctggtggatgctgcaggccatgagcttcgtctgcctcctcatctccgtcgcagccagcatcggatccgtgcacgacatcgtgcacaacctcaaggccgccgcgccattcaacactgcaaactgattaataaacatgcatttactagtatatatacggatcggatcggaggagtgatgggttaattagtttcttaattagctttggctactatatctatcagtatcagagtcagaggagcagagggccggccacatgcatggcctttttgtgtttcttgattatatatctggcaaatttgatctgtcgagcagattttcatgcatgcatgcatgctgctaattcggacgtacgttgaactagtaataatattattatttgtaatgtaaccccagcaatgcaatgcaatgcaagaagcaacaataatatttgcc

SEQ ID NO: 2674 - DNA, 227 bp, Zea mays
  Clone ID: PAT_MRT4577_77107C.1
gtgcaaacagaagcttgtagcaaatgcccttcttgcggtttcacttgctgtgtgcaaagctctagctatggttaaaatgattactgtctaacagcacattggaaatcttgctgggaacaaaaatatggtgctccctgtacctgccttgaatgcgattaatggaaggtcacatgctggaaacaagcttgccatgcaggagttcatgatcctacctactggtagcctct

SEQ ID NO: 2675 - DNA, 517 bp, Zea mays
  Clone ID: PAT_MRT4577_7710C.1
cccccctctcgagtttttttttttttttttttttttttttttttttttttttttttttttttttttttggggagcaatttatgcaacatgccatcctgctttataattattacaaaagcgacaaacccctccaatcacacgtgaagggggggcccagggtgaaaaaaaagtcttattaaaaggaagggggaaaatgacgaatttaaaaaataatgggaccctttgtcacgtccactcataatatatccaacaaccccccccggccgggcggtttactcgctgcccggaccggaggtagctttcgtgaccccggggaaaatgaccctggtgccaagcagctccttgccgacctcgggggggaatgtgtcgtaccggaggaaaagctcgacgaggaggagcctgccgaccaacaccacaaagtttttcccggggcactgtttgttgccaaccctggggttctcggcctcccggccgttggaccagtacacgtactggagcagtttgctgccctcctcgc

SEQ ID NO: 2676 - DNA, 2004 bp, Zea mays
  Clone ID: PAT_MRT4577_77280C.1
acccgtgcaaccacttcactcatcacttccacttatgttccacattgccgtgccgtgcggtgcgtgaaaggcacggggccgccggccggactcttctgacttggcaaccgccgcgcagcgcgacgagcgccacctgcttgctgccgcgtgcctgcgtgcgtgtgcgtccaccactgaccccgcgcccgcccgccgcccctgcccctccactccacttgctcactcgtcggctcgtcgcggcccgcttcccccccggccaagggatggacgcgcttcgcctacggccgtccctcctccccgtgcggcccggcgcggcccgcccgcgagatcattttctaccaccatgttgttccatacaacgaaatggtgaaggacgaatttgcttttctagccaaaggacccaaggtcctaccttgcatcaccatcagaaattcttcgaatggaaatcctcctattgtaggatatcacatcggtcattaaatacttctgttaatgcttcggggcaacagctgcagtctgaacctgaaacacatgattctacaaccatctggagggcaatatcatcttctctagatgcattttacagattttcccggccacatactgtcataggaacagcattaagcatagtctcagtttcccttctagctgtccagagcttgtctgatatatcacctttgttcctcactggtttgctggaggcagtggtagctgcccttttcatgaatatctatattgttggactgaaccagttattcgacattgagatagacaaggttaacaagccaactcttccattggcatctggggaatacacccttgcaactggggttgcaatagtttcggtctttgccgctatgagctttggccttggatgggctgttggatcacaacctctgttttgggctcttttcataagctttgttcttgggactgcatattcaatcaatctgccgtaccttcgatggaagagatttgctgttgttgcagcactgtgcatattagcagttcgtgcagtgattgttcagctggccttttttctccacattcagacttttgttttcaggagaccggcagtgttttctaggccattattatttgcaactggatttatgacgttcttctctgttgtaatagcactattcaaggatatacctgacatcgaaggggaccgcatattcgggatccgatccttcagcgtccggttagggcaaaagaaggtcttttggatctgcgttggcttgcttgagatggcctacagcgttgcgatactgatgggagctacctcttcctgtttgtggagcaaaacagcaaccatcgctggccattccatacttgccgcgatcctatggagctgcgcgcgatcggtggacttgacgagcaaagccgcaataacgtccttctacatgttcatctggaagctgttctacgcggagtacctgctcatccctctggtgcggtgagcgcgaggcgaggtggtggcagacggatcggcgtcggcggggcggcaaacaactccacgggagaacttgagtgccggaagtaaactcccgtttgaaagttgaagcgtgcaccaccggcaccgggcagagagagacacggtggctggatggatacggatggcccccccaataaattcccccgtgcatggtaccccacgctgcttgatgatatcccatgtgtccgggtgaccggacctgatcgtctctagagagattggttgcacaacgtccaacatagcccgtaggtattgctaccactgctagtatgatactccttcctagtccttgccagcaccagtgacccaaacttggtcggctgagctcagcgctcagcagctttacgtgcatctgcgccttgacttgtgcagtgggcgtcgctagcatgaatgatgtatggtgcgtcacggcctgacggttcgtcagtctgggccgtgttttgtgtccgaggaagatcgtctgtcagagatctggattgcctcgctgctacaaaaaaaaaattaat

SEQ ID NO: 2677 - DNA, 565 bp, Zea mays
  Clone ID: PAT_MRT4577_77291C.1
ctcacacatctattgttgttcaaagcctgtgtgtttactagcaaccaggtagctcgggcggcatagcgcagcctttatgtgggtgggagaagcccaccactttttcaactcaccacaagaaggaccaggagcagcccgccggcaagtacgggtactccgagaccggggtggtcaccgccaccgaccagggcgagtgcgagaggtacatgaaggaggagaaggaccacatgcacaagcaggacctcggggaggccgtggccttcgccgccggaaccttcctactctactagaagcacgaggcgaagaaagaccccgagcacgcgcacaggcacaatatcacggacgatgtcgatgccgaaagaacgtctgtgccggccgctacttttttcacgagcacaacgagaagaagatggaccacaacgaccccgatgaggccatcggtacagaagaaccaccaccacctcttcagatgacactataccagccggctcgcgaccgagctagctaactccggcgcacacaaccacacacatgtttaattgtgaactgcatgcgtgtgtaatac

SEQ ID NO: 2678 - DNA, 400 bp, Zea mays
  Clone ID: PAT_MRT4577_77349C.1
cggactcgtggggggctggcttctcctccccctcttaccaagtactcttcgggtaaggtacttaaggatgtgtggacgggctatggctgcgggtgatgtggattacctctactttgtcagcgggcttgcctatgtcaccactaacgagtcgctggagaatgccttcatctcctacggcgagatcctcgactccaaggtcatcacctaccggaagacggcgaggtctcgcggcttccgcttagttaccttctccttcgataactccatgctcgacgctatcgagaacatgaacggcaaggagctcgacggccgtaacatcaccgttaaccagacccagtctcttggcagtcgcggtggcggtggtggctacagcagcggtcgaagaaccggcggctatggt

SEQ ID NO: 2679 - DNA, 2003 bp, Zea mays
  Clone ID: PAT_MRT4577_77402C.1
acgcgggggcgcacacggcacacacaccacaccacacctcctcgcttgcactccgctcgtctgacatctcgtcccgtcctttcgtttcgaagcctcgcgagccccgacgatggccaccaccgcggtgtcggtcgacgagaagctcgataagcttcgcgccgaggtcgccaagctcgaccagatcagcgagaacgagaagtccgggttcatcagcctcgtgtcacggtacctcagtggggaggcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattcaaattgagtccctgaacaagaagtatggatgcaatgtccctttacttctgatgaactctttcaacacccatgatgacacacagaagattgttgagaagtattccaactccaacatcgaaattcatactttcaatcagagccagtatcctcgcattgttaccgaggacttcttgccacttcccagcaaagggaaatctgggaaggatggctggtatcctcctggtcatggtgatgtgtttccttctttgaataacagcggaaaacttgacatcttattggctcagggcaatgagtatgtctttgttgcagactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaagtacccgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggacgtatatttttactgaaatgatactccgaagagcacgtatggtgtcttaccgggaggactcattgccgccattctgccacatgcccccggtgctcgagaatattgttatggaaagggcacaaagtggccatattcccaaggtgataaacgccgtcatgcgggacacttttcgagcgaatggcgtttgtggtccgggagaccgggaccttgcggataagttcctcgcctgcttgttcgaatccaaggtgctagatccatcccgaataccagccggcaatcctgttagcactttagctccattctgcgggttgttagactagctctaacaagaaactctaaagagttctgtaccctaaatttagaggatcagatcgttctctatttactccagcagcgtcgtctaaacgatcctctaaatttagaaaacgcttgttggattttctatatatagagtttctttaaacgttaaaaaaaaaaaagaaaaaaaaaaaaaaaaa

SEQ ID NO: 2680 - DNA, 1922 bp, Zea mays
  Clone ID: PAT_MRT4577_77404C.1
ccttcgagtccgccgggacacggcattacggcacacacaccacaccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcaggcgagtgcccccctcctctccgcactagatctcgccgcccgatcgcttcgcctcccatttttgctgatttctgagtgtgtttttccgcgcagcgagaacgagaagtccgggttcatcagcctcgtgtcacgctacctcagtggggaagcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattcaaattgagtccctgaacaagaagtatggatgcaatgtccctttacttctgatgaactctttcaacacccatgatgacacacagaagattgttgagaagtattccaactccaacatcgaaattcatactttcaatcagagccagtatcctcgcattgttaccgaggacttcttgccacttcccagcaaagggaaatctgggaaggatggctggtatcctcctggtcatggtgatgtgtttccctctttgaataacagcggaaaacttgacatcttattggctcagggcaaagagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaagtacccgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggatgtcaatggccctgaggatctttaagcaatgtttgtcatcaccagtttttcccaaggacatgtcacaggaactgccaagcctagtcactcctactgagctctatattttgtaattttcatgtgcattccgattccgctgtgagggtcatgtgagcccgctagagaataattgtaatcttctttgctgcgtctgtacttgtgtttttgtgcgccaggacgtatatttttactgaaatgatactccgaagagcacgtatggtgtcttaccgggaggactcattgccgccaaaaaaaaaaaaaaaaaagcggcc

SEQ ID NO: 2681 - DNA, 2335 bp, Zea mays
  UNSURE (1)..(2335): unsure at all n locations
  Clone ID: PAT_MRT4577_77406C.1
  unsure (1)..(2335): unsure at all n locations
cccacgcgtccgcgcagaagcaccgaaaggtgtcacctctgctcgccttcgccttcaccttcaccttcaccttcaaatgtgactcggcttggcgcaaggggaatgaactccaggagacaggagcagcaggctcggcggaccatcagagcgctgctggccaagaacggagcgctgtgcacaggtgtttggagatgcaggagcggaggcgcagatatagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacggtacctcagtggggaagcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattcaaattgagtccctgaacaagaagtatggatgcaatgtccctttacttctgatgaactctttcaacacccatgatgacacacagaagattgttgagaagtattccaactccaacatcgaaattcatactttcaatcagagccagtatcctcgcattgttaccgaggacttcttgccacttcccagcaaagggaaatctgggaaggatggctggtatcctcctggtcatggtgatgtgtttccttctttgaataacagcggaaaacttgacatcttattggctcagggcaaggagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaagtacccgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggatgtcaatggccctgaggatctttaagcaatgtttgtcatcaccagttttccccaaggacatgtcacaggaactgccaagcctaatcactcctactgagctctatattttgtaattttcatgtgcattccgattccgctgtgagggtcatgtgagcccgctagagaataattgtaatcttctttgctgcgtctgtacttctgtttttgtgcgccaggacgtatatttttactgaaatgatactccgaagagcacgtatggtgtcttaccgggaggactcattgccgccattctgccacatgcccccggtgctcgagaatattgttatggaaagggcacaaagtggccatattcccaaggtgataaacgccgtcatgcgggacacttttcgagcgaatggcgtttgtggtccgggagaccgggaccttgcggataagttcctcgcctgcttgttcgaataccaaggtgctagttcctatcccgaaataccagccgtgcaatcctggttnagcactttagctaccattcttgcggcgttgttagcactagcttctaactaagaaactgtaatagagtttctgtaccgctaaatttagaaggatccagatacgttctcctattctacttccagcagacgtcctactaaacgagtccttctaaatttgagaagaacgttgttggattttcctatatatagagtttcttt

SEQ ID NO: 2682 - DNA, 2146 bp, Zea mays
  Clone ID: PAT_MRT4577_77410C.1
agcggagcactgctcccagcgctatcactgttgcttgtaggggaaggtttagaggtggccgctgcacccatctcgttaccctaaacgtgcacagtgcaaggggagggggaagggcgcggcatgcgctgaagacagtctgaggcgctgcgggcagtctaacagcaccccctcctcgctcgcactccgttcgtctgacatctcctcccgtcctttcctttctgaggctcgcgaaccccgacaatggccgcaaccgcggtgtcggtcgacgagaagctcgacaagcttcgcgccgaggtcgccaaactcagccagatcagcgagaacgagaaggccgggttcatcagcctcgtgtcacgctacctcagtggggaggcggagcagatcgagtggagcaagatccagaccccgaccgatgaggtggtggtgccgtacgatatcctcgcgtcacctcctgaagatctcgaggagacgaagaagctgctggacaagctcgttgtgctcaagctcaacggagggctcgggacgaccatgggctgcaccggacccaagtctgtcattgaagtccgcaatgggttcacattccttgaccttattgtgattcaaatcgagtccctgaacaagaagtatggatgtaatgtccctttacttctgatgaactctttcaatacccatgatgacacacagaagatcgttgagaagtattccaactccaacattgaaattcatactttcaatcagagccagtatcctcgcattgttaccgaggacttcttgccacttccaagcaaagggaaatctgggaaggatggctggtatcctccaggccatggtgatgtgttcccctctttgaataacagtggaaaactcgacatcttattggctcagggcaaggagtatgtcttcgttgctaactcagacaacttgggtgctatagtcgacatcaagatcctgaaccatctgatcaataaccagaatgaatactgcatggaggttactccaaaaacattggctgatgttaaaggcggtactctcatctcttacgaaggaagagttcagcttttggagattgcccaagtacctgatgagcatgtgaatgagtttaaatcaatcgagaagtttaagatattcaacactaacaacttgtgggtgaaccttaaagctgtcaagagactagtagaggctgaggcacttaagatggaaattattccaaaccccaaggaagttgatggtgtgaaagtccttcaacttgaaactgcagctggtgcagctattcgtttctttgacaaagcgattggaattaatgttccccgctcaagatttctcccggtgaaggctacatctgatttattgcttgtgcagtctgatctttacaccttggttgatggctttgtcatccgcaatccatccagagcgaatccagctaacccttcgattgagcttggacctgagttcaagaaggttgccaatttccttgctcggttcaagtccatccccagcatcgtcgagcttgacagcttgaaggtttctggtgatgtctggtttggttctggaattacgctcaagggcaaggtgacaatcaccgccaagtctggagtgaagttggaggttccagatggagctgtatttgaaaacaaggatgtcaatggccctgaggatctttaagctatgcttgccgtcaccagtttttcccaaggatttgtcaataggagcagccaacccaaatcactcccactgagctctaccttttgtaattctcgtgccattccgctcccgctgtgagggtcctgtgagcccgctagagaatatgactgtaatcttctttggtgcgtctgcccttctgtttttgtgcgccagggacgtatattttgctgaaatgatactaccatagctttgcgtgccggaaaaaaaaaaaaaagaaaaaaaaaaaaaaaaaaaaaagttcggccttgacaacccaacccgaccccaagttcccaacgcagaggatcgaactgaatcctccgcaactcgccgccgccgggaccgaccgacccgatcctatcgatcgaggatgtcgtacgcctacctcttcaagtacatcatcatcggcgacacaggcgtggggaagtcgtgcctgctgctgcagttcacggacaagcgcttccag

SEQ ID NO: 2683 - DNA, 2142 bp, Zea mays
  Clone ID: PAT_MRT4577_77417C.1
gcgttcgccccgcgtccgccccgcgtccgccgagcgtccgcccgggcagcgtcccctcgaggccggccgggacaagatcacttcgggaggcaagtgcgatttcgatctcgcagccaccttttttttgttctgttgtgtatctagtagttggaggagatatgcagtttgcacttgcattggacacgaactcaggtcctcaccagataagatcttgtgagggtgatgggattgacaggttggaaaaattaagtattgggggcagaaagcaggagaaagctttgagaaataggtgctttggtggtagagttgctgcaactacacaatgtattcttacctcagatgcttgtcctgaaactcttcattctcaaacacagtcctctaggaaaaattatgctgatgcaaaccgtgtatctgctatcattttgggcggaggcactggatctcagctctttcctctgacaagcacaagagctacgcctgctgtacctgttggaggatgttacaggcttattgatatccctatgagtaactgcttcaacagtggtataaataagatatttgtgatgagtcagttcaattctacttcgcttaaccgccatattcatcgtacataccttgaaggcgggatcaactttgctgatggatctgtacaggtattagcggctacacaaatgcctgaagagccagctggatggttccagggtacagcagactctatcagaaaatttatctgggtactcgaggattattacagtcacaaatccattgacaacattgtaatcttgagtggcgatcagctttatcggatgaattacatggaacttgtgcagaaacatgtcgaggacgatgctgatatcactatatcatgtgctcctgttgatgagagccgagcttctaaaaatgggctagtgaagattgatcatactggacgtgtacttcaattctttgaaaaaccaaagggtgctgatttgaattctatgagagttgagaccaacttcctgagctatgctatagatgatgcacagaaatatccataccttgcatcaatgggcatttatgtcttcaagaaagatgcacttttagaccttctcaagtcaaaatatattcaattacatgactttggatctgaaatcctcccaagagctgtactagatcatagtgtgcaggcatgcatttttacgggctattgggaggatgttggaacaatcaaatcattctttgatgcaaacttggccctcactgagcagccttccaagtttgatttttatgatccaaaaacacctttcttcactgcaccccgatgcttgcctccgacgcaattggacaagtgcaagatgaaatatgcatttatctcagatggttgcttactgagagaatgcaacatcgagcattctgtgattggagtctgctcacgtgtcagctctggatgtgaactcaaggactccgtgatgatgggagcggacacctatgaaactgaagaagaagcttcaaagctactgttagctgggaaggtcccagttggaataggaaggaacacaaagataaggaactgtatcattgacatgaatgctaggattgggaagaacgtggtgatcacaaacagtaagggcatccaagaggctgatcacccggaagaagggtactacataaggtctggaatcgtggtgatcttgaagaatgcaaccatcaacgatgggtctgtcatatagatcggctgcgtttgcgtctacaaaacaagaacctacaatggtattgcatcgatggatcgtgtaaccttggtatggtaagagccgcttgacaggaagtcgagcgttcgggcgcaagatgcgtagtctggcatgctgttccttgaccatttgtgctgctagtatgtactgttataagctgccctagaagttgcagcaaacctttttatgaacctttgtatttccattacctgctttggatcaactatatctgtcatcctatatattactaaatttttacgtgtttttctaaaaaaaaaaaaaaaaagcggccaaaaggaaaaaaaaaaaaaaaaaaaaagaaaaaaaaaaaaaaaaaaaaatttaaaatgaaaattttagggtgaaaagaacaaagtgtcagaacaaggttaagtaagtaaagggggggccccat

SEQ ID NO: 2684 - DNA, 243 bp, Zea mays
  Clone ID: PAT_MRT4577_77476C.1
agcatgggcctgccttttataattacatatgcgggcaacggatgtgttagttgatgcgatgatggcatacatacatattttgcgtacatacacatgacatgactggattattacatatgtccaacgtatgcgtgagcgcaccccatgatggcatacatacatattttgcatacatacacacatcacatgactggtgaatcatgcaaagatctgtgatctgattctcatgcaagagcaggaacg

SEQ ID NO: 2685 - DNA, 371 bp, Zea mays
  UNSURE (1)..(371): unsure at all n locations
  Clone ID: PAT_MRT4577_77517C.1
  unsure (1)..(371): unsure at all n locations
ccgggtctatgtagcgtagtgagtcggaatcggctcgagaagtacaagnttgacaacctgtatggttgccgacactcgctccctgatggtctgatgacggcactgacgtatgatcgcggaacaagctgcgtggtctgcgaatacggtgatgtcggcatggtggtgcgtctgccgtcaagaaggtctgtgcccgtgtcagtttgaccgagatcgacgccatctgtgacctccaggctctgatcggagggtcttcaggtccttcccttggaggacgttgtctctgaagctgacatcttcgtgagcaccactggcaacaaggatatcatcatggttgaccagatgaggaagatgaagaacaatgccattgtctg

SEQ ID NO: 2686 - DNA, 1703 bp, Zea mays
  Clone ID: PAT_MRT4577_77573C.1
cccgctgtcttctagatcaaaagttcggttaaatggttgtcaaacaatggtaggcaacataggatacattaaatttcaaatcaaaacccagtgcatccgagttcaggtcttcaggcttggcaggtgaagatttctcgagaaaaccctggaaacaactggcttccgtttacggaccttgattcccacacctgccatgcccctcaaatgcctggtggttctgctttacgtcatcctgatgaacttccttggtttttcggactgtaaacatgccttcgcatccagaaacctaacaaagacaaattactgattgcatcgtatcagggacaatattgtttctaagttactgagtgtttcttcttggcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagtaagaaaaacgaatctccggttctcttcttccttgttcgtcccgtggatctgttccgtggcgtccgaagcattcgatttctgttattatgacatccgccgccgcgagtagattttgacctttttttttcccgtcgtcgttgttttgctgtcgctgtctctgtcgtcgtcgtcgtcgactcgattgctttggcatctgcaggctggcggtgaagagcaagggggcggagaagcccgccaagggcaggaaagggaaggccggcaaggaccccaacaagcctaagagggctcccagcgctttcttcgtgttcatggaggaatttcgcaaggagttcaaggagaagaaccctaagaacaagtctgtcgctgcggtggggaaagctgctggcgacaggtggaaatccctgagcgagtcggacaaggctccctatgtagccaaggctaacaagctcaagctcgagtacaacaaggccatcgctgcctacaacaagggcgagagcactgcagctaagaaggctcctgccaaggaggaagaggaggaagatgaagaggagtctgacaagtccaagtcggaggtcaatgacgaggatgatgaagagggtagtgaggaggatgaagatgatgacgagtgatggagctcctcgagacaatggaccgtgcttcatccaacaatggagcggctacacaaggccccgtggcgatcacaaaaaaggagcctatatccatgtactagaattattcagtttcactccacatcgtgatgttttatttttacttttgtcgtgctataacggatagcgctcctcgttggcgccactggcgggtggttctgcctctggtctggtgtgtttgtgtgtggtcacacttgccagccagcagaggcgcctgcttgtacctagattactgtttccattgtcgtcatcatcggctaacattgtcataatgtcagtttgggtaatgttagattaagtaattattgtgttctgtattcttgttaaaaaaaaaaaaaaaaaaatgtttgcttttacaggtttactgttatctcaatatatgtatatgtactagtgatgtattaaatgtgctaatatgtgatatatatatatatatatagctttttcatctaaaaaaaaaaaaaaaaaagcggcc

SEQ ID NO: 2687 - DNA, 2021 bp, Zea mays
  Clone ID: PAT_MRT4577_77574C.1
gaggttggccgggctttctcgccttctcggcgcgctacgcctacgactgagctgaaagaagcggtagatcggcgttagcggcgagctagggttccggcgagtgcacccaatggcatcggaggcggcgcggcggcggcaggagatggcagaggaggggcaacggcacctggaggagactatcgcagcctcgttccagatcctcgtatccatgaacgacgagctctgcaacgccggcctttggtcctcctcatccgtctcggccaccgctgcggctggctaccagcaccatcactctgctactcttccgaccccacactctgtagattccgacgctgccgacgcagggggcgcgcccagccccggcgggtcgctcgacgaggcgaggcaccgctacaaggcgcctgccctcccctcctgcagcgcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaacaaggccatcgcagcctacaacaagggcgagagcactgcagctaagaaggctcctgccaaggaggaagaggaggaagacgaagaggagtctgacaagtccaagtcggaggtcaatgacgaggatgacgaagagggtagcgaggaggatgaagatgatgacgagtgatggagagctcgctcgagacaatggacggtgcttcatccaacaatggagcggctacacaaggccccgtggcgatcaaaaaaaaggagcctatatccatgtactagaattattcagtttcactccacatcgtgatgttttatttttacttttgtcgtgctataacggatagcgctcctcgttggcgccactggcgggtggttctgcctctggtctggtgtgtttgtgtgtggtcacacttgccagctagcagaggcgcctgcttgtacctagattactgtttccattgtcgtcgtcatcggctaacattgtcataatgtcagtttgggtaatgttagattaagtaattattgtgttcaaaaaaaaggagcctatatccatgtactagaattattcagtttcactccacatcgtgatgtgaaactgaataagtctagtacatggatataggctccttttttgtgatcgccacggggccttgtgtagccgctcctcgagacaatggaccgtgcttcatccaacaatggagcggctacacaaggccccgtggcgatcacaaaaaaggagcctatatccatgtactagaattattcagtttcactccacatcgtgatgttttatttttacttttgtcgtgctataacggatagcgctcctcgttggcgccactggcgggtggttctgcctctggtctggtgtgtttgtgtgtggtcacacttgccagccagcagaggcgcctgcttgtacctagattactgtttccattgtcgtcatcatcggctaacattgtcataatgtcagtttgggtaatgttagattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggg

SEQ ID NO: 2688 - DNA, 1127 bp, Zea mays
  Clone ID: PAT_MRT4577_77605C.1
ctctagtgccgccgagacgctttccttccgtctgccgaccgacgcacgcggacgcctccgttcgtactcccgccgcctgtagaggcctcgtcctctcgcccaccggcgaaaaacagttcccctctgccgtttccgggtctcttagtgcaagcaaggaggccgttccacgctcctccagcgagctccgtgctgaagcggcaagcagtagcagcaacaacaacaaagccttttagtcccaagaaagttgagataggctaaagctaaaaacccaagagaacttacaaggcaaggttcgggcacatggatatctgttttccacacactcctattcaagaaagatgattaatcttttcaaaataaagggtcaaaagaaagatgaggcagcaagtgctactggaaaggcccctgttaagaaacagtctgctggggagctccgtcttcataaagatattagtgagctcaacctgccgaagaccacatcaatttcttttcccaatggcaaggatgatctgatgaattttgagatcaccatccgacctgatgaaggatattacatgggaggcgctttcgttttcacctttcaagtgtccccatcttatcctcatgatcctccgaaggtcaaatgcaagaccaaggtgtaccatccaaatattgatttggaaggcaatgtctgtctgaacattctgcgtgaagattggaagcctgttctcaacatcaacaccgttatttatggcctgaatcttctttttacgcaaccaaacgacgaggatcctttgaaccacgaagctgcagctgtcctccgtggcaacccaaagatgtttgaggcaaatgtgaaaagagccatgaccggaggctacgtaggccaacactatttccaaagatgcttggcttgatgtgatggcatcaagccagcgggcccatgtatcagcaccagcgcgcccagctttggaggatttatgtggatttagtgcgcttctggaagcaaaggtcaaatcggtcgttgttgataatgtgatgtacttctttttattttccatgttttagtataaaaatgaactagcaagcgacaaatattcgataacgaggtagtatctgtttgccctgaaaaaaaaaaaaaaaaagccctc

SEQ ID NO: 2689 - DNA, 1179 bp, Zea mays
  Clone ID: PAT_MRT4577_77606C.1
gcgtttgcggttgtcgttgggagtgccgccgagacgctttccttccacctgccgaccgacgcacgcggacgcctccgttcgtactcccgccgcctgtagaggcctcgtcctctcgcccaccggcgaaaaaccgttcccctctgccgtttccgggtctcttagtgcaagcaaggaggccgttccacgctcctccagcgagctccgttctgaagcggcaagaaagatgattaatcttttcaaaataaagggtcaaaagaaagatgaggcagcaagtgctactggaaaggcccctgttaagaaacagtctgctggggagctccgtcttcataaagatattagtgagctcaacctgccgaagaccacatcaatttcttttcccaatggcaaggatgatctgatgaattttgagatcaccatccgacctgatgaaggatattacatgggaggcgctttcgttttcacctttcaagtgtccccatcttatcctcatgatcctccgaaggtcaaatgcaagaccaaggtgtaccatccaaatattgatttggaaggcaatgtctgtctgaacattctgcgtgaagattggaagcctgttctcaacatcaacaccgttatttatggcctgaatcttctttttacgcaaccaaacgacgaggatcctttgaaccacgaagctgcagctgtcctccgtggcaacccaaagatgtttgaggcaaatgtgaaaagagccatgaccggaggctacgtaggccaacactatttccaaagatgcttggcttgatgtgatggcttcaagccagcgggcccatgtatcagcaccagcgcgcccaggtttggaggatttttgtggatttagggcgcttctggaagcaaaggtcaaatcggtcgttgttgataatgtgatgtactccctcagttctttttatttttcatgttttagtataaaaatgaactaacaaacgacaaatattcgataacgaggtagtatctgtttgccctgtgacgtgtttaaaaccggtgaatttggggatatggtggtgtcacaagggaaaatgcttctccaattatatcactcgataaatactaaacgagaaatgggaactggattgtaaagaagatcgcttcttttccagaaaaaacaaaattgaggtggtatctttgattttgtactcggctgtcttc

SEQ ID NO: 2690 - DNA, 281 bp, Zea mays
  Clone ID: PAT_MRT4577_77693C.1
accaataagtaccattttttccttaggattaacttataacaaattctgacaggagtaacagtattcattgatccacagtccatgctgggggggcaggggtttgctggagccggggagaacacaggactaacaactgtctcagagcgaccttgcataaaaaacacagatgggcaacaacaaacgagacgaacgaagataaaccctttggactagggtaaacatcacggctgccaacaggataactgggccgggcgggccccaccggtaagtttcttcagttc

SEQ ID NO: 2691 - DNA, 234 bp, Zea mays
  UNSURE (1)..(234): unsure at all n locations
  Clone ID: PAT_MRT4577_77815C.1
  unsure (1)..(234): unsure at all n locations
ggtgggtggaatcttcctaaacgacttgttncattgattcttgtttagttttagcttcttttgcaccacaagggggggggtttttttcaactgcggatcaggcttcaaatgcggctcaagctgcaagtgcggcaagaagtaccctgacctgtaggagacaagcaccgccttgcaggccaccgtcttcctcggcttggccccggaaaagaaggccgctcccaatttcgacaaggc

SEQ ID NO: 2692 - DNA, 401 bp, Zea mays
  Clone ID: PAT_MRT4577_77920C.1
ggaaaaaacttgccccgtttataatcgataattgggggggttttgaagaacaggagttttgaaccctggggcagtttggaggttttacatgactggggaaaaaagggcatgggattggagcttttatgggccctggtactagaaagggtcacatagcaggggtttggaaaaaaactggggatcaccccatcccccagcagggggcaatccggttgccaatggggggggagccttaaacaagcccctgagctggagttagcctagcaatcggaaccctgaagggggggcaagaaacgtaatccagccccgccttcgcaaaaaaggccacagagggggggtctccaccgggttctccacaaaggcccaccttcaagttagggctagctttggggccccttttt

SEQ ID NO: 2693 - DNA, 446 bp, Zea mays
  Clone ID: PAT_MRT4577_77952C.1
aaaaaaagcctccaccctgtaaggggggggccttgttgtaacacgtgtcacgaaacacgacgcatgaactgaattgaacttgggcgaccagaaaaaaaagagcgggctattaatcttttggacaggttctaaagggacacaaaactccgggtccaaaacaaaagggggagccgctgggcttttatacaaagttttaaaaatcgcaaaaagaatgcaattggacagcaataccgtttagggcacaacaagcccaattgaaaagcagttattagctccaactttgccaaaaatacccttactagtaataacagaaagaccactgaataaccccatttttgcccccaggagcttctataaaacagtatatggaggtgaaaaggacattccaatcttccaatgtttacttgagggggtctcttttggaattacttgttggcaccacccct

SEQ ID NO: 2694 - DNA, 305 bp, Zea mays
  Clone ID: PAT_MRT4577_7801C.1
ttgcttcattgatagcacatttgtgttccttctatggctgccaaattatttagcctccttatgctccttggtctgtctgcatgtgctgcttcggcgtccattttcccactatgctcacaagctcctatagcttacgttcttaccccgtacctctcaccagcggagtcttcgagtttgtgattacccaattctccatccctattggttccatctggcattcgctgctggcttcttacctttatcacccttgctgctccaacaatcttctgccctattacagctgcttcctttggggcattttttgg

SEQ ID NO: 2695 - DNA, 237 bp, Zea mays
  Clone ID: PAT_MRT4577_78059C.1
tgaacccttctgcccttcttgaaaaaacaacagttgttggcccgttctaacctgcacgcctagcctaaagctggcacccttttaaaactgcaaaaattgctgccattcaacccacttgctttgaaaaaaccaacagtgttctaacaacaacccatcattggtggtgccctcttttaaaatgcttatgaattataattcaataatgaaaattttttggatagaagtttgtggcttccc

SEQ ID NO: 2696 - DNA, 312 bp, Zea mays
  Clone ID: PAT_MRT4577_78070C.1
tagtgagtcgtattaaagttgattgggacaaatggcaggacgaggatgatgaagacgctggatttaatgactttggtggtatggacttctcgaaactggacataggaggtgctgatgaccactatattggggatgatgaagatgatgtggttgaaagtgctaagaaggatgaagaacgacgtaagacagaacagagcaaggatgaggaagcagctccagctgctgcaaaggaagtgaagccatgaagaatcagttgactttgctcggcgccatgggtgtccacggtatctagctaggcgagacgttcccttg

SEQ ID NO: 2697 - DNA, 1002 bp, Zea mays
  Clone ID: PAT_MRT4577_78087C.1
atctccgacccgatccgacccgacacacaaatatctccacccctgttccggcgacgactacgatttgggaggaaggtaagcgaatgggtgaggaggcggtcgacgactacgagctccacatggtgtgctacggcggcggcggcggcggcagcgaggacgagcgcgtgatggagtgggagtcaggtctcccgggcgcggacgagctgaccccgctgtcgcagccgctggtgccggcgggtctggcagcggcgttccgcatcccgccggaggccgggcggacgctgctggacgtgcaccgcgcgtcggctgccacggtgtcccggctgcgtcgcgcgccgccgccgtcgtcgtcgggcagcggagggagctcctccttcgcgcccttccatccggcggcgaggggggacgaaggggcggactcgtcggcggcgggcggcggggcggcggcgacgacgaacggcaacaataacatgagcagcagcagcaagcggccccggctggtgtggacgccgcagctgcacaagcggttcgtggacgtggtggcgcacctggggatgaagaacgcggtgcccaagaccatcatgcagctgatgaacgtggaagggctgacgcgggagaacgtggccagccacctgcagaagtaccgcctctacgtcaagcggatgcagggcctctccgacgagggcccgtcgccgtccgaccacatcttcgcatccacgccggtgccgcaaagcctggtgcatgaggtgcccatgtacggcaccatggccagcggcggacaggcgtaccacaaccacaacggaatgggaggaggagggtaccagtaccagtaccatcactaccaccacgcccacaaatgactcttctgttggattggatccctcaataatcccatcgatccttttggttttggatctcttgctaattcagttcttcgtgtgagcggtaaatggatctcttttaagaaataaagaaagaaagataagtttcttttcccttttc

SEQ ID NO: 2698 - DNA, 536 bp, Zea mays
  Clone ID: PAT_MRT4577_78147C.1
actttcttatttctgggaagcacacaaacatgaaacaaagaactctattattgaactataactcataagaaatctaaaagagggcaccaccaatgatgggttgatggtagaacactgctaagtttagaaaagcaagttggttgaatggcagcaattgatgaaactgaaagatggtgccatcgttaggcgcatcgtgctgatagaacggcaacaactgtggttgcgtgaagaaggtaatagggctcacaccagctaactgtctgaatggtagtagctgatgctgctgtaaataagcaggagagctcaatgctggcagatggttgaatggaagaaattgctggaggtaggcaacaggtagctggctgaatggtagttgttgctggtgcaaataagaagcataggtcaatgcagctagctggctgaatggaacaaactgctgttgctgagagcatgcagcaaggtttgctagcacaagttggtgtaattgatgtgccctgatgttctgtgccattaaatgcacctaatgtaaccgcgaa

SEQ ID NO: 2699 - DNA, 466 bp, Zea mays
  Clone ID: PAT_MRT4577_78248C.1
gcttgcctcaaaccctcgacagcgctgtcgacctcgcgcggccgccgcaacaatggcgtcccttttcaaggacccgagcaagctgtcggtgtacagggaccggcggttccctgggacgcaggaggagtttgaggcggcgctgctggcgtcgctgacggtgtacgtggggaacatgtccttctacaccacggaggagcaggcctacgagctgttctcccgcgccggcgagataaaaaagatcatcatgggcctcgacaagaacacaaagaccccctgcggcttctgcttcgtactgtactactccagggaagatgctgaagatgcagtaaaatatattagtggcacaatgcttgatgatcgcccaatccgtgttgattttgattggggctttgaagaaggcaggcaatggggccgtggaaggagtggtggacaagtccgagatgagtaccgcacggattatgatcct

SEQ ID NO: 2700 - DNA, 376 bp, Zea mays
  Clone ID: PAT_MRT4577_782C.1
cacgcagccgcagccgccggaagcaagcaagagctgcgactgcgagcaggcttattaagctaagcgacgacctccgttccattgcgaacaggctacatacagatcagagtgaggaagaagaggaagccgaatttcttttcactcttccgactgacctttcgcgggtgcgcacgccacctcgggtcgggagcgcgtcgatcgagtccgtggcggtggcggcgtgggacggtgaccggtaagtttgtacaatataaagcgcggcggccacacagtcacacacactgacacacacacaccagctgggagctccggagatgcaacagcggcgcaagtcggtgttcgcgtccgcgccgttcgcgatgaagcaggcggcgct

SEQ ID NO: 2701 - DNA, 112 bp, Zea mays
  Clone ID: PAT_MRT4577_78338C.1
ggtaatatatattctcgcacgatgggcatctccggctgcggtggctagagcaagctggagagcccgctgctgggcccgtcttctacgggccacggctaggcggtggtgagcg

SEQ ID NO: 2702 - DNA, 865 bp, Zea mays
  Clone ID: PAT_MRT4577_78440C.1
gtccacacttcgcaacaacagaaaaaaatcctttttttaattgaattttttatcaatcaaaatgactgaaacaagagagatcaacgttttcatggccaagctcgctgagcaggctgaacgttacgatgagatggttgaagccatgaagaacgttgctgatttgggacaagaactcaccgttgaagagcgtaaccttctctccgttgcctacaagaacgtcattggtgcccgtagagcttcatggagaatcatcacctctattgagcaaaaggaagaatccaagggaaacaccgctcacgttgagagaatcaaggagtacagaaagaaggtcgagaacgaagtctccaagatctgcgctgatgtcctcggaaccctcgacaacaagttgattccaaacgctcaaaccaccgagtccaaggtcttctactacaagatgaagggagattaccaccgttacctcgccgagttcgccaccagcgaagctagaaaggaagccgccgacaactccttggctgcctacaagtccgccaccgacattgctaactccgagttggccccaacacacccaatccgtttgggacttgccctcaacgcctccgttttctactacgaaatcatgggatcaccaaagcaagcttgcgagttggctcgtaaggccttcgacgacgccattgccgagttggatcaactcaacgaggagagctacaaggactccactttgattatgcaattgttgagagataacctcaccctctggacctctgacttggagggagacaaggccgacgctgaaccagaagccgccaactaagaatcttcctttcctcacacaacactttgtataaatacttctatctttatttat

SEQ ID NO: 2703 - DNA, 1658 bp, Zea mays
  Clone ID: PAT_MRT4577_78450C.1
tcggcttccttggcaccaccgcctcccctcctctccttattaccaccacctagctagcagcggcagcggcagcgccggcctgttgtgctgctcgctcagacagctctgctagctgcatcctcctaattctccaggtctctctctcctctcccaactcccaagtcccatccggatccgagacgctggaggcggagcgcccccccgggacggcggcggcgacgatggggcgcggcaagatcgagatcaagcggatcgagaacgccaccaaccgccaggtgacctactccaagcgccggacggggatcatgaagaaggcgcgcgagctcaccgtgctctgcgacgcccaggtcgccatcatcatgttctcctccaccggcaagtaccacgagttctgcagccccggaaccgacatcaagaccatctttgaccggtaccagcaggccatcgggaccagcctatggatcgagcagtatgagaatatgcagcgcacgctgagccatctcaaggacatcaatcgtggtctgcgcacagagattaggcaaaggatgggcgaggatctggacagtctggacttcgacgagctgcgcggcctcgagcaaaacgtcgacgcggctctcaaggaggttcgccataggaagtaccatgtgatcagcacgcagactgatacctacaagaaaaaggtgaagcactcgcacgaggcgtacaagaacctgcagcaggagctaggcatgcgggaggacccggcgttcgggtacgtggacaacacgggcgccggcgtcgcctgggacggcgcggcggcggcgctgggcggcgccccgccggacatgtacgccttccgcgtggtgcccagccagcccaacctgcacggcatggcctacggcttccacgacctccgcctgggctagcgcatccatcaccatatatgctgggtggtgctgctcgatcctactgcatggcaatgcaagctggttggttagttcgctcatgcatcgtccgtcaacaaagcaagtaagcaatgcaatgcaaccgaggtactgtaatagccaataaaatctactgcatactgcaaacccaattactggtagcttagctaccgcgtgtgtacgaatcaaccgattaattaccgcgccctagcttgcatgtcgtcgtcgtctgtgcttttggcgttcgtagacatgtgtgtattgtatgcatgggtcctgttcatctgcatccatgcatgttgtttatgattgtaattgttgtgtgaaatggctgtactttgttatgatcacgtgaaattatatctacattcgtgagactaaaaaaaaaaaaaaaaaaaaaaaaaaaaaaaaaaaaaaaaaaaaaaaaatggcggtgatatacgccttccgcgtggtgcccagccagcccaacctgcacggcatggcctacggcggctcccacgacctgcgcctcggctaatcgatcacggctattgctcctactagcttatatatcgagtgatcaagttaccacaataagaaaaaaaaatctgtgtgtttgtatttgtgaaatgctgtgatcgatgatgccttatgtcggtctcgtgcacatgattcagttcaatgtgtaattaacgccgtagtgctcgactgtgtattgtattgcatgatgtgctatgactttggttgtgagct

SEQ ID NO: 2704 - DNA, 1668 bp, Zea mays
  UNSURE (1)..(1668): unsure at all n locations
  Clone ID: PAT_MRT4577_78571C.1
  unsure (1)..(1668): unsure at all n locations
gggtacctcgaggccggccnnnnnnnantttccaaaaaaaaaaaaaaaaaaaaaaaaaaaaaaaaaaaaaaaaaaaaaaaaaaaaaaaaaaaaaaaaaaaaaccggacccacgcccgcgcggacgcgtggacaccaatacactacaccataccagaaggagcaaaaataagacgagatggcggacgagcgcttgcctcaaacggccggcgcccgcacggctctcgccagagctactggatcctcggcacggaaacgcgcccgcgatagttaggtgcgcctgtgggcccggccggctcgtcacttacataggcgcacgcacccccgcctggtgcgtcgtcgatcgctgctttgctggcgcgcggcggccctgtgtggcacagtagaggtctgctgaggacgacgaccggaggcgtgctgcgtggatggtcctcatggccgggatgctccccggcgtggagtgcgcgcggcggcggcgggtccggcagggcggggcggggatgggagcggaggcggccggaggaggcacggggcggcggtcctccttctgcctgtacgcggccggccacggcggcgccggtaattctggcaagcggagcggcggcgtggtgcacgggcacgggtggacgctggacagcaatgcccgggaggccaaggagcggctggaccagaagctcaggaccaagagggaggccgccatcaagaggcaccacagcacggggagcataaagctgggcgtgccgcaccggagcgccggcgcggacgagcgcggcgagagctccgcgccggcgatggccggcgtgcagcgcgaggtgtactcgaagaagggcgtgatgcggcggctgatgcggtggagccggccgcggtgggccgcggcggagcaggcggagtgcgcggtgtgcctggacgagttccgcgcgggcgacgtgctggcgcacctgcgctgcggccaccgcttccactgggcctgcgcgctgccctggctcgagggcacctcgcggtgccccttctgccgcgccgccgtggacgccggcgccgccgccgccgccgacggcgcctagaagcggccgaggctctggtcttgctggggcttgccctgggctgggacggcgcggggcgccttgtcgctgtcggcccacgccagccacgccacccccatggcgttgccacgctaggcagtggctagtgggggtggtcatggtgagtggtgaccggcctgcttgtgcatgtggcgcggagcggaggaggacagcgagacgcgcacgacgaacccgtgagtgccttggcagtttttgcacgctttgcgcgcgcaaaggcacggttggtgcacatttgttggttgggccgtttggcccccctttgccgtgtcctcctcccatcatcgcgagcaagtgatgaacggttttgttttcgtgtttggggagcgctttgtttatggactctggtattagcggatagcggttccatcatgtaattcatgtcaaaaaaaaaagatcgtctgatcgatcttggagaaagaactgtaatttagatcaacatcaatcacatctgtgtacagtctcagtgttgttgctctgaacttgtataattttctgtttgctcagttgaaggtaaatgcagttggaggtgaggtctctttagaacgctaaaaaaaaaaaaaaaaagcggcc

SEQ ID NO: 2705 - DNA, 301 bp, Zea mays
  Clone ID: PAT_MRT4577_78749C.1
gcattacccccttcggtgcaacatctttgcaccgtgcttcaaccaggtgtaccccttccgtcactgacacatctaggctacggttttcggaaatcattatacaatatgtcgtcaggatgttgaaaaagtattttgccttactctgtgaaacaaaacattctttatcacaagtgtgcataaacctgtgagttatatatgggagagtacttttgtgatatattcaaactttatgattatgatacagaccaagggcaggaccattacatcctatgttgcatatccacgttttatgtctaaagaa

SEQ ID NO: 2706 - DNA, 1243 bp, Zea mays
  Clone ID: PAT_MRT4577_78947C.1
cattgggaccctcgaagccggccgggttgatatagtatgtggtagttgaacaaggagcgcgatgatgccgatcatagacttggatccgtgacggtcccactgtcacggatgcccttgttcactcgactaggattctaaagtctaatttaaataatctgatcagataactgggctgcatataaatatagcttggagcaaatctttcagccacccgatccccaaccgcccggcccgacattccctccaaccgccgctgcggctgcgccgcccaccgccgacaggcgacagcatcgacaggcgcagcagtcaacaggaaccgagccatggcgagcgcggatctgctgcggagggaggaggagttctactcctccctgtttgattccgccaaaggcgatggcgccaggtcgcgctcacagctgatcgagaggaagatcgaggccctggaggacatggccaccagggtcagtaaccggagatcgcggaagtggtttaacgaccgtttgctgattgaactcgtcccgcgtctttacgttgaagagatcaaaggcctattcgctcctccgccgtggggtgagcaagtgcccttgtcagcattctacagggcaaatgttggtgaatgggattccttcaggagcattgacatggatgctgaggcaagattgatgcagcatatgaaaaaatcattggaaaaacccaggaatcatgtcgatgaaggggaatcgattgcgctgaatgcttggcatcgaatagatcgacacactagagaagcaataaagagaaatttccttcctgatctgcttggaatatatgaagaacgcgttagggccttcattgaagacgctagtgacaaagatgctcttgtgctgaatgttcaggacccatttcagagactactgctccacggtgtttgtgagttctacaacgtgagctcgacaaccaccagcagtgtgagagaagatgggaggccttggaaggcaaccaccatcaagaagaggcagggcaccggcgttccctctagaatcacactagttagctttctgagaatgaagaagaatggatcgcagtaacgttagttagcgttcaagaatacaacaaaattgctttagattccgtttaggctgttgcaagacaagtgagtggtcactggcaatgtgttcttatatcgcatcagcctgctggctacggtttggaacttcctgacagaaagtaaaaacttccggttctacaaaaaaaaaaaaaaaaa

SEQ ID NO: 2707 - DNA, 2502 bp, Zea mays
  Clone ID: PAT_MRT4577_79089C.1
cccacgcgtccgcccacgcattgggtccctcgagggccgccgggaatgccctcctccctcggcggaaacatccaatccccgggccaccactacctgcctgcccgtgcccacgcttcttctcttctcctccccaagccccagccccagctaccgcgccccctcctgtctgttccaattccaccagcgtcggcctagctacctgcccgtcccctctccgagtacggtcggaagcctcagctgaaggatctggcctgggcgccctccggacgacgggacaggttctgtttggtcttcataaagtagagcactagctagaagacatattcacacgcatcagctatcaaattgcaagcttagaattgacctcaaagttgggacatgcttgtcttaccagaagcaactgatagcttggagttgtagtccgtccggactgtctgctggaccagtatggctgacactccaacttcccgcatggtgcacccctttggcgacgtcccaaggcagactcccaagcaattcctgtattctggtaacccgcagcacctctgccatccgtaccagtcagctccggacacccacgtcgtgccgcagcgccgttacaccgtgaggtctcagtctcactcaccaaataatgctggttctcaagaccatgagactcacaagcagtacacgctggagtcctcagcggcttcccggttgttcaaggcatggttctccctccagccaaagcgtccatgccgggagtggcagccctgtgtctcatgacgacagccactccggctccacgaatggccatggatcacctgtgagcgcgtcgtgtgtcaccggcgaggaccctactgatctcagcagaaactgaaggatcttgaggctgtaatgctggggacatctgagactgaccccgagatagtcaacagtctcgagatctccgcggcaaaccaactctcgttggagcccgaggagtgggagcacatggtgagcatgcccagagggaacctgaaggagctgctgattgcctgcgctagggcagtggaacgtaacaacagctacgccattgatctgatgatcccagagctgaggaagatggtttcggtgtccggcgagccgcttgagaggctgggagcctacatggtggaaggtcttgttgccaggctcgcggcctccggcagctcaatctacaaggctttgaagtgtaaggagcccaggagctctgatctcctctcctacatgcacttcctgtatgaggcctgcccctacttcaagttcggctacatgtcagccaacggcgcgatcgcggaggccatcaagggagaggacaggatccatatcatcgacttccacatcgcgcaaggggctcagtgggtctctctcctccaagcccttgcagccaggcctggcgggccaccgttcgtgagggtcaccggcattgatgattcagtctcagcttacgctcgaggcggcggtctggagttggttggcaggaggttgacacatattgctggcctctacaaggtgccctttcagttcgacgcagtcgctatctcaggcagtgaggtggaggaggagcatctaggcgtcgtcccaggcgaagccgtcgccgtcaacttcacccttgagctgcaccacatccccgacgagaccgtgagcacggcgaaccaccgggaccggatcctgaggctggtgaagggcctgtcgcccaaggtgctcacgctggtggagcaggagtccaacaccaacacggcccccttcgcgcagcggttcgcagagacgctggactactacacggccatcttcgagtccatcgacctggcgctgcccaggggcgacagggagcggatcaacatcgagcagcactgcctggctcgggagatcgtcaacctggtggcctgcgagggcgaggagcgggtggagcggcacgaggtgttcggcaagtggaaggcgcgcctcatgatggccgggttcaggccgtccccgctcagcgcgctggtcaacgccaccatcaagacgctgctgcagagctactcgccggactacaagctcgccgagagggaaggcgtgctctacctcggctggaagaacaggcccctcattgtttcatcggcatggcactagtgttggcctcgtggagaatgttggcctcgtggagaatgtttctggtgactttctacctcgttgttagtatagatatgcttggctgagcactaaaactatatataggaagcctgtggtgatagatactgagttgtagtagaacacatatagcctaaatgcctaatgctgtgatggcagtcactaccagcctagcctagaacaggttgatgatgtgtagtagtaagtttgggtatatgtttcagttaatcagttttgcttgggtgcattctgaagggtggcctcttcaaaaaggacatcaaaccttctaacttgacccttcaaaaataattcaaatagtgagggccgaaaaatcagtatgaaaaaataaaaaaaatcaaataatatggaaaa

SEQ ID NO: 2708 - DNA, 392 bp, Zea mays
  Clone ID: PAT_MRT4577_79171C.1
gccggtaccgatgaactggccgagttctaagtagagaatcggtttttcttgtcagatgccggtgtctgctgcgtctggtggtggttaatgggagaaattcgcgagatctgttccggatcaagcgtgcgagctcgggaatcaagggtttcacacatagcttcgtcgatttgaatttgatgtactaatggagtctaagggtggcaaaaagtctagcagtagtcgttctatgatgtatgaagctccccttggctacaacattgaagacgttcgacctgcctgatgcgtgaaaaatttccaagctgttgcttactccaacttctcgtagaatccattcttgttatccttttggctttctcattcttataattaaagattttttttctgacactttt

SEQ ID NO: 2709 - DNA, 649 bp, Zea mays
  Clone ID: PAT_MRT4577_79229C.1
gatatattctcttctccttcttcttcttgtcctcctccttcgtcttctccatcttcctgtccttcgatccatcaaaagctggccgcggccgagacgacgtgcatagctataaataatagcccatagcatcctcaacaaccagacaagaagtaccacgccgccggttgtttgtttgtttcttccatggagagcacggagctgaaagtggagatggtggcgttgcatgagaagcgggtacgcagatgcctgtccaaagtgaaagggatcgagcgggtggaggtggaggcgagcctgcagaaggtggtggtgacggggtgcgtgaaccggagcaagatcctcaaggcgctccgccgggtggggctgcgcgccgagccgtggtcaccgcacaacgagctgctcagcgcctacgccgccaccaccaccctcgtcttcaacaactcctacgccttcttctgatcaagtcatctcatcctttatagctagatagctattgtaatctctctctctctctgcgtgcttggcttgcttggagtttgttgggaacgtgaacgacggacggcgttccacatgtacacaacatggatggcattttaatctctctctcccttctttcttcttgaaaaaaaaaaaaaaaaaggcccctagggcc

SEQ ID NO: 2710 - DNA, 395 bp, Zea mays
  Clone ID: PAT_MRT4577_7924C.1
acgaggtgtacgcgcgggtgtgggtgctgcccgaggacgaggacgcggagaagcgtgcgcaggcgcgggtccgggacgacgaggacgcggatcgccgcgacggcgaggacggcggcgccatgaggccgctcgcacggacgccgcacatgttctgcaagacgctcacggcatccgataccagcacgcacggcggtttctcagtgccgcgccgcgccgccgaggactgcttcccgccgctggactacagccagcagaggccgtctcaggagctcgtggccaaggatctacacggcacggagtggaagttccgacatatctatcgaggtcagccacgaaggcatctcttaaccactggatggagtgcatttgttaataggaagaagctcatttctgga

SEQ ID NO: 2711 - DNA, 374 bp, Zea mays
  Clone ID: PAT_MRT4577_79371C.1
gacacaggggggccttgccatcaaaaacacagaggggggacaacaaacaccacacgaacgaagataaaccctttgggctaggggaaacatcacgggggccaacaggataacttgggcgcgcgggccccaccggtcaattcctccaattcccgtgggagttcccctaaccccccccaccggtgccacccccctaaccccccccaccaccaccgtagccgccggccccaccggagccgccggcaccgccgaagccgccccccgcatcacggggcccgccaccggcgtaacccccccctccacgggcaccaccggacccaccggcgccgccttcacaggcgcgatgggactgggcctccttgacggggatgttgcgg

SEQ ID NO: 2712 - DNA, 2122 bp, Zea mays
  Clone ID: PAT_MRT4577_79414C.1
agcagaccagtagaccaccgtgcctgtgcctctctctcgtagtcgtatctgcgttgcgccgctgcttaaacaaacgccggacaggggagggccgcggcacgcgtctccagtctccaccctccacggctccacccatctcaaaaccctagcaaccgcgcctccatcggtccatccctaccccaaatcccaatccaagttcggtccccaggcggcgaggaccctcccgcgccgactcgtccccgcagatcggcgggcggggcagattcagattcgggtccgtggttcgctcggctagcctcgccggggtcccaccgcggcggtcggggagcatggtgggaggggggaggcggggaggagcggcggcggaggaggtgaagctcaacaccggcaacgtgttcgcggcgctcgagtccctcaagaagaagaagaagggcgacaagggcagggcggccgggccgtcctccaggaagaagcacggcgcgggggccgcgcagcagcagcaggagccgccgcagaaggatgtcttctgggctcccgcgccgctcaccaccaagtcctgggcagacgtcgaggacgacgacgacgacgactacttcgccaccaccgcgccgccgcgccccgtatgggccgccgccgccgccgccgagcccgccaaggaggaggaggaggacgtcgaggatgctgtccgcgccgcccttcaggaggacgttgagagtgacgacgaggaccttgatgacgaggaccttgatgatggagctgagcatgaagtggaagatgccccagccgaacttgctgtcaaaacagttgaagccctggctgcgccacccaaagatacagaaaggcagctgtctaaaaaggagttgaaaaagagggaactagcagaacttgatgcagtattggctgagctgggactttctgggaactcaaccagcgctgcacaggatgctgagaaggaaggtgccaaccaagctggtgatgcagagaaaaaggaagatgctactgtcccctcagagagcaagacctccaagaagaagaaaaagaaggacaagagttcaaaggagggaagaaaagaaacacaagaagcagccgaggggtcagaggagactgccagtgcaggacctgatgaagaagataccactgctgtggacgtgaaggagcgtttgaagaagatggcttcaatgaagaagaagagatcgagcaaagagacggacaccggtgccaaaatcgccgctgccgaggccacagcaaggagcgcaaggcttgcggcggccaagaagaaagagaagagtcattacaaccagcagcctgtgcggtaaatgggcataaagttttggatttgggtgctctgaattttatatttccttgtagttggactcacaataatacttttttgatctgtcgtatttatgaccgggaagttcctttgagttccatttcagaaaatgaaaaaaaaaaaactcctccattctccaccgcgccccaacctcgaagagttccgaagtttccacaccctcaaagcgaagcagcatgagttccaccggaggcagcggccgtgggaaggcgaagccagcgaccaagtctgtgtcgcggtcttccaaggctgggctccagttccccgtcggccgcatcgcgcggtacctcaaggccggcaagtacgcggagcgcgtaggcgccggggctcccgtgtacctctccgccgtcctcgagtacctcgccgccgaggtgctggagctggccgggaacgctgctcgggacaacaagaagaaccggatcgtgccgcgccacattcagctggcggtgcggaacgacgaggagctgagcaagcttctgggcactgtgacgatcgcggccggcggcgtgatgcctaacatccaccaaaatttgctgcctaagaaggctggtcacaagggggacatcggctccgcctcccaggagttctgaacgcgtcttcggaaggaggagagacgcgtggtgatgtttgggctttgcggttttggggctgttgtcgatgggtttgagactgatggtttgtgggatgtaaacaaatgcagcgcgttgtttcatgaatgaacggatgaagatgaatgatggatagaaagtatttattcatgatttcctccct

SEQ ID NO: 2713 - DNA, 2388 bp, Zea mays
  Clone ID: PAT_MRT4577_79557C.1
ggccgggccgggaaggaatcaaagccaccccagtccgctgcttccattccatctcccttctctcgccttctgcggcactgcagtgctctgctgcctcggcgtctccacctcctcccggcgacggcagggcatccgatacgacgccgcgcttccttccgaatcccaagccgcaccccgcaccctcccggtcgccattcccgatgctggtgttctcgagcgacgacgactgctgcggctcctcgtactaggggggcaggatcgatcggcagactcgcagaactataggatatcacagaacagttcttgaggtacttattgcagcctaatagtacatggagcgatattcagatatgagaccaaaggcagaagtttcatatctcggaaggggttccagattctcttctagaaatcaaagttcagaagagaggactaaccatagcagcgataaaccgggaagcagcacaagattcaatcctacgaaagcgagaattggcggtaatcaagggaggccaagatatgtatgcgattcatttaaatctccaagctcaaaggtgtcgcctgcaggctcttccaaatttccacttagcaagtttgaggagaggcgaagacagccttttgtgccagggtttgacattgctgaaagtagtagaagaaaggctgatgccaagcagctacagggtagtaagaaaattgctgcagagaacgacagttcagacaatctgcgaggtgaatcagaaggttttactactgaacaagtagtaaaaccagaaggctctcatgttgtcggtcattcaggtgtttctgcgtatacagtcgggtccctggtccaaactgcttcactaggttctaggacacacagacagaaacacaaagaagtgaatttgggtactccaggagcatcgtcttcaactctgactaacaggtctactatacctggaaattctaccatgggtgtgaggccagcttatggtcatgttaatggagggcagatacatggtcttaaaaaccttggttgttcttcggtacctgatgctcagccatcaggttgcccatctgagtctgttattagtaggaggaggtttgagttcatgagaaagagggcctttgaccaggaaagctcttccagatcagtgaacttaagcttaggtcattcaactcctacagatattcgcagaatcagaatgaatgaacaatcactttgtcaacaaataccacgaagcagcagcagaagccatcaggaatcggcaggttcagttaggacaagacgaccttctcctcatgccactaggatgagtgttcctgatggaagagcagatggcgtgctttctctgcacgagtcatccacaaaggatgtacagccagctcaggaacatctttcattggaagaagtctccactgagagttcaataaggccattctttgtggaatttgataataacattttctcgtctagtcatcttcgtcgctcgagtactcgagctgaaaggggaagaccaagctccctttttgaagaaagtcctcgacaaatgttccatagtctcatgggggagagggacagacatagacacataaccatggaaggaattacagaggttttggctgcattggagaggattgaacagcaagcagagctgacctatgatcaattgctaatgctggaggctaatctattttttggcgcctttgcctcctatgatcggcatagagacatgcggatggatattgatgatatgtcctatgaggaattattggccctggaggagagaataggctctgtgagcacagctctttcagaggagcagttcacaaaatgcctcaaaagaagcatatatagtcaggtcgctctagaagtgaacaaatcaaccgttgatgacatgaaatgcagcatctgtcaggaagagtacgcggagggcgaagaggttgggaggctgccatgcgagcaccggtaccatgtgtgctgcataggccagtggcttgggcagaagaactggtgtccagtatgcaaagcgtctgccgtgccttccaagggctgaagcattggggatgctggaaaccccgttccggattacaaaccatccttgcttttgtctacgtacattgttcttttccctatatgcattagatatagatcatgtctagatgtatgacgctagaacagcttgcgatttgggaggaagctaagagagtaatagttagctggttaataatagttcatagctaatatttgctagataactattacttggctacctattagctgtgcctttcacattgtggtacaggacaaatgcttgtcagatcgtgaacaaccttataacttgatgaatggcctaagtcaaagaggaatatgttgtgcctatctcatattgcgaaaaaaaaaaaaaaaaa

SEQ ID NO: 2714 - DNA, 263 bp, Zea mays
  UNSURE (1)..(263): unsure at all n locations
  Clone ID: PAT_MRT4577_79616C.1
  unsure (1)..(263): unsure at all n locations
cacacacgtacgcacacgcatacgcacacgcatacggctgaactgagctgagctcaccaccacctaacacgggagatagctatagctagcatagcaagccagcaagtcagcgacttagcagcagctaactagccatgctgccgtccttcgtgtcgccgacggcangctgcgcggcctcggtggcgcctccgccgcggccgtttccaggcagctacggggcaccggtgctgggcccgctacgggaccggctcgacttcttctgg

SEQ ID NO: 2715 - DNA, 676 bp, Zea mays
  UNSURE (1)..(676): unsure at all n locations
  Clone ID: PAT_MRT4577_79625C.1
  unsure (1)..(676): unsure at all n locations
ccggccgggaccttcaaagttcactttcaaaccccttcatctagtacagtcagaatgcctgagaccgttggagagaacggcaacgccgctccaggccgcctgctactgctttccaaccgtttgcccatcaccattaagcgatccgaagatggaagctattcattctccatgtcttctggtggtctggttactggactgagcggcctcagcaaaaccaccagctttcagtggtatggctggcctggtctcgaggtccctgacaacgaagtcgagggcatgaagcaacgactaaaagaagaatacggcgcacacccagttttcatcgacgatgagcttgcagacagacattacaatggtttttcaaactcgatcctctggcctctattccactaccaccctggtgagatcacattcgacgaatctgcctgggctgcataccaggaggtcaaccgcctcttcgccaagactgttatcaaagatgttcaggacggtgaccttatttgggtccacgactaccatctgatgctgcttcctcagatgcttcgtgaggaaattggcgaatcaaagaagaatgtcaagattggtttcttccttcacacaccattccctagcagtgagatctaccgaattctgcctgtacgagaggcactcctgactggcctnctcgactgcgatc

SEQ ID NO: 2716 - DNA, 327 bp, Zea mays
  Clone ID: PAT_MRT4577_79648C.1
ttcacgcgtacgtccacccagaactctatcagggttgcccaatggatgcttgaaactactggcgcgacaagtttcatgggatgcattggaaaggacaagtttggtgaggaattgaagaaaaacgctcaagctgcaggagtgactgctgattactacgaggatgatactgctcctactggcacatgtgctgaatgtgttggtgctggtgaatggtcattgattgcaaatctgttagaggcttactgtcacaaatatgaacatctaaagagaccagtgaactgaacgctagttgtcatggccagtgacatatacattgctggatttttg

SEQ ID NO: 2717 - DNA, 273 bp, Zea mays
  Clone ID: PAT_MRT4577_79789C.1
aaaaaatcgaaaaaaaacaaatcccgttcatatacacaaaatgggctcacagatctttgtccatacgtgcatcctgattgtggaagcacgcagctgcccacctagggctgcatacttacttattcagactgatccagcttgtgggaccatcgtaagttcacatgcttacagacgacaaattttcataccactagcctgtcttgtctgcttcacagattaaccaaacgacaacctcgaatttgcggcgttttaaaatatacagctcacaagcaa

SEQ ID NO: 2718 - DNA, 3181 bp, Zea mays
  Clone ID: PAT_MRT4577_79924C.1
ttgggtacctcgaggccggccggcgttgcggacgcagccacgcaggcgcaggaggcaagacgggacctcgccctcccccgccttgcctttgagtgcttccactccacctcatcagtcgccgcccccgccccgccgcgccgcgggcccctccacctaccctcggcgcccgcccttcttggcccagcgcccctgcacatctgcctgccccccctcggccgccggcggcggcgatcgcgggtagccgccccaaccggccgaggttgcatagaggtgctggtatcttactctgcttctggttatgctatctgcctatgacttcagcttcccaaacttctccctgcttcttgcccctggttggtaaaaatctgtaacaactgctgccctgactgcaaaagacgcaactatgcgtctttcttcttctcttcaagatttgccgaccttcaccagaattgatgctttggaaaggggttctagcgtaggcagtgatctgagctcagggcgcccaaaacctgtccgcatgcttcaaagagatggtgccgtcgcaagcttttcaaaagaaagaacacccccctcatcgccgacaaatagaaagaaatgcatgagagcagccggatgtgctattgcattgatcttactggtgttctttgcgtatggttcatggagatattttcatgtgttcctctctgaaggaagatctgaatactatgttgttcttgattgtggcagcactggtacgagagtttatgtctatgaatggcatattaatcataatgacgcaaatgcatttcctattgttttgaaacctttagggaatgctcccaagaagaaatctggtaaattaacccgactatatcagcgaatggagacagaacctggattgagcaagctcgttcacaatgaatctggattgaagaaggcaatagagccccttcttcagatggctgagaaattgatccctagacatgcacacaagcacactccactttttctatatgctactgctggtgttcgcaagctacctagtgcagattcagagtggctcctggataagtcctgggatatcctgaacaattcatcatttttatgtagtagagatagagttaagatcattagtggcatggatgaagcttattatggatggatagctcttaaccacaacatggatatgcttggcacctcatcatctaaaatgacatatggttcacttgatttagggggatcatcattacaggttacatttgagaatgataaatcagtgcaggatgagacaagcattcgtctgagtattggttcagttgaacatcacctcagtgcttattctcttactggttatgggttaaatgatgcatttgataaatctgtagcacatctagtgaaaagactgggaggagttgctagcaatggcaaggttcaagtcaaacatccctgtctacagactggattcaaggaagattatatttgttcttactgccatccattgaaacaagatggaagtcccagtgtcggcgagaagaacagtggcaaagagaagcagggaatagctgttgaactggtcggagcacctcagtggaatgaatgtagtgctcttgcaaaagtaacagtcaatctttctgagtggtccagtgcaagtccagggcttgattgtaacatccatccttgtgctcttgcctctaactttccccgaccatatgggcagtttttcgctatctctggcttctatgtggtttttaaattttttaatttgactgctgatgcgactctaggtgatgttcaaaaaagaggtcaggaattttgtgaaaaaccatggaaagttgcaaagagtagtgttcctccacagccttttgtagaacaatattgcttcagagctccttatatttcatcactactgagagagggattgcagattaaagatagtcaggtgataattggctctggcagtattacttggactcatggagttgctttgctggaggctggtcaagcattgtcttcacgactagatattcaaggataccgaatactgcacagggagataaatccaaatattctcatagtactgtttctgatttcaattgtgttggtcatatgtgccatactatgcgtcagcaattcgataccaagatcattccgcaagtcttatctgccaattcataggcataattctggaggcagttctgttcttggtatgggattgcctttcaaacatttattatggaatcccattagttcaggtgatggtagaacaaagacaccactgagccctactgttgctgggtcagatcctcatccatttgcaggattaggaggcagcagtgtcgagcttatggagtcctcgaggcaatccttgggtgcctatcacagctattctgttgggagcttaggtcagatgcagttttctagcggggtgaggaaccctagccgaggtcagactacacttcaaagtcggaggtcgcaatcaagagaggatctcagttcttcacttgctgatattcattttccaaaagtgtagcactgcatcaaggaatgactagaatgagatccttacatgccataacaaactctgtaaataatagctccagagttcgaactgcttgatttcttctctaatcagaagtcaattttgtctgtccgcttacacttcaatgaggtttaggattcatataaatgaacttatgacttgtgcctatcctggacatgatacatccattcatcccattgtatgtgctcaagaacataccatagcagtgaagttctggtagtgtactggaagatatatttatgccgttcaccagactggttgaccatggctacagcctacaactttatagatcgattgtgctgcaatcagggatgttatttttttgtatctgagacataataaaggtgcatgtggtctcatgtactgttgtaccctctaggctctagtggctctgtgaggttactcttctttcctggaataccttttgataggctactctgtggtatcaactgaaatcatgaaacactgacatcagttctactggattatctagttgcgtactgtgtatacacatctattgagttttttttgttggcatagtaaaaaatttgatgacactgaaaatcagtataggaacatttgggccaatgtttttcctcgttgagctgagtttgatctgtattgcacatttgcttgtggatc

SEQ ID NO: 2719 - DNA, 3808 bp, Zea mays
  UNSURE (1)..(3808): unsure at all n locations
  Clone ID: PAT_MRT4577_79974C.1
  unsure (1)..(3808): unsure at all n locations
ggccggccgggaacagaacccaaacctcgccgattcgctccccttcctcaccgcgcgcgtacgccgccgctgcgctcaccttaacgaaccctaaacctgagccaccgccctcccccggaggtccgccgctccgtgtgggactctaggcgtcgccggagccccctccaggggctagcggcggaggaagtcggaaaccgattacccctcccctccccttaccgggggagggagaaactagcggaggaggcgaatcaggtcagagtggggcacgatgaggatcatgatcaagggaggcgtgtggaagaacacggaggacgagatcctcaaggcggccgtgatgaagtacggcaagaaccagtgggcgcgcatctcgtcgctgctcgtccgcaagtccgccaagcagtgcaaggcccgctggtacgagtggctcgatccgtccatcaagaagaccgagtggacaagggaggaggatgagaaattacttcatcttgctaaactcatgcctactcagtggaggacaattgcacctattgtaggtcgaacaccatctcagtgtcttgaacgttatgaaaagctgcttgacgccgcatgtgcaaaggatgaaaattatgaggctaatgatgatcctaggaagctgcggcctggcgagattgacccaaaccctgagtcaaagcccgcacgtcctgatcctgttgatatggatgaagatgaaaaagaaatgctttctgaggctagggcccgcttagctaacactaggggtaaaaaggccaaacggaaggcaagggagaaacaacttgaagaagcaagaaggcttgcttcactacaaaaaaggagagaattgaaggcagctggtattgatacacgccacagaaaaagaaagagaaaggggattgactacaatgctgagattccatttgaaaagagaccaccttcaggtttttatgatactgttggtgaggacagaccacctgaacatgtacagtttccaacaaccattgaggggcttgaagggaagagaagagcagatatagaggcacaattaagaaaacaggatattgccaggaacaagatcctgcagcgacaggatgcccctgctgctataatgcaagcgaataaactaaatgatccagaagctgtcacaaagaggtcaaagctaatgctgccgcctcctcaaatttctgaccacgagctagaggagatagcaaagatgggcagtgctggtgatcctgctttagctgatgagcttggtgaaggaagcactgccacaagaaccttgcttgccagctattctcagactccaaggcttggtatgacaccattgcgaactccgcagcgaactccagctgggaagggtgatgcaatcatgatggaggcagaaaatcttgcacgtctcagagaatcacaaacgcctttattaggaggtgataacccagagcttcatccatcagatttctctggtgttacaccacgcaagaaggagatacagactccaaatccaatggcaacacctttagcaagccctggccctggtatcactccaaggattagtatgacaccatccagagaggggcacagctttggtttaacaccgaaagcaactcctcttcgtgatgaacttaacataaatgaagtggaaatgcaggacaacactaaacttgagcttcgtaggcaagccgaactgaggaaaagcctgcgatctggttttgcttctattccacaaccaaagaatgagtaccagatagtcatgccacctattacggaagatgagaaagaagaagctgaagagaaaattgaagaggacatgtcagacagactggcacgagaaagggctgaggaacaagctaggcatgaggcattgctcagaaagagatccaaagtgttgcagaggagtctgcctaggccaccggctgtttcagtagagattatccggcaatctcttattagaagtggagaaagcagaagcagaagcacctttatgcctcctacatcacttgaacaagctgatgaactaataaatgaggaactccttaggcttcttgagcatgataatgcaaaatatcctcttgatgaaaaaactcaaaaagagaaaaagaaaggaagcaagcgtcagcaaaatggaggacctcttgtccctgaaattgatgattttgatgaagatgaactaaaagaggctagctctatggttgaagaggagattcaataccttcgagtggccatgggtcatgaaaatgaatcttttgaggacttcgtgaaagcacatgatgcatgccaagacgaccttatgttttttcctaccagcaatagctatggtttagctagtgtggctggaaatgctgataagatttctgctttgcaaaatgagtttgaaactgtgaagaagcgaatggatgatgaagctaagaaggcttctcggcttgagcagaagattaagcttctgacacaaggatatcagatacgggctggaaaactgtggtcacaggtccaagatacattcaagcagatggacactgccgcaacagagctcgaatgcttccaagagctgcagaaacaggaacatctcgctgcttcatatcgaatccaaaatttgtctgaagaagtgagtaaacagaaggcactagaaaggaccctccagagccgctacggcgagctggtttctggtttccagaggatccaagaacaggtcgaggagcacaagaggcaactcaaggtacaagaggcggtagaagccgaaagtcacgctcaggaagaggaagctgcggcatcaaatcatgctgctgctgaggaagaggatgaaaggaaggaagatgatgaaaggaaggaagaggatggaagcaagtctctcagctctgaagagaaaccacagcagacaagtacggctaccgatgaagaacctgcaggaagcaaaggaaccaccgaggatcagatggacgtggacagcgggaatggagagggtggagttgtaggccctgtcccaccagcaccagacactgaagggggtaatgatgaagtatcagttcaagagatcagtgaagcccagcccttgccttgaagacggcgctcctttcccttcaagctccgctttcttctcccgcacctggcgatcttcacgatgttgttgttgcacagcaggtccggactgagtatttcctatttggttatatttttagtgcactataatatcgcaagcgaagctacaattggttgtgagctaaatttgcatatccttccctttgttgtattcccttgaacaatgaatcagaacaactgtttaccatttttctaaaggatcgacggcttatgtactcatgcagaactgcctcattgtgcctctggctgaatagcagccaagtaagcgtgacatgctctttgttcatttagtatggtccacaatgctttatggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaannnggggggggnannnaaaaagaaaaaaaaaataannnnannnnnaaaaaaaaaaaaaaanttttttttttnnnaaaaaaaaaaaaaaaaantggggntttttttaaaaaanttnaaaaggaaaaaccgggggggtacccaaaaattgggggtgggaaaaaaattcccttttgggaggggggggaaaaaaaaaaaagccccccccccatcccccccccaaaaatggccccccccgaaggggaaatgggccccccc

SEQ ID NO: 2720 - DNA, 2289 bp, Zea mays
  Clone ID: PAT_MRT4577_80047C.1
atataatgcgttattatcctccaccagagagagccgacgatgtccatccatgtaggcatgtagctgcagcctgcaggccccggcctctctacacacacccgtagcggagatcatgagcagcgcgcgccaagccatcaccccgtggccaagcttaaagaaacctcaccatgtgtccctcggtccctcccggtttaaggatgccgtcaattgtttagaaaccacacggctgtccctgtcgctggctaagtggttggagtgctgactagttagtgccagattagacgggcaagccatcagcagccaatgcctccgtgctgttgttgttgttgttgcatgttgttgtccattatttagctgctttgcgcgcgtgcagacaccgagctacctataggccataggctatagcaagctccgccgtcgccattgctacacaccaatctttcctgccgcggtgccgcctctcgtccatggcaaagggagcgggagctagctgacggccgcgcgctttcgtcttttgtcctttaatttcgcagcattccgcgcgcttggtctctcggaggcgtggcggtagcctgtgccggtgtgcctcggagctccggcctccgggaataaacataggggtatcgccatgcaggcggcggccaagacgaggaatggctccttggaacaccccacccggacgtcctccctgggcggtctcgaggccggccggacggcgaggatggccgagtcgcccaccggcctcagccccaaggtcgaccgccgcacggcggtgagcgccgagagagagaaaaggaggccaccgacgacgaagctatcggagctggagtcccagctgtcgcagctgcaagacgagctcaagaaggccaaggagcagctccattcctccgagctctccaggaagcgggccctgcaggaggtggacgacgccaaggcgcaggccgccgcggcgtccgcgcaggcgcgcgacaccgaggctcagctcgccgagctctcgtcggccgaggagtcccgcctcctggagctgcgtcgtctgtcgcaggagcgcgaccgctcgtggcagtcggagctggaggccatgcagaagcagcacgccgcggactcgaccgcgcttgccgcggcgatgggcgaggtgcaccgcctccgcgtccagctcgccgccacggcgcgcgccgaccgccggcaggacgtggtggaggcgctggccaccatcaacgagctcagggccaagctcaaggcaagcgaggaggccgaggcgcaggcgcgcgcgatgcacgaggagtgcaagcagcagctggaggcgagccgggccaccatcgattcgctgctcaccgacgggtccaagctgatggactcgttcagcctcgtggtgaaggagctcgaggagtcgcgtgccacggtcaaggctcttgaggacgagatcgcggagacgtcgtcgagggccgcaggcgaccactgcagctgctcgggctcggagtcagaggcctccgagctgagggcggagctagaggccgcggaggccaggtaccaagaagagaagatccttagcactgtcgagacgcagtgcgcgtacgagctcatggaccagataaagacagagtccgacctgcggcacggcaagctcgcggcggcgctcgagggcgccaagtccgaggtcatcttcctcaaggcgagtctgttcgacaaggaatccgagctacgtagtgccctggacgcgatcaagaagctacaagcggagacgagagcagacggctcggccgacgcgctgaagcagcagctgcagtgcgcgctgcacgagaacgggcagctgaagcaggagttgcaccagtacgagtccgagaagggctccgcgaccgcgaggacggcggaggccgacgcgtcggaagcggcgaagaagggtgagatggaaaccgagctgcgccgcctgcgggtacaggccgagcagtggcggaaggccgcggagacagccatggcgctgctgacggttggcaagggcgggaacggcaagttcgtggagcggagcgagtcgtgggagggcgttaagtacgcgggcctctgcgaggaattggacgacgacgcggctgtcaggaagaacggcaacgtgctcaggaggatcagcggcatgtggaagaaatgagtgcgatcgggcagctgagcggcggacgcggcgagggctgtactgatctgtagccttgggtctctctggtgtaattgttttttttaaaaggaggatgaccctatggttttagaaaaagaaaggtaacaaatataatacatgagttgccagtg

SEQ ID NO: 2721 - DNA, 360 bp, Zea mays
  Clone ID: PAT_MRT4577_80122C.1
ttgttttaagattctagaaatgaacttttcaatttcagggatggctcaaacatccgatgaaaaactttattattgctctataactaataagaaagctaaaagagggcaccaccaatgatgggatgatggtcgaacactggtgggtgtgtaaaagcaagatggttgaatggcactaatcgttgcaattgtaggagggtgccagcgtgaggcgcaacgtgctggtcgatcggaaacaactgtggttgtgataagaaggctgcggggctcacacctgctagctggctggatggtaatagatgttgctgctgtcaataaacaggcgagttcaatgctgctcgctggtggtatggaagaaattgc

SEQ ID NO: 2722 - DNA, 986 bp, Zea mays
  UNSURE (1)..(986): unsure at all n locations
  Clone ID: PAT_MRT4577_80301C.1
  unsure (1)..(986): unsure at all n locations
ccgggaaaacgatgaagaaaagctccgtgacgcatgggtccgtcacgttgtcaccttctcaggtgattcgagcacctctgagcttatcacaattcactccactcatcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaaggcttagaaagtagggacttcatttgcactgtgtgctgtagcatgctcgtgtctagatctgtggatgggatgtgtcctgctctagtttcgtccttgtgtcttattgtatgttcgtcttcatcgagaagatcttcagcaatcagagctcgttgtgtactaatgttccccatgttctgtttctcgttctgattctgcaattcgtcatattgttgaatttaatggttttgtggaatcactaaaaaaaaaaaaaaaaaaaaaaaaaaaaaaaaaaaaaaaaaaaaaaaaaaaaaaaaaaaaaaaaaaaaaaaaaaanaaaaaaaaaaaaaannnnttttttttttcccccttgct

SEQ ID NO: 2723 - DNA, 1964 bp, Zea mays
  Clone ID: PAT_MRT4577_80303C.1
gcacgaggatggtcagataggggtatacaaaggaacacctgctttgatgctcacgggcactgcagcgaggaggtacagccacaagtacaaagcacgattagacaattttttttgaccccattgcaacatttcacaaatttgctctcatcaagcaagagtcgtttagaacctctaaaatttcccccactcgccagtcgcagcagcacctgtagcagccatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgttctggagtacctcgccgccgaggttctggagttggcagggaacgcggcgaaagacaacaagaagacgcgcatcaaatcccgcgccacgtgctcctggcgatccgcaacgacgaggagctcgggaagctgctggccggcgtcaccatcgcgcacggcggcgtcctccccaacatccactccgtgctcctgcccaagaaggccggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcatgctctagtatcgtccttgtgtcttattgtatgttcgtcttcatcgagaagatcttcagcagtcagagctccgagttttttttttttttttttttttaaatcaatagagaaacgttataatacagcccaaattgcttcagaacatacaatcgcccaatatgtccaaaacaggtgcggccaagggcgtaccgttttacaggatgcaacaaccaaagccttaagtttgggagtttgggacaagcgtcatcaaccaagtaccaaggcaactgaacatgagcattggcataccatgggcataaaaatgaaacaatccagagacaattctcagggccagtgaattccaggctgtgatccatgtgataaagcacttgcaaacaatactcaggtaaacaatatgggacgacaaataatcagccaaaatcttcactcagccaatcatagaaggtatgttcccattctctaagcattcctggttgcgatctgagactcagcctctttcttcacgggctcttccttctctgacaagatgagttcgatgtggcacggggaggacatgtaagggttgatgcgcccatgagcgcggtaggtcctgcgccgctgcttctgagcctggttcacttgaatgtgtgacacatagagggtatcgacatcaagaccttttacctcagcattgctctcagcattcttgagaaggtctagaatgaatctagcagatttgacaggccagcgtccctgcccatttgagtgacgagacttagcctgagcggtacgtccaacaccgccacaatacctgcggaacgggatggcctgcttgtgggcaatcacatcctcaaggtaccttttggccttggtgagtgacaacttcctaagggcaaaagctgtctcacgggtgttcttgaagtgaacacgtaggtcacggcccatggccttggttgacttggtggggttggttggctccgtcgaatatttcaccatggctgcagccggcgagttgggggggtcctcaaggcggtgttgagatgctcctgcggagggagcgggagccaaggttagagaacgaagcggcggcggtaggagcgcgagaaattgtgtacatgcaactatgcaagccaactactgggcaaaaaccctagcggcttcgttatgggccgagccgctcgagcttggcccacgttcatccaaggaaaaagaacctcgtgc

SEQ ID NO: 2724 - DNA, 1188 bp, Zea mays
  Clone ID: PAT_MRT4577_80350C.1
gttacagaggaaaggttgcggtggatacctaggcacccagagacgaggaagggcgtagcaagcgacgaaatgcttcggggagttgaaaatagtttcctcctccactccctcccccgcctccacaacccccctcccaggagccgcccaggtacgtcgccggcggcgatgacgacgcgcttcaagaagaaccgcaagaagcgcggccacgtgtccgccgggcacggccgcatcggcaagcaccggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgacaaggcggcggaagccggcggcgacaaggccccgcagatcgacgtcacgcagttcggctacttcaaggtgctcgggaagggggtgctgccgcccaagcccatcgtcgtcaaggccaagctcatctccaaggtcgccgagaagaagatcaaggccgccggcggcgccgtcgtgctcaccgcctagttttcagtccttattcgcctcttggttttgagatctatatctgaactagcagtgctttcttgtctcacctatttgtgttaagaagacgtagtttttaaatccattgctccttcctgtttggacagtgctttcatatcaaatatttcaggtatattagagctgaaaaaaaaaaaaaaaaaaaaaggaaggagaagaagacgagtgtcaagtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtctaacgcgacctgcggtaagcggctggcg

SEQ ID NO: 2725 - DNA, 1918 bp, Zea mays
  Clone ID: PAT_MRT4577_80424C.1
gtcagagaacaccataagtggccgctacacctgctcactccattgcaccactagcaagtagcaacaggagcgcaggcagaactagagcggtcttggtatggcttcttccctcgcgcccgcgtcgtgggcactgccgctgcagatgggcggggctggggcggcagcggcggggccttcctgccgcgcgacgctagccgtcgtcacggagccccgctgggccgcgtcgctgcgccgggcaagggttctcgtggcgctggcgccccggtgcgtggcgctcgacgggcccggcgccagcggcgaggaggaggcgcccaagatcgaggacgagaggaagaagagcggtgagacgaagaagccggcgcgcggccggccggtgtggagccggatcctcttcgcctccaagaagacacgaagtatcatcatcctcaacgccctcacggtcatctatgcaagtgatattccggttttgaaagaggtcgaagccctgacagagcctgcggtcttcaacatggtgcggttcgttgttgcagccatccccttcgtaccattcgcgctccgttccttcggtgaccgcagtgtacgctacgcgggactggagctgggagtctgggttagcttagcttacctttctcaagcaattggattgctctcatctgatgctggccgagcatccttcatcacggccttcacggtcgtagttgtgcctctaattgatggtcttcttggtgcttcgatccccagactcacatggttcggagccatcatgtctctgttcggaattggcctgctggaatgtggtggatctcctcccagtgttggcgatattttgaacttcttcagtgccgtgtttttcgggatccatatgcttagaacagaacaaatatcaaggagtacggacaagaagaaatttttagctcttcttggcttcgaggtccttgtggttgctttctcctccgttctctggtttatgttcaaagatggctacgttgataccagcggatccagctttgaatcttggacgttcgggatgctctgggataccacagtttcgtttccttggataccagcattgtacactggagttctttctacggtgttatgcatgtgggcagagatggtggcgatgggcgatgtttcagcaaccgaaactgcagttgtttacgggttggagccagtttggggagctgcttttgcttggttcctccttggtgaaagatgggatgacgctgcatggactggagctgctctcgtattatgtggcagtttgacagttcagctatttgggtcagctcctgagaagtccaagaaagtcaaaaaacgcagcagcaatgctttagaaactccagtgaaacgacgagactacttatcgttgtctcccataccagttgattccgggaagatcataggaaggcaattagaaaggaagaacaaagcagtataggtagcccaactacaaggcaagaagaaaggaaacgctgcgatgataggggcgcgcatgtaccaaatcattgtcctgaggcatcatctgtttggctccgtcaatatggggatgctgctcgattgctccgcatggagtttttttttcctttgtccgtattgaaaatggtcgtatttggatttctgttgtctcagttgaccgtgctagagtacctcatgcgtattaggaaatgaggcattggtagtggcaactcgaggagaatacttagacacatctactggcgtagtaatggcgttcagtgagataacttagtatgttttgggcactgttaaccgtacaggttcatgtaaatatatagtggctaaatggttctagagtactgagctgagcacaccattgtatagtactgaaataacaaataccacgcatggtattatttggctcccagtcaatagatccaggaatgattttgtggccgtg

SEQ ID NO: 2726 - DNA, 807 bp, Zea mays
  Clone ID: PAT_MRT4577_8051C.1
atttaacccccacccctctcgccctcctctcgattcgatctcggcttcctctccaagccacgcgagaccagagctccggccatggccgccacgatccagtccgtcaaggcccgccagatcttcgacagccgcggcaaccccaccgtcgaggttgatgtgtgctgctcagatggaaccttcgccagggccgctgttcccagcggtgcatcaactggtgtctatgaagctttggagctgagggacggtggatctgactacttgggcaagggtgtttccaaggctgttaacaatgtgaactccattattgcacctgctttggtcggcaaggaccctaccgctcaaactgagctcgacaactttatggttcagcagcttgatggaaccaagaatgagtggggttggtgcaagcaaaagcttggtgctaatgcaatcctggctgtgtcactagctgtttgcaaagctggagccagcgtcaagaagattccactgtaccagcacattgccaaccttgctggcaacaagcaattggttttgcctgttcctgcattcaatgtcatcaatggtggatcccatgctggaaacaagcttgccatgcaggagttcatgatccttcctactggagctgcctcattcaaggaggcaatgaagatgggtgttgaggtgtaccacaacttgaagtctgttatcaagaagaagtatggccaggatgccaccaatgttggagatgaaaggtggttttgctcctaacattcaggagaacaaggagggccttgagctcttgaagaccgcaattgagaaggctggata

SEQ ID NO: 2727 - DNA, 848 bp, Zea mays
  Clone ID: PAT_MRT4577_8054C.1
ctcgagccggccgggccgggactgctacagcgaacccgcacccctctcgctctccgctccatctggtccgattcgattcgattcgatctcggcttcctctccaagccacgcgagaccagccatggcggcgacgatccagtccgtgaaggcccgccagatcttcgacagccgcggcaaccccaccgtcgaggttgatgtgtgctgctcagatggaaccttcgccagggccgccgttcccagcggtgcatcaactggtgtctatgaagctttggagctgagggacggtggatctgactacttgggcaagggtgtttccaaggctgttaacaatgtgaactccattattgcacccgctttggtcggcaaggaccctaccgctcaaactgagctcgacaactttatggttcagcagcttgatggaaccaagaatgagtggggttggtgcaagcaaaagcttggtgctaatgcaatcctggctgtatcactagctgtttgcaaagctggagccagcgtcaagaagattccactgtaccagcacattgccaaccttgctggcaacaagcaattggttttgcccgttcctgcgttcaatgtcatcaatggtggatcccatgctggaaacaagcttgctatgcaggagttcatgatccttcctactggagctacctcattcaaggaggcaatgaagatgggcgttgaagtgtaccacaacttgaagtctgttatcaagaagaagtacgggcaggatgccaccaatgtcggagatgaaggtggttttgctcctaacattcaggagaaacaaggaggggccttgagctcttgaagactgcaattgaaaaggctggata

SEQ ID NO: 2728 - DNA, 522 bp, Zea mays
  Clone ID: PAT_MRT4577_80551C.1
aaaaagtcctttttttatttttgggaaagccacaacttcaaataaaaactttttttttgacctttacctcataaaaaatttaaaaaagggccccaccaatgatgggttgtgggtaaaccactgttgggtttgtaaaaccaggttggttgaatggcaccaatggttgcagttgtaaaagggggccagcgttaggcccaccgtgctggtaaaacggcaccaactgtggttgtgtaaaaaaggtaccagggttaacaccacttacctggttgaatggtagtagttgttgttgttgtaaataaccaggaaagttcaatgctgttagttggttaaatggaaaaaattgttgggggtaggcaccaggtacctggctaaatggtagttgttgttgttgcaaataaaaaccaaagttcaatgaacctatttggttaaatggaaaaaactgttgttgttgaaaagtaggcaccagggtttgttaccccaagttgttgtaattgttgggccctgatgttttgggccaataaa

SEQ ID NO: 2729 - DNA, 129 bp, Zea mays
  Clone ID: PAT_MRT4577_80580C.1
actaactaccttcgccctgacctcaagcgtggcctactcagcactgccgaggagcagctcgtcattgacctccatgccatgctcggaaacagatggtccaagatcgctgccaagttacctgggagaaca

SEQ ID NO: 2730 - DNA, 285 bp, Zea mays
  Clone ID: PAT_MRT4577_80596C.1
gcagcaccaagaggcaccattttttccttaagattaacttagaataaagtctgacgggggtaacagcatccatcgatccgccttccacgctgactgatgcatggttatgttgaagccgaggatgaacccaaatctaccaactgccccagcgcggccttgcaatcaaaaacacagatgggcatccacaagcacatcacgaacggggataaaccctgtggcctagggcaatcgcctcgattgcaaacccgataacttggcctggcggtccccaccgctcagttcgtc

SEQ ID NO: 2731 - DNA, 685 bp, Zea mays
  Clone ID: PAT_MRT4577_8071C.1
ctcgggccggccgggctgtaaactacactcctactcctgcactgaaacacttgattgattcatgggtagctagttagctgaattacattggatcctaccaagtttcgttcgtacagcagacacgacacgacggggatgacgaccaacgcggccgctcctgtgtggaacgacaacgaggcgctgactgtgcggcctcgcggacccatcctgctggaggactaccacctgatcgagaaggcggagcacttcgcgcgcgagcgcatcccggagcgcgtggtgcacgcgcgcgtggcctccgccaagggcttcttggagtgcacccacgacgtgacgtagctgacgtgcgccgacttcctgctcgcgcccggcgtgcggacgcccgtgatcgtgcgcttctggacggtgatccacgagcggcggtccccggagacgatgcgcgacccgcgcgtgatcgccgagaagttctacacccgcgaggtcaactgggacctgctgtacaacaacttgctcggcttcttcatccgcgacggcatcaagttccccgacgtgatccacgcgatcaagcccaacctgaggccgcacgtgcaggagtactgccgggtgctctacttcctgtagaacctcccggacagcctgcacaccttcatgttcctcttcgacgacgggggcgtgctggccgactacc

SEQ ID NO: 2732 - DNA, 170 bp, Zea mays
  Clone ID: PAT_MRT4577_80753C.1
aagctcaacagtcatggtcgacatgggcaaggagcaacaacaacacgaggcggatgaggtgcaatgggaggtcgtccaagaagaagtgctagtcgggcaagagacagtggtaccggtaccgtcggatgaggacaaggtggccgaggcggcactagtgcacaagatctcca

SEQ ID NO: 2733 - DNA, 969 bp, Zea mays
  UNSURE (1)..(969): unsure at all n locations
  Clone ID: PAT_MRT4577_8094C.1
  unsure (1)..(969): unsure at all n locations
cattgggtacctcgaggccggccggngaaaaaaanaaaaaaaaaaaaaaaaaaaaaaaaaaaattctttccccgcttgctttccagtttggcggcatcnagtcggtggcgcctgcgatggagtctctgttcggccaatcgcagcggaggaggagggcgggcggcagcggcttcgaatcgctcaagcgtctgggtcacatctcacccgctgtgcagtcccacctcaaacatgtgtacctcaccctatgctccgcgctggccttctctgcactcggcgcgtacctccacatcctcctcaacgtcggaggcgccctcacgaccgtgggatgcgtggcctccatcgccttcctcatctccctgcccgcttcacgggaccaggagaggaaccgcttggcgctgctcatgtctgccgcgctccttcaaggcgcgtccgttggtccgctcgtcgaccttgttattgacttggattcgaggattctcgtcactgcgttcgtcgggacggcagttgcttttgcatgcttctctggcgctgccatcatcgccaagcgcagggaatacctgtacctcggcggtctgctttcatctggcctctccattcttctctggctgcagtttgctacttcaatctttggccacaccagcgcgaccttcatgtttgagctcttctttggcctcctggttttcctgggatatatggtgtttgacacccaggagatcatcgagagggcgcaccgtggggacatggactacatcaagcacgcgctgactctcttcaccgactttgttgcgatgaagaatgcacaggagaaatcccaagacgagaagaggaagaagcggtagctgctgaatgaattggatgacatatgttgttgtggtcactacttcatagtaccatgtactcctatcctattgtactaataataataataagacgaaagatgactgctgggaatgaatatttggttctgct

SEQ ID NO: 2734 - DNA, 493 bp, Zea mays
  UNSURE (1)..(493): unsure at all n locations
  Clone ID: PAT_MRT4577_80953C.1
  unsure (1)..(493): unsure at all n locations
cggcgccggggatcgcacatatatatttagaccaactagcaacatangcaagcacaatagtgtaccaacaatgggagacgaaatattctggctgcttatgcagcttgatattaagtgaaagtgctgctgcggtaaccattttcgccgcaatggtcacaagctcctataggttgccttctagccccgttcctctcaccagcggtaagttaggtatgtgaaaacccaattctagaaccctacaggatgcaacagacgatcagaggtggcatcttacctttatcacccttgttcctccaacaatcatcagccctattacaagagttacctttggtgcatttattggcacaaaacatcagggcacaacaactacaacaacttgtgctagcaaaccttgctgcctactctcagcaacagcagttttcttccattcaaccaaactagctgcattggaactcctgtttctttttttgcaacaacaacaactaccatttta

SEQ ID NO: 2735 - DNA, 1270 bp, Zea mays
  Clone ID: PAT_MRT4577_8095C.1
atcgacttccgcagcagcagcgtcggacacccaaagccggcgttcgcggtgtgcgacccacaacatgactagtacgtcgacccagcggggccggaaaaaaaaaaaaaaaaaaaaaaaaaaaaaaaaaaaaaaaaaaaaaaaaaaaaaagccggccgtgggccagcctgaaagcaaagagtgggccgggtggccaggaccaacgacttttccatagtcgtgctcgtcttcgtccacctcccgacccgactgagtagcaagcaattctccaaattagggtttctttccgcttgctttccagtttgcggcatcagtcggtggcgcctgcgatggagtctctgttcggccaatcgcagcggaggaggagggcgggcggcagcggcttcgaatcgctcaagcgtctgggtcacatctcacccgctgtgcagtcccacctcaaacatgtgtacctcaccctatgctccgcgctggccttctctgcactcggcgcgtacctccacatcctcctcaacgtcggaggcgccctcacgaccgtgggatgcgtggcctccatcgccttcctcatctccctgcccgcttcacgggaccaggagaggaaccgcttggcgctgctcatgtctgccgcgctccttcaaggcgcgtccgttggtccgctcgtcgaccttgttattgacttggattcgaggattctcgtcactgcgttcgtcgggaccgcagttgcttttgcatgcttctctggcgctgccatcatcgccaagcgcagggaatacctgtacctcggcggtctgctttcatctggcctctccattcttctctggctgcagtttgctacttcaatctttggccacaccagcgcgaccttcatgtttgagctctactttggcctcctggttttcctgggatatatggtgtttgacacccaggagatcatcgagagggcgcaccgtggggacatggactacatcaagcacgcgctgactctcttcaccgactttgtttcggttcttgttcgaatccttgtcatcatgatgaagaatgcacaggagaaatcccaagacgagaagaagaggaagaagcggtagctgctgaattaattggatgacgtatgttgttgtggtcactacttcatagtaccgtgtactcctatcctattgtactaataataataatagtaagacgaaagatgactgctgggaatgaatatgtggttctgctaaataaaaaaaaaaaaaaaaaagaaaaaaaaaaaaaaaaaaaaaaaaaaaactcgag

SEQ ID NO: 2736 - DNA, 160 bp, Zea mays
  Clone ID: PAT_MRT4577_8096C.1
tctttcgctagtgggcgaccgccgccgcgtccgtccgtcaggtgcccaggtgtagcctcgtccgccccttcgtcaggtcttcgttagacccctcgtcgactagcacccaccagacatgcattagagcgcgcattaaaaataatatctgttcttaccggcg

SEQ ID NO: 2737 - DNA, 1560 bp, Zea mays
  Clone ID: PAT_MRT4577_81096C.1
ccggggagattcaatgaatccatctccatcctttcataacacacctgcaatcataaagagaggtgcaacgtcttctccgtgcttaccactcgccattcctaagtcctaactacctccacccccgcacgcacaactggccgcgccaaggcaaagctagaagaagacaacgcaaagggagaggacagaggaggagcagaggacgatgggcagcggcggcgctaacactgcccccctcctcaccccctacaagatgggaaaattcgatgtttcccacagggtagtcctcgcaccactgacgagacagcggtcctacggcaatgttcctcagcctcatgccatactgtactatcagcagagggcgactaaaggaggtcttctgatcgctgaggccacgggggtttcagacactgctcaagggtacaaggacactcctggcatttggacccatgagcaagtcgaagcatggaagccgatcgtagacggggttcaccagaaaggagggatatttttctgtcagatttggcacgtagggagagtctccaattccacttttcagcctaatgggcaggctccaatttcaagcaccgataagccactaaagcctcaagtgagagccaatggtatagacgtggctactttcgcagttcctagacgcttagagactgatgaaatccctttggtcgtcaatgatttcagggtagctgctcgaaatgcgattgaagctggatttgatggtgtcgaaatccatggagctcacggttacctgattgatcagtttctaaaggacggggtcaacgaccgcacagacaaatacggtggcagtctggagaaccgctgccggtttgcactggaagtaactcaagccgtggtcgacgaaattggagctgacaaggtcgggataaggctgtcaccattcgctagctactcggaggcgccggactcagacccggaagctctgggcatgtacatggcgaacgcgctgaacgagttcgggattctctactgccacatggtggagccgcggatggtgaaactcggtgaaaagttcgaaaccccctacagccttcgcccgataagggacgctttcaggggaacgttcatcgttgccggcggctacggcagggaggatgggaatcgcgcgatctccactgggtatgctgatttggtcgcgttcgggcgcttgttcttggctaatcctgacctgcctcggaggtttgaagtagacgctccccttaacaagtacaacagagacacgttttacatccctgatccggttgttggatacactgactacccatttctttcgtcagatgtataaatgttctcttttcagcaatctgcttttttagattgagtagtaactggttggtgtaccagtaaaatattagaggaataaaccattggtctgaatgcctcattctcatatatatggacaaaagcaatatgatcgttgtaattgtgcctcaaatcttatagttgtaaaaaatattgtgaacaagatcagacaaaaaaaaagaagggcggccgctctagaggattcacagaatcacaggcaactac

SEQ ID NO: 2738 - DNA, 1693 bp, Zea mays
  Clone ID: PAT_MRT4577_81100C.1
ggtacccccgatctttggcggaccactcgccattcctaagtcctaactacctccacccccgcacgcacaactggccgcgccaaggcaaagctagaagaagacaacgcaaagggagaggacagaggaggagcagaggacgatgggcagcggcggcgctaacactgcccccctcctcaccccctacaagatgggaaaattcgatgtttcccacagggtagtcctcgcaccactgacgagacagcggtcctacggcaatgttcctcagcctcatgccatactgtactatcagcagagggcgactaaaggaggtcttctgatcgctgaggccacgggggtttcagacactgctcaagggtacgtctgtcgtctgctagaccatcaggctactacggctgcttgagatctgtgtggtcatgctaaatttcatcattcagtagtttagtcgatgtctgaataaagatgtgttttctgtatgcgcacaaggtacaaggacactcctggcatttggacccatgagcaagtcgaagcatggaagccgatcgtagacggggttcaccagaaaggagggatatttttctgtcagatttggcacgtagggagagtctccaattccacttttcagcctaatgggcaggctccaatttcaagcaccgataagccactaaagcctcaagtgagagccaatggtatagacgtggctactttcgcagttcctagacgcttagagactgatgaaatccctttggtcgtcaatgatttcagggtagctgctcgaaatgcgattgaagctggatttgatggtgtcgaaatccatggagctcacggttacctgattgatcagtttctaaaggacggggtcaacgaccgcacagacaaatacggtggcagtctggagaaccgctgccggtttgcactggaagtaactcaagccgtggtcgacgaaattggagctgacaaggtcgggataaggctgtcaccattcgctagctactcggaggcgccggactcagacccggaagctctgggcatgtacatggcgaacgcgctgaacgagttcgggattctctactgccacatggtggagccgcggatggtgaaactcggtgaaaagttcgaaaccccctacagccttcgcccgataagggacgctttcaggggaacgttcatcgttgccggcggctacggcagggaggatgggaatcgcgcgatctccactgggtatgctgatttggtcgcgttcgggcgcgtgttcttggctaatcctgacctgcctcggaggttcgaagtagacgctccccttaacaagtacaacagagacacgttttacatccctgatccggttattggatacactgactacccatttctttcgtcagatgtataaatgttctcttttcagcaatctgctttttagattgtgtagtaactggttggtgtaccagtaaaatattagacgaataaaccattggtctgaatgcctcattctcatatatatggacaaaagcaatatgatcgttgtaattgtgcctcaaatcttatagttatagttgtaaaaaaatattgtgaagaagatcagtcagttgtcaagttgtataaaaagtcagcctggttcacagaatcacaggcaactactatgcccctgttggaatcacatggcgttttcacagacaaaaaaaaaaaaaaaaaagcggcc

SEQ ID NO: 2739 - DNA, 411 bp, Zea mays
  Clone ID: PAT_MRT4577_81104C.1
ttattgagaccaactagcaacatagaaagcacaatagtgtaccaacaatggcagccaaaatattttgcttccttatgctccttggtctttctgcaagtgttgctaccgcaaccatttttccacaatgctcacaagctcctatagctttccttttttccccataccttttaccagcggtgtcttcaatgtgtgaaaacccaattgtttaaccctacaggatccaacaggcaatcgtaacaggcattttaccattatcacccttgtttcttcaacaaccgttagccctattacagcagatacctttggtccatttggtggtacaaaacattatggctcaacaactacaataacttgggcttgttaactttgctgcattctttcaactccatagtttcttcattcaaccaactg

SEQ ID NO: 2740 - DNA, 377 bp, Zea mays
  Clone ID: PAT_MRT4577_81216C.1
gctaccggtcgtctaccacctccagtcgaggttgtgccccatccccagctcccaagtcgcagctcttccggccatggcggcggcggcgcagaggctcctcgcggcgagcacgaagatcgtcggggtcgggcggaactacgtcgcccacgccaaggagctcggcaaccccgtccccaaggagccggtgctgttcctcaagccgacctcgtcgttcctccacgcgggcgtggccaccaccgccgtcgaggtgcccgagccgctcgagtcgctgcaccacgaggtcgagctcgccgtcgtcatctcacggcgcgcgcgcgacgtgcccgaggcctccgccatggacttcgtcggaggttatgctcttgctttggacatga

SEQ ID NO: 2741 - DNA, 305 bp, Zea mays
  Clone ID: PAT_MRT4577_81245C.1
gttggcttctcttgccccttcggttcggggtctggttcgggagggtatccgcggttcggtttctcgaatcagcggatcgagatggccgcgtatgatgttgactaccgctgcttcttcggcggcctcgcctgggccaccgacaaccactctcttcacaacgccttcagcacctacagcgaggtcctacagtgcaagatcatactcgatcgggagacacaaaggtcccgcggcttccgctacatcaccttcttcacagaggaagctatgccgaacgccatcgaaggcatgaatctgaaagagctgga

SEQ ID NO: 2742 - DNA, 219 bp, Zea mays
  Clone ID: PAT_MRT4577_81527C.1
atcagcttagcccgccggcgatcggcatcgcggtggagtgcgtgttcgcgccgttcctgggccgcgaatgataccagccggtggtggacgagaatgtggataagctcaagaaggtgctggaagtgtacgacgcgcgtgtcggcacgtgcacgtacctcgacggcgacttcctcagcctcgccgaactcagacgcttcacgatcatgcagtggctcatgg

SEQ ID NO: 2743 - DNA, 1751 bp, Zea mays
  Clone ID: PAT_MRT4577_81549C.1
ccggccgggttcggattctcctcctctgcctttcgcttcgtcactcgccacgccacgccaaagaccaagaaaaaaaaggacgattttttcctagctgcaacttccctcacgccatggaggaggagatgccgctgcagctgctctccgcttcctccgccgccgtcgctgtctgagctcccccttcgctcgatctctccatcgggccgggcctacctctcctagcagtgaatcaaaccatggcagctttcgccgcgctgttcgaccccctgtactgcccggaggagcacctcgatctgtaccgcgacgaacccggcgagggtgcggacgagcagtggccgggccagcacggacagcaggagccggctgtcctcgacgacgagctgccggcgctgttcgaggcacaccgggccaaggagggggtggtgctggcggaggatggcgggtacggcggcgcagctgggcgtgaggccgcggtcggctgggtttcacgcgccgcggcgcggctaggcttctccgcgctcaccgccgcgctcgccgccgcctacctcgaccgctgcttcctccccgggggcgcgctccggctcggcgaccagccctggatggcgcgcctagccgccgtcacctgcttcgcgctcgccgccaaggtcgaggagacgcgcgtgccgccgctcctcgacctccagctctacgccgccgctgacgccgcggatccgtacgtattcgaggccaagacggtgcgccggatggagctgctcgtgctctccgcgcttgggtggcggatgcaccctgtcacgcccttctcctacctccagcccgtcctcgccgacgctgcgacgcgcctgcgtagctgcgagggcgtcctgctcgcggtcatggccgactggaggtggcctcggcaccggccttcggcgtgggccgccgccgcgttgctgatcacagccgccgccggcgacggcggcgacggcgacggcgacacggagctcctggcgctcatcaatgcccccgaggacaagaccgccgagtgtgccaagatcatctccgaggtgacgggcatgagcttcctcgcctgcgatgtcggcgtgagcgccggaaataagcgtaagcacgcggcggcgcagttgtactcgccgccgccgagcccgagcggcgtgatcggcgcgctgtcctgcttcagctgcgagagctcgacgtccgccaccgctatggctgcggcggtcggcccgtgggcgccgtcggcgtccgtgtccgtgtcgtcctctccagagccaccaggtcgggcccccaagcgcgcagcggcggcgtcggcgtcggcgtcggcgtcagccggggtcgcgccaccggtccaggtcccgcatcagctaccccccgacgaggagagccgcgacgcctggccgtccacctgcgccgcgtgacgcaccgtgccggaaacggtgcctatggcgagaccgccgttcggtggcggtggagaatggagaacaaggagcatcattggctcgcgtcggtgagcaggagaacgaactattttgcccattgccgtgacagatggggggcaagagagataagaaaagatgtccttgtttgcatgcttatggcgggagtaatgtttgcatgcttgtggcagcacattttgcaatgatggttctcagagaacttagctggaggtggaagatgattagcggataatttgccgtcgagatcgatggcgatttagtatttgttgcaactgtagtgatgctagttcttgccgtgtt

SEQ ID NO: 2744 - DNA, 170 bp, Zea mays
  Clone ID: PAT_MRT4577_81550C.1
caacaaaggggagccggtatttaaaccgagtcactgaactggggtttgtccaagtccaaagacgggcaacaaaaaaaaaaaaatcccgtttaactttcttaaacaaaaagttggcagggggggggctccccgttttttaaactaaacgggagctacagtttgatttaaaa

SEQ ID NO: 2745 - DNA, 448 bp, Zea mays
  Clone ID: PAT_MRT4577_81604C.1
cctactatcaacatataaagctcaatattgttccaacaatggcagccaaaatattttggcgccttattctccttggtctgtctgcaatttctgctacttctaccattttccctaaatgctctcaagctcctatatcttcccttcttcccccgtaccttttaccagctgtgtcttttgtatgtgaaaacccaattcttcaatcctacacgatccaacattcaatcacagctggcatcttatctttattacccttgttcctccatcattcatcaatcctattacatcatttacctttgatgcatatattttctcatatcattatgttcacaacaactacaacatctagtgctttcatatcttgctgcctactctcatcaacatcagttcttttttttcaactaactatctgctatgatttctgcttcctattttactcatcattctaact

SEQ ID NO: 2746 - DNA, 2362 bp, Zea mays
  Clone ID: PAT_MRT4577_81610C.1
atacacgccaagtcgccagccagcatttccccccgaaccatccttccactccctcgccgaccctccccccgcgcccgccatggacacggcgatcggctccgtcccggcagcctccgacgcggcgcgtcacccagcgccgtccgcgtccgccccgcgcgacgcgacgctgggccggcacctggcgcggcgcctggcggaggtgggcgcccgggacgtgttcacggtgccgggggacttcaacctcacgctcctcgacgagctggaggccgagccgggcggcgtccgcctcgtcggctgctgcaacgagctcaacgcggcgtacgcggccgacgggtacgcccgcgcgcgcgccggcggggtcggcgcctgcgccgtcaccttcaccgtcggcggcctcagcgccatcaacggcgtcgccggcgccttcagcgagaacctccccgtcgtgtgcatcgtcggcggacccaacagcaacgactacgggagtaacaggatcctgcaccataccatcggcttgcctgatttcacgcaggagctcaggtgcttccagaacgtcacgtgctatcaggctgtggtgaacaacttggaagatgcgcatgagcagatcgatactgccatctccacggcaatcaaggagagcaagcctgtttacattagcatcagctgcaacctcccttcgatcccacatcccaccttcagccgccatcctgtccctttcttcctctccccaaggctatcgaaccagatgaacctggaggctgcagtggaagccgccgcggctttcttgaacaaagccgtcaagccagtgcttgtaggtgggccaaagatgagggtgtccaaagcatgcgaagccttggcagagctggcagatgcctgcggctatcccgtcgccgtgatgccttctgcgaaggggctagtgccagagcaccactctaggttcattggcacgtactggggtgcggtgagcactccattctgtgctgagatcgtcgagtctgccgatgcctacctatttgctggccccgtattcaacgactacagctcggttgggtactcgctgctcctcaagaaggagaaggccatcattgtccaaccagagcgggtggtggtcgggcatggacccgcgtttgggtgtgttctgatgaaggatttccttcatgcccttgcaacccgtctgaagaagaacactgtcgcgtatgagaactaccgtcgaatttatgtgcctccaggcgaaccactttcatctgaacctggcgagccgttgagagtgaacgtgctcttcaagcatattcaggcaatgctgtccggcgacatggctgtcatcgcagagactggggactcgtggtttaactgccagaagctgaagctaccggaaggatgtggatacgaattccagatgcagtatggatcaattggctggtcagtgggcgcaactctaggatacgcacaggctgccaaggataaacgtgtcattgcctgcattggagacggcagctttcaggtgacggcacaagaagtgtcaacgatgctccggtgggggcacaacagcatcatcttcctgataaacaatggagggtacacaatcgaggtggagattcacgatggcccttataacgttatcaagaactggaactacaccggtctggtggaagcgttccacaatggcgagggcgcgtgctacacagcaaaggttcgaacagaggaggagctgacggaggcgctggaggcagctctaggacctaagaaggactgcttatgcttcatcgaggtcatcgtgcataaggatgacaccagcaaagagcttctcgagtggggatctagggtttctgcggcgaatagccgtccacctaatcctcagtgaatacatcaggtctcccgaattgccctgtaaaccgatccgctttctggtgacgcccataacaagaagtctcggcgatgacatgctgccgatttctgaataaattgtccctgtaattcactgatgttgcaagtccttgttgtaaagatacaaagacgtttggaagaatcactgacaacgtaaactctacgtatcttacgtgaaatagccccgtgatctacatatatataaagcagattttgagagtactagaaaaaaaagcggccctcagtgaaatagccgtacatcaggtcccccgaattgcccggaagaccaacccgttttctggtgaggcccaaaccaaaaagtctcggcaaggacatcctgtcgatttctgaataaattgtccctccaattccctggtgttaaagtccccgttgtaaaggtacaaaaacgtttggaaaaatccctgacagcgtaaactctacgtatcttacgtggaaaaaaaaaaaaaaaaaaccaaaa

SEQ ID NO: 2747 - DNA, 324 bp, Zea mays
  UNSURE (1)..(324): unsure at all n locations
  Clone ID: PAT_MRT4577_81682C.1
  unsure (1)..(324): unsure at all n locations
ttgacccagatggccctgatgccgtgcggctcacctggaacacctggccacggtcaaaggtcgaggccagccgctgcgtcgtgccgctcgccgccaccatctcgcccggtcgcgtcccggacccctccgcggngtccccgccgccgctcccttaccctccgctccgttgcaaggctccctgctccgngctcctcaaccccttcgcgcgcgtcgacttcgccgccaagatctggatctgcccgttctgcttctcccgcaaccacttccccctgcactactctgccatctctgagtccaacgttcctgccgagctctccccgcagt

SEQ ID NO: 2748 - DNA, 411 bp, Zea mays
  Clone ID: PAT_MRT4577_81745C.1
ttatatttttttttttataatttaaaatttttttggagagcaaaaaaaaactgtaataaccaaacagctaaacagctaaaaacaaatgtaaatgttctcttctctggtctgcacttaaggaaaacaaagggtacaacataatgtacatgtacaaaaaagggcgtccttttttgcggaaagcaaaccaggtaattcattatacatacatacaaatatatatgtaaaagttgacgtgaacttccggacttcaaaaaacgttactgtcagtgccaagcagaagcagatataaacttcctgttttataaaccgagcaaaatcgcgccatacttcttttcaagggtgaactagtccaagaagaaagaaaaaagcttccagaaaaccgaattaacatacaaactcaacgggtatggt

SEQ ID NO: 2749 - DNA, 376 bp, Zea mays
  Clone ID: PAT_MRT4577_8178C.1
tgggcacgatgaccggcgaggcctagcacaaggccggctatactacatatgccaccaagcataatgcctgcgagacgactgaggctaccaagcagaaggccgtcgagacgacggaggccgccaggcagaaggcagtcgacgccatggaggcagtcaagcagaatgccgtcgaggccgggcaagtacgccaaggacaccgtcgtctccggcaaggacaagttcggcgacgtcattcaataagccactgatcaggtgaagagcgcggctgcgggcgctaaggacgcagtgatgagcactcttgttatgggcggatacgacaagcagggctacgccaacaccaacaccaaccaagactctctttaccattaccagggga

SEQ ID NO: 2750 - DNA, 398 bp, Zea mays
  UNSURE (1)..(398): unsure at all n locations
  Clone ID: PAT_MRT4577_8184C.1
  unsure (1)..(398): unsure at all n locations
gaaaaaaaagcccgcaggngaagccgccgccgcttttgngnccatagccaccgcaggagactgaganggggggnnnngncaagacccacaggagcaangcatacttcaagcgnnnccaggngaagnncaagagaaggcgcgctggcaagacagactacagggccaggataaggctgattaaccaagacaaaaacaagtccaatacacccaattgcgggggggttgtgcgatttaccaacctggacatcacagcacanatcatctctgctagtctagcaggtgatatggttcttgcttctgcttgctcgcatgagttgccccgttgtggtcttgccgttggtctgtcctgctttgcggcctgccttctgcgctgtccttctgttggctcgccgtgtgct

SEQ ID NO: 2751 - DNA, 685 bp, Zea mays
  UNSURE (1)..(685): unsure at all n locations
  Clone ID: PAT_MRT4577_81870C.1
  unsure (1)..(685): unsure at all n locations
cgggtttctggtgtgcagccagctcccactctatggcatttattcgacgactggagctgatcctttctactggatgcgtgttatcctcgcatcaaaccgtggcactgtgatggagttgggtattactccaattgtgacctctggtatggtaatgcaacttcttgtcggatcgaagatcattgaagttgacaacagtgtgagagaggatcgtgctctgctgaatggtgcacaaaagttgcttggtatcttgatcgctattggggaagctgtggcatatgtcctgtctggaatgtatggcagtgtaagccaacttggaacagggaatgctattctcattatacttcagcttttctttgctggcatcattgtcatctgtttggatgaacttctccagaaaggttatggtttgggatctggtatttctctgttcattgctaccaatatctgtgagaatatcatctggtaagtccgtgctcttcgtgaggctttctaccgccagaaccttccaaatgtgaccaatttgcttgccactgtcttggtattcctcatagttatctatttccaaggcttccgtgttgtgcttccagtgagatcaaagaatgctcgtggccagcaaggctcatatccaattaagctgttctacacttcanacatgcccatcattcttcactctgcgctgattacc

SEQ ID NO: 2752 - DNA, 680 bp, Zea mays
  UNSURE (1)..(680): unsure at all n locations
  Clone ID: PAT_MRT4577_81872C.1
  unsure (1)..(680): unsure at all n locations
ggggacagggtgttcgcatttcatatgctgcagctatgtcgacactgcaaactgcaatgggaaagataaaagaagcgatggctctgctcaggccccctgttgccgtttaacaaaaccaacgtatcgctaatcagttgtggaccaaaggcttctgcaatgcactatcatattaaatacattcagttgacaatctctctcttctcctcgcctcgccttggtgttcacgccgtcgctagcgcctgccgcggcgaagcttctgccctccccggcgccgggctcgggtcgtcgtcggccaggaagatggctggcggcttcagggtactgcatctggtcaggccttttcttgctttcttgccagaggtgcagagcgcggataggaagataccgttcagagaaaaagttatctacactgttatttccctcttcattttcctggtctgcagccagctcccactctatggcattcattcaacaactggagctgatcctttctactggatgcgtgttatcctcgcatcaaaccgtggcactgtgatggagttgngtattactccaattgtgacatctgngatggtaatgcaacttcttgntggatcgaagatatttgaagttgacaacagtgtgagagaggatcgtgctctgctgaatggtgcacaaaaagtgcttggtatcctgattgc

SEQ ID NO: 2753 - DNA, 701 bp, Zea mays
  Clone ID: PAT_MRT4577_81875C.1
aaaaaaaaaacaaaaaaaaaaaaaaaaaaagaaattgcatcttgtttaccagagtcgcatgtcagaaacttggagtctttgctgtcatacggttatatttatatgagacttctatcggtaaaaaaaaaaaaaaaaaaaaaaaaaaaaaaaaaaaaaaaaatctcttttttctcctcgcctcgccttggtgttcacgccgtcgttagcgcctgcggcctgccgcggcaaagcttttgccctccccggcgccgggctcgggtcgtcgtcggccagaaaaatggctggcggcttcagggtactgcatctggtcaggccttttctggctttcttgccaaaggtgcaaagcgcggataggaagataccgttcaaagaaaaagttatctacactgttatttccctcttaattttcctggtctgcagccagctcccactctatggcattcattcaacaactggagctgatcctttctactggatgcgtgttatcctcgcataaaaccgtggcactgtgatggagttgggtattactccaattgtgacatctgggatggtaatgcaacttcttgttggatcgaagatcattgaagttgacaacagtgtgagagaggatcgtgctctgctgaatggtgcacaaaagttgcttggtatcctgattgctattggggaagctgtggcatatgtcctgtctgaaatgtatggca

SEQ ID NO: 2754 - DNA, 2031 bp, Zea mays
  Clone ID: PAT_MRT4577_81878C.1
cctcgaggccggccgggccggggctagagtgacagttgcgagaacgctactgtacgaacaaataggatagggatgtgaaatgatctaggaccgcgggtttattttgacaaactacaagggattctttgtatctctctcctctcatctccacctctcctccggctagggtgttcacgcctgccgcggcgaagcttctgccctccccggcgtcgcgctctggtcgtcgtcggccgggaagatggctggcggcttcagggtacttcatctggtcaggccctttctggctttcttgccagaggtgcagagcgcggataggaagataccattcagagaaaaagttatctacactgttatttctctcttcatttttctggtgtgcagccagctcccactctatggcattcattcgacgactggagctgatcctttctactggatgcgtgttatccttgcatcaaaccgtggcactgtgatggagttgggtattactccaattgtgacctctggtatggtaatgcaacttcttgtcggatcgaagatcattgaagttgacaacagtgtgagagaggatcgtgctctgctgaatggtgcacaaaagttgcttggtatcttgatcgctattggggaagctgtggcatatgtcctgtctggaatgtatggtagtgtaagccaacttggaacagggaatgctattctcattatacttcagcttttctttgctggcatcattgtcatctgtttggatgaacttctccagaaaggttatggtttgggatctggtatttctctgttcattgctaccaatatctgtgagaatatcatctggaaggcatttagccccacaaccatcaacagtggtcgtggcgctgaattcgaaggggctgtcattgcactgttccatctgttgattacgagaaccgataaagtccgtgctcttcgtgaggctttctaccgccagaaccttccaaatgtgaccaatttgcttgccactgtcttggtattcctcatagttatctatttccaaggcttccgtgttgtgcttccagtgagatcaaagaatgctcgtggccagcaaggctcatatccaattaagctgttctacacttcaaacatgcccatcatccttcactctgcgctgattaccaacctctattttatatcccagcttctctacaggaagtacagtggaaacttccttgttaaccttcttgggaagtggaaggagtctgaatactctggccattctattcctgttggtggtcttgcttactatgtaactgccccatcaagtttggctgatgtccttgcaaatccattccatgcactgttttatgtggtcttcatgctgtcagcctgtgctctgttctcaaagacatggattgaagtttccggttcatcagcaaaggatgttgctaagcagctcaaggaacaacaaatggtgatgccaggccatcgtgagtcgaacttgcagaaggaacttaaccgatacatccccactgctgctgcatttggtggtgtatgcattggcgcattgaccgtcctggctgatttcatgggtgcgattggttcaggaactggtatattgctcgctgtgacaatcatataccaatacttcgaaacctttgagaaggaaagggcgactgagcttggtttctttggtttttgattagtagctgtggaaccttaacttggctatagctgaattttcttgtaagtccctgtagtgcttagccagttgtaacttaaagagttctgtttaggttgccttcttgcggccacaatcatgtagcagaatgtgcgtgtgtttcaggttagcgtgggggtatgtgcatctgtccaaagagagtctgcaatttggcaaccggatattttgttatcaatttcagttacttcgaactgagcatgttctcattcccactttctgtttcggtctgttactaatttctcagaacattagatgctcacaggcgctttattctaatgtctctatttcatgacgagatatgaacatctctgaatctgattgcttca

SEQ ID NO: 2755 - DNA, 2648 bp, Zea mays
  UNSURE (1)..(2648): unsure at all n locations
  Clone ID: PAT_MRT4577_81879C.1
  unsure (1)..(2648): unsure at all n locations
gccggccgggccgggagctccgcctcccttaaacccaccgctgttcgcgtcctcgtttctctcaatctctctcttctcctcgcctcgccttggtgttcacgccgtcgctagcgcctgcggcctgccgcggcgaagcttctgccctccccggcgccgggctcgggtcgtcgtcggccaggaagatggctggcggcttcagggtactgcatctggtcaggccttttctggctttcttgccagaggtgcagagcgcggataggaagataccgttcagagaaaaagttatctacactgttatttccctcttcattttcctggtctgcagccagctcccactctatggcattcattcaacaactggagctgatcctttctactggatgcgtgttatcctcgcatcaaaccgtggcactgtgatggagttgggtattactccaattgtgacatctgggatggtaatgcaacttcttgttggatcgaagatcattgaagttgacaacagtgtgagagaggatcgtgctctgctgaatggtgcacaaaagttgcttggtatcctgattgctattggggaagctgtggcatatgtcctgtctggaatgtatggcagtgtaagccaacttggaacagggaatgctatcctcattatacttcagcttttctttgctggcatcattgtcatctgtctggatgaacttctccagaaaggttatggcttgggatctggcatttctctgttcattgctaccaatatctgcgagaatatcatctggaaggcatttagccccacaaccatcaacagtggtcgtggtgctgaatttgaaggggctgtcattgcactgtttcatctgttgattacgagaaccgataaagtccgtgctcttcgtgaggctttctaccgccagaaccttccaaatgtgaccaatttgcttgccacagtcttggtcttcctcatagttatctatttccaaggcttccgtgttgtgcttccagtgagatcaaagaatgctcgtggccagcaaggctcatatccaattaagctattctacacttcaaacatgcccatcattctgcactctgcactgattaccaacctctatttcatatcccagcttctctacaggaagtacagtggaaacttccttgttaaccttcttgggatgtggaaggagtctgaatactctggccattctgttcctgttggtggtcttgcttactatgtaactgccccatcaagtttggctgatgtccttgcaaatccattccatgcactgttttatgtggtcttcatgctgtcagcttgcgctctgttctcaaaaacgtggattgaagtttctggttcatcagcaaaggatgttgctaagcagctcaaggaacaacaaatggtgatgccaggacatcgtgagtcaaacttgcagaaggaactgaaccgatacatccccactgctgctgcatttggtggagtatgcatcggcgcattgactgtcctggctgatttcatgggtgcaattggttcaggaactggaatactgctggctgtgacaatcatataccaatacttcgaaaccttcgagaaggaaagggcaacggagcttggtttctttggtttttgattagtagctgtggaaccttgaaccgatagctgaattttcttgtaaggccctgtttggaagcaacccggttttttagaaaccagtttttatattttagctaggagaggccagcttcttggtttttaagaaactgagaatctaatttctataaacttagtcataaactagtatgtttggaaccacctcaatttctataaaccagtttcttaaaaactgggtgtttccaaacagggcctaagtcactgtagtgcttagccagttgtaacttaagagagttctgttaggttgccttgtggccacaatcatgtagcagaatctgtccaaagagcgtgctcatcccatccacaatcagtaatccgcactctacagtttgctcataggttaccctggcaactggatgttctgtgttcaatttcagttacttttgaactgtaaggtctgttattactagtttcccagaacttagatgctcacgtgcgctttatttcaatatctattttgtgatgttgcatgattatctctgaatctgattgcttgtttgctaacagaccttacaatggnacttttttgttacattgcatgctgcattactgaagcaatatattttgctactgttacaatatgtgtgttcaatcccctccatggggtgcgacagtttctccccaagggacgcaccccttggggaggcactagttcgcctgtatatataagcattgtcttacttgcaataaagacaactgtcattctgtctctgtcatttgcacaatctctcagtctcgttaccactaccctctaacaatcagataacatttatggtaccatcagatggagccgtattattatcttcgtcagccacaaccctttggtcattcccgtaaacatacctggaggcgaagaagacctatactaatagcgacacccagctcaagaactgctagcaaccaataaaatcggccaagtttccccttgttcaagttggacccatcaagccaacctcctgtgccatcgcagagtcttggaactcggtttgccacttga

SEQ ID NO: 2756 - DNA, 2176 bp, Zea mays
  UNSURE (1)..(2176): unsure at all n locations
  Clone ID: PAT_MRT4577_81883C.1
  unsure (1)..(2176): unsure at all n locations
tgcagtgagctcatctgcgtcgtcggttggttgttggtcggtcggcagatcagagtgaagaggtgcagtttattaatgttgattttggtggacaaggattacgaggggatgtatgtgggaaatttcccttactatgtacattgaatagcaagaaaaaaaaaaaaaattctctcatctccacctctcctccggctagggtgttcacgcctgccgcggcgaagcttctgccctccccggcgtcgcgctctggtcgtcgtcggccgggaagatggctggcggcttcagggtacttcatctggtcaggccctttctggctttcttgccagaggtgcagagcgcggataggaagataccattcagagaaaaagttatctacactgttatttctctcttcatttttctggtgtgcagccagctcccactctatggcattcattcaacgactggagctgatcctttctactggatgcgtgttatcctcgcatcaaaccgtggcactgtgatggagttgggtattactccaattgtgacctctggtatggtaatgcaacttcttgtcggatcgaagatcatttgaagttgacaacagtgtgcagagaggatcgtgctctgctgaatggtgcacaaaagttgcttggtatcttgatcgctattgggggaagctgtggcatatgtcctgtctggaatgtatggcagtgtaagccaacttggaacagggaatgctattctcattatacttcagcttttctttgctggcatcattgtcatctgtttggatgaacttctccagaaaggntaatggtttgggatctgggtatttctctgttcattgctaccaatatctgtgagaattcatctggaaggcatttagccccacaaccatcaacagtggtcgtggtgctgaattcgaaggggctgtcattgcactgttccatctgttgattacgagaaccgataaagtccgtgctcttcgtgaggctttctaccgccagaaccttccaaatgtgaccaatttgcttgccactgtcttggtattcctcatagttatctatttccaaggcttccgtgttgtgcttccagtgagatcaaagaatgctcgtggccagcaaggctcatatccaattaagctgttctacacttcaaacatgcccatcattcttcactctgcgctgattaccaacctctattttatatcccagcttctctacaggaagtacagtggaaacttccttgttaaccttcttgggaagtggaaggagtctgaatactctggccattctattcctgttggtggtcttgcttactatgtaactgccccatcaaggtgaaaatctagttccttcagtggggactggggaggccttctcgccatgatcatttttgttgtttttgttattcaataattaggtattcttttgactaacaatagcacattggaaaccacacagtttggctgatgtccttgcaaatccattccatgcactgttttatgtggtcttcatgctgtcagcctgtgctctgttctcaaagacatggattgaagtttctggttcatcagcaaaggatgttgctaagcagctcaaggaacaacaaatggtgatgccaggccatcgtgagtcgaacttgcagaaggaacttaaccgatacatccccatttgttgttccttgagctgcttagcaacaaatggtgatgccaggccatcgtgagtcgaacttgcagaaggaacttaaccgatacatccccactgctgctgcatttggtggtgtatgcattggcgcattgaccgtcctggctgatttcatgggtgcgattggttcaggaactggtatattgctcgctgtgacaatcatataccaatacttcgaaacctttgagaaggaaagggcgactgagcttggtttctttggtttttgattagtagctgtggaaccttaacttggctatagctgaattttcttgtaagtccctgtagtgcttagccagttgtaacttaaagagttctgtttaggttgccttcttgcggccacaatcatgtagcagaatgtgcgtgtgtttcaggttagcgtgggggtatgtgcatctgtccaaagagagtctgcaatttggcaaccggatattttgttatcaatttcagttacttcgaactgagcatgttctcattcaaaaaaaaaaaaa

SEQ ID NO: 2757 - DNA, 162 bp, Zea mays
  UNSURE (1)..(162): unsure at all n locations
  Clone ID: PAT_MRT4577_81890C.1
  unsure (1)..(162): unsure at all n locations
gtgggattgtgggaagatgcctccncatggggcgcgggcagaccctcctccggagcgcgtcnagatggacgaggtggtagaagcggacccggatacggaggcggaggatcacgaggagaggtgggcgaagctgcttccagagctgctctaccacatggtgcg

SEQ ID NO: 2758 - DNA, 403 bp, Zea mays
  Clone ID: PAT_MRT4577_81929C.1
atctcttttgttactttattttttttttttttttttttttttttttttaaaaaatggactttcttatttctgggaagccccaaacatcaaacaaaaaacttttttattgaactataactcataaaaaatctaaaagagggcccccccaataatgggttgttggtaaaacccttctgggtttgtcaaaacaagttggttgaatggcaccaattgttgcagttgtaaaagggtgccaccgttaggcccaacgtgctggtaaaacggcaaccactgtgggtgtttcaaaaagggagcagggctcacaccacctaactggctaaaagggaataattgttgctgctggaaataaacaggaaaattcaatgcttccccttggttgaatggaaaaaattgctgggggtag

SEQ ID NO: 2759 - DNA, 308 bp, Zea mays
  Clone ID: PAT_MRT4577_81979C.1
gtttcattgattcttgaaatagacgagcttcttttgcaccacaaggtcgaggatgtcttgcaactgcggatcaagctgcggctgcggctcaagctgcaagtgcggcaagtaagtaccctgacctggaagagacgagcaccgccgcgcaggccaccgacatcctcggcgtggacccggagaagaggccgtgcccgatttcatttaggccacggtggtatccaaccgaggacgtccacggctgcatctgtaacggcaactgcaaagtcgaccactgcaactactgatcacattataactacaaccatgga

SEQ ID NO: 2760 - DNA, 321 bp, Zea mays
  Clone ID: PAT_MRT4577_81984C.1
ttcttatcgatctgcaagtctcgctacgtagcagtgcaataaaaaaagcagccgcaatggcgagcagcaccatggccctctcctccacggccttcgccggcaaggccgtgaacgtgccgtcttcgtccgccttcggcgaggcccgcgtgacgttgcgctagactgcggctaaggccaagcctgcggcggcttccgggagcccgtggtactgcccccaccgcgtgctgtacctgggcccactgtccggcgtgccggcgtgctacctgaccggcgtgttccgggtcgactacggctggaacagcccagggctgacggttgacc

SEQ ID NO: 2761 - DNA, 421 bp, Zea mays
  Clone ID: PAT_MRT4577_82033C.1
gacccacgcgtcccctgaggcatcaataacttccagtctgctgcttactccaactgcgcgaaaaacccatcctagaatgcctttttgcttcctcatatctactactttaccatttcttttctgacactttgattctcaccaatctctctggcctgctgcttcctgataatctaccacgtccccattcttgctccttgcactcctccctacatctgcaacattgtgttctcattcaccctctccaatgcctgttctttcttctgctgatgcttcccccgtctcacctatcagctttgaagactattacaaacgccttgacatcacattctctgatgcacctgcctttgtggaccctcatgggcgtacttcgcgtgccctctccacagcccatattgactctcttctagatctcgcacagagc

SEQ ID NO: 2762 - DNA, 707 bp, Zea mays
  UNSURE (1)..(707): unsure at all n locations
  Clone ID: PAT_MRT4577_82069C.1
  unsure (1)..(707): unsure at all n locations
tttgctggtatgtgttgtttcttgaaatatttaccgccttctctttttatgggaaaccctcattggacctacagataccaatagttgtacctttgtgtggtaaaatgtattttatataagtgaccatgtgcacttttttgctatcaccaaatggtgaaatactactgattgtttatgttcttttggttgctgttatattctaaacaaaccaccttgtacttgaaatattcctgtagaataatcttagatcttgctgttgtttttccacgtgtctttctttaactttattaagaactcctaaaaaactcgacccttgtattaataactctatttatcttagctgtgtgtcttgaaccggaagggcgggcctggcgcagcggtagagcctaccgtctgtaaccggaaggtcccgtgttcgagccccagcctctgcatattacgcgggtaaggcttggcgcttaaagataccctttcccagaccccgcacagtgcgggaagcctacgacactgngtacgccctttgtgtgtcttgaactaaatggattttcttcccaagtggaaacaaaaagggatcttatggatggaccttaaagaagtatgtgtttctatcttaagataacagatgatgcatggatgaaccttaaatatgtgctaatgcaatatcagatgatacaaggaagaaccttgaaagtagtatgtgtttctac

SEQ ID NO: 2763 - DNA, 275 bp, Zea mays
  Clone ID: PAT_MRT4577_82076C.1
gtgagccctgctaccttcttgatacaaccacagttgttgccgttctaccagcgggcggggcctaacgctgtcacggctgttacaactgcaacaattgctgccattcaaccaacttgctttgacaaacccagcagcgttctaccaacatcccatcattgttggtgcccttttttagattacttatgagtaatagtacaataatatagttgcttgtctgatgtatgaggctttccagaaatatgaaagtacatttgtagataatgctgaaataagga

SEQ ID NO: 2764 - DNA, 393 bp, Zea mays
  UNSURE (1)..(393): unsure at all n locations
  Clone ID: PAT_MRT4577_8212C.1
  unsure (1)..(393): unsure at all n locations
ggtgggttggcttctcctccccctccggttcgggttcgggttcgtgaggttctccggggttcgggttcgagggtgagcggatcgagatggcggcgtcggatgttgagtaccgcttcttcatcnacnncctcacctaaaccacggaccaccactccctccacagcgccttcaggcaccgaccgcaaagncctcnantccaaaatcatcctccatctttaaacccataagtcccacggcttctgcttcttcaccttcttcacggaggaggcgatgcggaacgccatcgatggcatgaacggcaaggagctggacggcccgaacatcaccgtcaacgaggcccagtcccgcggcggccgttgaggcggcggcagtgggaactgtgggtggccgtgg

SEQ ID NO: 2765 - DNA, 283 bp, Zea mays
  UNSURE (1)..(283): unsure at all n locations
  Clone ID: PAT_MRT4577_82255C.1
  unsure (1)..(283): unsure at all n locations
cggntacatgcggnatgtacagntgtgtgatgaaggaacaatatcttcaagctttttcccattgaatatgtctatggcgacaaagtggcntttggcgtggccatgcttaccagtcttgttttttgaaacctccacaaccttgctggggcgggtcttgntgacgatgaagccgttcttacggncggtgccngcctgctgcgggttggtcttggncgccccngcgtcggccttcngttcgggtggtgctcgtgcgngtccgncntggcgttccttgtcttggttg

SEQ ID NO: 2766 - DNA, 3067 bp, Zea mays
  Clone ID: PAT_MRT4577_82317C.1
ccgtgcggtataatctaggcactgaacagcggtgcatgctttgctttgccgtgctaatggcgcccgctccatgtggccgttcgtcgcagagggtgttccacttcggcaagggcaagagcgagggcaacaagaacatgaaggagctgctgggcggcaagggcgcgaacctggcggagatggcgagcatcgggctgtcggtgccgccggggttcacggtgtcgacggaggcgtgccagcagtaccaggaggccgggcgcgccctcccgccggggctctgggcggaggtcctcgacggcctgcggtgggtggaggagtacatgggcgccgccctcggcgacccgcggcgcccgctcctgctctccgtccgctccggcgccgcggtgtccatgcccgggatgatggacacggtgctcaacctggggctcaacgaccaagtggccgccgggctggcggccaagagcggggaccgcttcgcctacgactccttccgccgcttcctcgacatgttcggcaacgtcgtgatggacatcccccacgcgctgttcgaagagaagcttgaagccatgaagaaagccaaggggctgaagaacgacaccgacctcaccgccaccgacctcaaagagctggtgggccagtacaaggacgtctacgtggaggctaagggagagccattcccctcagaccccaagaggcagctggagttggcagtgctggccgtgttcgactcgtgggagagcccgagggcaaagaagtacaggagcatcaaccagatcaccggcctcaggggcaccgccgtgaacgtgcagtgcatggtgttcggcaacatggggaacacctctggcaccggcgtgctcttcactaggaaccccaacaccggagagaagaagctgtacggcgagttcctggtgaatgctcagggcgaggatgtggttgctggaatcagaaccccggaggatcttgatgccatgaaggacgttatgccacaggcctacaaagagctagtcgagaactgcaggatactggagagccactataaagaaatgcaggacatcgaatttactgttcaggagagcaggctgtggatgttgcagtgcaggacagggaaacgtacgggcaaaagcgccgtaaagatcgccgtggacatggttaacgagggccttgttgagcgccgtgcggcgatcaagatggtagagccaggccacctggaccagcttctccatcctcagtttgagaacccatcggcgtacaaggaccaagtcattgccacgggcctaccggcgtcacctggggccgctgtgggccaggttgtattcactgctgaggacgctgaaacatggcattcccaagggaaatcagttattctggtgagggcggagaccagccctgaggacgtcggcggcatgcacgcggctgcaggaatcctcacagaaagaggtggcatgacctcccatgccgccgtggtcgcacgcgggtggggaaaatgctgtgtctcgggatgctctgggattcgtgtaaatgacgcagagaaggttgtgaagattggaggcaatgtgctgcgcgaaggtgagtggctatcgctgaatggatcgaccggcgaagtgatcctcggaaagcagccgctctccccaccagccctcagtggcgatctgggaacattcatgtcctgggtggatgacgttagaaagctcaaggtcctggcaaacgcggatacccctgaggatgcattggctgcgcggaacaacggggcagaaggaatcgggttatgccggacagagcacatgttcttcgcttcggatgagaggattaaggctgtgaggcagatgattatggctcccacagttgagctgaggcagcaggcgctggatcgccttctgccttaccagaggtctgacttcgaaggcattttccgtgctatggatggactttcagtgactattcgacttctggaccctcccctccacgaggttccttccagaagggaacgtcgaggaaatcgtgcgtgaactgtgttctgagacgggagccaaccaggaggatgccctcgcacggatcgaaaagctttcggaagtaaacccgatgcttggcttccgtggctgcaggcttggtatatcgtaccctgagctaacagaaatgcaagcccgtgccatctttgaagctgctatagcgatgaccaaccagggcgttcaagtctttccagagataatggttcctcttgttggaacaccgcaggaattgggacatcaggtggcccttatccgtcaagtcgctaacaaagttttcaccagtatgggtaaaactattgggtacaagatcggaacgatgattgagattcccagggcagctctagtggctgacgagatcgcggagcaggctgaattcttctcctttggaacgaacgacctcacgcagatgacctttggctacagcagggatgatgtggggaagttcatccccatttatctggctcagggcatcctccagcatgaccccttcgaggttctcgaccagagaggagtgggcgagctggttaagcttgctacagagaggggccgcaaagctaggcctaacttgaaggtgggcatttgtggagaacatggtggagagccttcatcggttgctttcttcgccaagactgggctggattacgtttcttgctcccctttcagggtcccgatcgctaggctagctgcagctcaggtgcttgtctgaggggctgcctcctcgttggcagccggatcgcctgctgttggtgcatctggtgattaataatactactatgacagagccatatgctctgtgaagagtattagtagcagcgctcataaaagctacagttccatctattttctcagctatgtaaaacttccaaactgttcatgcttaaaactgagggttttcgtggtgtgagatgtgcatgtcgttgttgaggccattgctgcacattccacctattgaggccctcctcaaattaagcctcgaaaaagctgatatcttttcgtagaactctagactccggtgaatgcaactggctggtttgcttccgaggcaaaaaaaaaaaaaaaaaaaa

SEQ ID NO: 2767 - DNA, 132 bp, Zea mays
  Clone ID: PAT_MRT4577_82627C.1
gcttctaaggatctcaaagtaaagcgtatcactccgcgtcacttgcagcttgcaatccgtggtgatgaagagttggattctcttatcaaggctaccatagctgggggtggtgtgatccctcacatccacaaa

SEQ ID NO: 2768 - DNA, 292 bp, Zea mays
  Clone ID: PAT_MRT4577_82701C.1
cccacgcgtccgcggacgcgtgggcctttttttcctctctctactctccaagttctcgtggggcgtcgaccgctctacacgtgggttgccaacctggacaccgaagtggaagaaggaagcagtcagcatatggattcatggatcagcagccagccttctgtgagccttgacctgtgcgtgggccttgccccgttcagacttcaccaccaggcgccggtggccgtcttctttcccaggcccaagctgcttgtcgaggagaactttctcctgccgccttcaaagaaagaaccat

SEQ ID NO: 2769 - DNA, 340 bp, Zea mays
  Clone ID: PAT_MRT4577_82704C.1
tacaacacctatagtgagtcgtattaagtggatcggagacacacgattcgcggaaggacgaggaagtccgatctgccctcgtgtcgcagagctcgacgaacaatgtcgcggagacgccgtggatgcgcatacgagtccttcacacgggagctccgggacaccttccagggctttcacttcggatctggaggcaggagtagcagcagccagtgctgctcgttcggtggcagcaccagctatgagacagcggtcttctctgggattcgtgtagaagggaacgagacgactgaagcgcgaggttgcaagagtgacgtgccggggctgaagtagggagatgtgg

SEQ ID NO: 2770 - DNA, 557 bp, Zea mays
  Clone ID: PAT_MRT4577_82761C.1
accaactgaatagtcacagaaaattccgtttgcgcaaacctagagctacctccgccgccgccgccggcaatcaagacagctgatggatcctatgcagtcatcggtgagaggccgcaggtcttcgttgcatgctgatgctgtcataactattggaggagtccgacctgcaccacccccacaaacatccacacatgtatgtcaagatgaggcgatggtcagcagcggggatccctcctggatgtctggttacaggagtgtggaagagagcagggtcaactggagggaacaatggaggtggtggagcgatgccctgtgcggcgccaaggctctgcatgtactggaacatctccgccatcctctgatgatctgcccggcgctccgcctcccgctccgccatcatcctcgcctccatctcgtgacgttccctcctctcttcttctagttgggtctgtaatattacaagtcaatgttatagtaactcaaagagaaggtatataactcaaggaaggacgagttacagaagcactaacctcgagttgtcaaacattaattaattt

SEQ ID NO: 2771 - DNA, 223 bp, Zea mays
  Clone ID: PAT_MRT4577_82965C.1
atgaattacattgaggaggaccttgtttccaccgattaccagggtgacagcaggtctagcatcggggagggtaatgttgggagtggcgggaacggtatcttcatgaaaattgtgtcctggtactacaactagtggggatacagcacccgcgtggtcaaactgattcgtcacatgaacagtaccaactaagaagaagaacttatagtaagggctggtgatacga

SEQ ID NO: 2772 - DNA, 508 bp, Zea mays
  Clone ID: PAT_MRT4577_82975C.1
ccggccgggagtcaacaggaatcggagaggaggttggtcaggtgattcaattctcgtaccatcacgctgctctggagtaccgcctccgccccataattcaccagcgtggtgctacgcatatttcccatcgtcttctccctagcgccatcagattccgcatgccagtgtggaccatgatctccccggacaccatccgcagggccatcggagcgatcggcaatggaactgcactcgtgatcttcctctcgcgagtgactacgttcatacacatgtggaagaaagggtcggtggagtacaactcgccgatcccgaacgagccgacagtgcagaactgcatgatgtaggtgctgtacgggatgccggcggtgcacctgcacagcatggtggtgatcactatcaacggcaccggcatggtgatccaaatgacctacgtggtgctcttcctcctctactaagcattggcagatctgagcaatgagttcctgctgctgcacgccgaggtgggctt

SEQ ID NO: 2773 - DNA, 768 bp, Zea mays
  UNSURE (1)..(768): unsure at all n locations
  Clone ID: PAT_MRT4577_83132C.1
  unsure (1)..(768): unsure at all n locations
acgacgactcggagctgctcgcgctcatcaatgccnccgaggacgagacccccacgcgtccgaagatcatctccgaggtgacaggcatgagcttccttgtctgcgacgtcggcggcatgatcgccgggaataagcgtaagcacgcggcggcgcggatgtactcgccgccgctgagcccgagcggcgtgatcggcgcgctgtcctgcttcagctgcgagagctcgttgtccgccacagcggactcgcgcaccctcgctactacggctgcgggggtcggcccgtgggcaccgtcagcgcccgtgtccgtgtcgtcttcccctgagcccccaggtcgggcccccaagcgcgctgcggcggcgggggtcccgcatccgcttccccccgacgaggagagccgcgacgcctggccgtccacctgcgccgcgtgacgcaccgtgccggaacggtgcctatggcgagatcccccgctcaggtagtcaggtggcggtggggatataaaggagcatcagaatctcgcgccggtgacgagaacgaaccattttgcccattgccgcgagagatggggggctagattgcaagaagaaaaggatgtaatgtctgcatgctcatgtatggcagcacattttgcaatgatggttctcgatcgtaactgttgggggggatcgtaactgttcggctggctacaagccgacactgttgcagctgtttggactgctgcagctgcaatccatagagagaaaatactgtagaagccgcagccgcagccgg

SEQ ID NO: 2774 - DNA, 371 bp, Zea mays
  Clone ID: PAT_MRT4577_83176C.1
aaaaaattataattttggggcacaaccaaaaagcaccattttttccttaggaggaaccaaaaacaaaccctgacgggaggaacagcatccatcgacccacagtccatgcgggttgaggcatgggcccgcgggaccccgggaggaacccagcactaacaacggacaaagagggaccttgctttcaaaaacacggaggggggacaccaaacgagacgaacgaagataacccctctggacaaggggaaacatcacggaagcgaacaggataactgggccgggcgggccccaccgatcagttcctccagatcccgccggagtggccgtagccgccgccacggggggcaccgccgtagccgccaccaccaccaccg

SEQ ID NO: 2775 - DNA, 318 bp, Zea mays
  UNSURE (1)..(318): unsure at all n locations
  Clone ID: PAT_MRT4577_83422C.1
  unsure (1)..(318): unsure at all n locations
cggcaacacagaaagcacaagagcgcaccaacaagggcagccaaanaagggggggcgttatgctccttggtcatactgcaagtgctgctaccgcgaccatttcccgcaatgctacaagctcctaagcgttccttgttgcccggacctattaccagcggagtcttcggaatgtgaaaacccaattcttcaaccctataggatccaacaggcaatcggagctgtcatcttacccttatcacccttggtcctacaacaatcatcagccctattacagcagttagccttgggggcatttattggcacaaaacattagggcac

SEQ ID NO: 2776 - DNA, 1585 bp, Zea mays
  Clone ID: PAT_MRT4577_83725C.1
ggcgattgggtctcccgaggccggccgggaggcggcaacgcaacacccccccgtgctttattataacccagcggcccctcccgcatcaggcaaccgagacgggacgagtccagcagccggccaccagcccatccgaaccctgctgcccccctctccgggttcgcgtgaggctgtgtgctgctgggaggagaggggaagcggcggcggggcgccatggaggccgagaagaaggcgccggcggtgtcagacgtgggcgcgtgggcgatgaacgtcgtcagctccgtcagcctcatcatggccaacaagcagctcatgtcctcctccggctacgccttcgccttcgccaccacgctgaccgggttccacttcacggtcacggcgctcgtcgggtggatctccaacgccaccggctactccgtctccaagcacgtcccgctctgggagctcgtctggttctctctcgtcgcaaacacctccatcaccgggatgaacctcagcctcatgctcaactccgtcggcttctaccagatctccaaactgagcatgattccggtggtctgcctcatggaatgggtgctgaacagcaagcactacaccaccaaggtcatctcggcagtggttgtcgtggccgccggtgtcgggatttgcacggtcacggatgtcgaggtcaatgccaaggggttcatctgcgcttgcgtggcagtgttctgcacgtcgcttcaacagattacaattggttcctttcaaaagaagtacaacattgggtcatttgagctgctgagcaaaactgcaccaatccaggcaatttcactcattatactgggcccctttgtggactactatctaaatggacggtcattgttgaactaccctttttcgggaggggcaactttcttcatcttgctttcctgctccctggccgtcttctgcaacatgagccaatacctctgcatcggccggttctcagcgacctcgtttcaggtcctgggccacatgaagaccgtgtgtgtgctgatcctcggctggatcctgtttgactcggccctcaccgtgaagaacatcctcgggatgctgctcgccgtgatgggcatggtggtctacagctgggccatggaagcggagaagaaggcggcagcccctgtcccccggatcaagagcgaaatgctcgacggcgaggacgtacccctcaaggccagggtgagcggcgtgcccgcggtcgacctcgaggacggcgagatgaagagctagctgccgccgccgccgctgattcgttcattcttcttgttcttttgtaactgtgcgcgcgcgatcgctcgatccaaagttgcttgtccgtcagccctcagctatcgacactacactgttaattttggccccttgttggggagagtccagttcctaggtgacgacgaccacccccagttcggcgtagatcaaacacacactagcagaatgcagatttttaggatttttttcaggcggcggggtgatccattcattgtcatgttgacaagactcataatagaaatacaggtaacatatgtatcctccgtggtaggattgataaggaatcatttatccaaaa

SEQ ID NO: 2777 - DNA, 1959 bp, Zea mays
  UNSURE (1)..(1959): unsure at all n locations
  Clone ID: PAT_MRT4577_83726C.1
  unsure (1)..(1959): unsure at all n locations
ggtaccctccttgggcacgagaagctgcaggggaaatgcaccatgcagcgcggctcggccccagcccccagatccaggcacgcaaccgagccgcggcccggctgcgcccttgtcgtcgccgcaccgtccgtccccgcccgcgtcaatccgtcgtcgtcgtcgtctcctcgtcaccccgcgagcttttttcaccgctgccctgccctgcccccgcgcccgttgacgtttccggcccccaattcgaaagcctcgcgctccccgttgctcccttccttgcctaggcggcaacgccctcgtgctttataacccagcggcccctcccgcgtgaggcaaccgagacgggaggagaccagcagcagcagcccatccgaaccccgcctcctcctcctcctcccgggttcgcgtgaggctgtgtgctgctgggaggcggcgccggcgccggcgccatggaggcggagaagaagccgccggcggtgtccgacgtgggcgcgtgggcgatgaacgtcgtcagctccgtcagcctcatcatggccaacaagcagctcatgtcctcctccggctacgccttcgccttcgccaccacgctcaccgggttccacttcaccgtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggattctaccagatctccaaactgagcatgattccggtggtctgcctcatggaatgggtgctcaacagcaagcactacaccactaaggtcatatccgcagtcatcgtcgtggccgccggtgtcgggatttgtactgtcacggatgtcgaggtcaatgccaaggggttcatctgcgcttgcgtggcagtgttctgcacgtcgcttcaacagattacaattggctcctttcagaagaagtacaacattggatcatttgagctgctgagcaaaactgcgccaattcaggcactttcactcattatactgggcccctttgtggactactatctaaatggacggtcattgttgaactaccctttttcaggaggggcaactttcttcatactgctttcctgctccctggcggtgttctgcaacatgagccaatacctctgcatcgggcggttctcagcgacctcgttccaggtcctgggccacatgaagaccgtgtgcgtgctgatcctgggctggatcctgtttgactcggccctcaccgtgaagaacatcctcgggatgctgctcgccgtgatgggcatggtggtctacagctgggccgtggaagcggagaagaaggcggcagccccgatcccccggaacaagggcggcatgctcgacggcgaggacgtgcccctcaaggccagggtgagcggcgtgcccgcggtcgacctcgaggacggcgacgtgaagggctagccgctgatccgttcattcttctcgttcttttgtaactgtgcgcgcgcggtcgctcgatgcaaagttgcttgttcgtcggttctcagctatcgacactacactgttaattttgttggccccttgttggggggagtctgctcgtaggtgaccccccccccccctcccccgggttcgacgtagatgaaacacacgcgggcagattgttaggatttttcaggcggggaggtggcgacatgctgttatagatggtgacaagactttatataatggaaatgcaggtgtttttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattattaataaaaaaaaaaaaaataaaaaaaaaaaaaaaataaaaaaaaaaaaaaaaaannnntnnattnaaaaaaaaa

SEQ ID NO: 2778 - DNA, 272 bp, Zea mays
  Clone ID: PAT_MRT4577_83846C.1
ccccacctaaacaatgagtgttcctggccagcagcctgatttttataattacatatgtgtccaacgtaagggtcagggcatcccatgagggcatacatacatatttggcgtacatacccatcacatgcctggatatttacatttgtccaatggaggcgttagggccccccatgagggtatacatacatattttgcgtacttacacacttaacatgactggagaatcttgcagagattttttatctcagccaaaatcaggaacgatgaagtag

SEQ ID NO: 2779 - DNA, 679 bp, Zea mays
  Clone ID: PAT_MRT4577_83935C.1
cacgctttccctcctctcacttcggattctgctctgccttcgcctctcgcctcgtcactacccacgccactgcatagaccgagaaaaaggacgaattttttcctcgccgcaacctcacaccatggaagaggcgatgccgccgccgccgccgccgctctcatcttcctcctccgccgccgtggcctgagctctcccatcgctcgctctctccatcgggcctacctatcctagcagtgaataagtcatggcagctttcgccgcgttgttcgaccccctctactgcccggaggagcacctcgatctgtaccacgaaggacccgtcgaggttgtggacgagcagtggcaggaccagcgcggacagcagcaaccggcggctcttgacgacgagctgccggcgctgttcgaggcgctccgggacaaggagggggtggtgctggcgggtgatggggaggaggatgggtacggcggctcggcaggccgggaggccgcagtcggctgggcgtcacgcgccgcggcacggctgggcttctctgcgctcacttccgcgctgtccgccgcctacctggaccgctgcttcctccccgggggcgcgctccgtctcggcgaccagccctggatgtcgcgcctcgccgccgtcgcctgtgtcgcgctcgccgccaaggtcgaggaaacgcgcgtg

SEQ ID NO: 2780 - DNA, 1717 bp, Zea mays
  Clone ID: PAT_MRT4577_83940C.1
gatctgtaggggacctcgaagcttcgagcacgccacaacccaacgccgcgcgggcggcgggcccgtgctgccctggtgtgtactgctccctcacgccccgcgccgccacccccggcccccgccaccactcctcccggcctccccgacggcgctccgggcagcaggaacaagatgtccaatcgggccggccaggggccgtatcactcactacccgcggcccgcgcccgatcgggcgcactgccctgtggtgtactggtgtgtcacgcccctcgtcactcaccccgtcacccgcaaccccatcttctattcttcccgacggcgctcctggcagcaggaacaagatgtccaatagggccacacattggtgttatgcctgtcggcggccaattcgtctccgtgggcaggatatcgtatgccccaactgcaatgatggttttatccaggaaattagtgagatgggtggcatattgaacacttatgggctaattgaaccagactttgaagagcgtcgagctagaagattcggaatgatggatgccatgtcttcccttatgcggcaacggatggaagaaatgggaagagatggtttgtttgatattcgtggtagacaaggaacaggtactgaatatggaaggaggccaactgctgttcctacattggtatttggcggcatcccttctcctggagttggtagcggtgatgttaatgttgtcctcaggggaggccgcagagctggcgctgcccaaccaaatttcagtagcttagttgttggtcccagtctggaagctctttttgagcagctacttctccagaacaaccgtcaaggcccagcacctgctccacagtcagctattgactccatgcctgtggtaaagataaaccgcaggcatcttgacgacgatccacagtgcgcagtttgcaaagacaaattcgaggttggagcagaggcacgggagatgccatgcaagcacctgtaccatactgactgcatcatcccctggctggttcagcacaattcttgccctgtttgccgccatccactgccatcacagagatcaggcagtaccagtagcgcccggccttcagcttactacaacgaagccgctgatcctcctggggtcaccagagcagatcttgaacctgctccaagagacggtggcagggaaagccaggaaaggcgccgctccttctcgtttctgtggccgtttggcccgtcgagttccagatccagttcttaccagtacgaacagaatgttgatgagcctgcagtatacgatccaaaccagatagcatattctgagtggcactatgaccactgactgaaaccctgcagcaagtgcaagctatctgcaattcgtgccttcaaccctcagctttggagaggcattcatcagctgtaatggctgcttgccgtataaaaaaaggatggttcttgcctgttatattgtgttcagtgcatagccttgctccgtatgtccgtcgtatatataatcccttgcgtgtagtaagcgatgaactgaatgcatccagaatatcatgtcatgataaacttgaatatagtttcatggttgttatttcagactgaaaataaaatcagtcttctgttccggttatactgattctgaaagaattctagacctccgttctttctttcaagacctccgttcttgaatatttgttgtctgttttaaaaaaaaaaaaaaccataaaaaagaat

SEQ ID NO: 2781 - DNA, 408 bp, Zea mays
  UNSURE (1)..(408): unsure at all n locations
  Clone ID: PAT_MRT4577_84205C.1
  unsure (1)..(408): unsure at all n locations
acctanattttttttttttttttttttttttttggggtggttttttggggggggcccgagcttttccatccaaggtccacaaaaataacggggctaaatgcttcgaaagacaaaacaaaacttttttattcaaggttcagggtacatatccttgaacccatcttaagcatacctagccgatttcaaaaggcaacccccccatcatgggggattggcccccagagctgaccatgggaacatttttactagagatgacccacccatgcgaagaaaatttgtgacccatcaaggccccttcttggaagaagggccagaatccggggttttttttctttttttgagaggctaaacctttccccttttctttgttttggccatcttcatagccctataaaggcctctttggtt

SEQ ID NO: 2782 - DNA, 2391 bp, Zea mays
  Clone ID: PAT_MRT4577_84221C.1
ttgggaccctcgaggccggccgggctttttagctgcttgtggctgcgcccggcgggcgacgccatttatcacacctcacctccgccacccgggtgcttacgtggcgcggcaccaccagctgatcctgatcggcgcaggaagccaggatcggagtaaacgcttgctggctctctaatccccgtccctcatccctcaccctttgcaaaaatcacagcggcaggggacagcaaaaatctccatgcccacgctcggcctagatctccggcgagccggccccgcgcggtagccgattcactctccgaccccgacccgatgggcggcgaggtgccggagccgcgccggctgagccgctcgctcagcttcggctgcggcggcgtccccgaggaggcgctgcacctcgtgctcggctacgtggacgacccgcgcgaccgggaggcggcctcgctcgtgtgccgccgctggcaccgcatcgacgcgctctcgcgcaagcacgtcaccgtcggcttctgctacgccgtggagcccgcgcggctgctcgccaggttccggcggctcgagtcgctcgcgctcaaggggaggccccgcgccgccatgtacgggctcatccccgaagacttcggcgcctacgcggcgccctgggtcgccgagctcgccgcgccgctcgactgcctcaaggcgctccacctgcgccgcatgaccgtcaccgacgaggacatcgccgtgctcgtccgcgcgcgcggccacatgctacaggtgctcaagctcgacaagtgctccggcttctcaacggacgccctccgcctcgtcgcccgctcctgcagatctctgagaactttgttcctggaagaatgtataattgccgatgaagggagcgaatggctccatgaactcgccgtcaacaattctgttctggtgacactgaacttctacatgacagaactcaaagtggagcctgccgatctggagcttcttgcaaggaactgtaaatcattgatttctctgaagatgagtgactgcgatctttcggatttgattggttttctccaaacctccaaggcactgcaagaattcgctggaggcgcttttttcgaagtcggagagtacaccaagtacgaaaaggtcaagctcccacctaggctatgcttcttggggggtcttaccttcatgggtaaaaacgagatgcccgttatctttccgtattctgcgtcgcttaagaaactggacctgcagtacactttcctcaccactgaagatcactgtcagcttatcgctaaatgccccaacctactggttctcgaggtgaggaatgtgattggggatagaggactggaagttgttgccgatacatgcaagaagctacgaaggctgagaatcgagaggggggacgatgaccccggccaagaagagcagggaggagtctctcagataggcctgacagccgtagctgtcggctgccgggaactggagtacatagcggcatacgtatccgacatcacaaacggggcgctggagtccatcggcaccttctgcaagaacatgtacgacttccggctcgtcctactcgacaagcagaacaaaataacggatctgccgctggacaacggtgtccgagctctactgaggagctgtaccaagcttcggcggttcgccttgtacctgagaccgggagggctctcggatgcaggcctcggctacgtcggacagtacagcgggaacatccagtacatgctgctcggcaacgtcggcgaatcggacaacgggctgatccggttcgcgatggggtgcgccaacctgcggaagctggagctgaggggctgctgcttcagcgagcgggccctggcggtggccgtgctccagatgccctcgctgaggtacgtatgggtgcaggggtacagggcctctcagacgggccgggacctcatgctcatggccaggccgtactggaacatcgagttcgtgcctccccgtcccgagagcgcgtgtcgggtgatggcggatggacagccttgtgtcgacacccatgctcaggttctcgcgtactattccctcgctggaaggaggccggactgtccgcggtggctggttactttgcatcccgcgtgactgtagatacggcaaggtgtccgagtgtggttactgttactaccagctgcttgtgtaccgtaatgaactgtagtgccgacgtactgtagcggaggtgtagtgtagtgcaataataagttgcggtgttgcttgtactggtatctagtcctaggaggatgtatactaagttatgctgtgctttcttctccccggaattgtattctgttgcttccactgtaaatatcagaaatggctttttgctagtttgggttgaaataatggacctcacaggtgcattgcatgcacaac

SEQ ID NO: 2783 - DNA, 2411 bp, Zea mays
  Clone ID: PAT_MRT4577_84224C.1
gccggggtgaaaccccggctgatcggcgcaggaacggagtaaacgcagcctccattccccgttcctcgctggccgctactactcatccctcgctcttgcggaggcgaggcagaggcttgctcctccctccaataattcccttccgcctctcctcccgtcctctcgcaagcccacaccacacctgcagaaatcacagcggcaggtgcagcaaaaatctccatgcccccgctcggctagatctccgacgagccggccccgcgcggtagcagattcgctccccgatcccgaccgatgggcggtgaggtgccggagccccgccggctgagccgcgcgctcagcttcggctgcggcggcgtccccgaggaggcgctgcacctcgtgttcggctacatggacgacccgcgagaccgggaggcggcctcgctcgtgtgccgcctctggcaccgcatcgacgcgctctcgcgcaagcacgtcaccgtgggcttctgctacgccgtggagcccgcgcggctgctcgccaggttcccgcggctcgagtcgctcgcgctcaaggggaggccccgcgccgccatgtacgggctcatccccgaagactttggcgcctacgcggcgccctgggtcgccgagctcgccgcgccccttgactgcctcaaggcgctccacctgcgtcgcatgaccgtcaccgacgaggacatcgccgtgctcgtccgcgcgcgcggccacatgctacaggcgctcaagctcgacaagtgctccggcttctcaacagacgccctccgcctcgtcgcgcgctcctgcaggtctctgagaaccttgttcctggaagaatgtataattgaggatgaagggagtgaatggctccatgaactcgctgtcaacaattctgttctggtgacactgaacttttacatgacagaactcaaagtggagcctgctgatctggagcttcttgcaaagaactgtaaatcattgatttctttgaagatgggtgactgtgatctttcagatctgattgggtttttccaaacctccaaagcattgcaagaattcgccggtggtgccttttttgaagttggagagtacaccaagtacgaaaaggtcattttcccacctaggctatgcttcttagggggtcttaccttcatgggtaaaaacgagatgccagttatctttccgtattccacaatgcttaagaaactggacttgcagttcactttcctcaccactgaagaccactgtcagcttattgctaaatgccccaacctaagtgttctcgaggtgaggaatgtgattggggatagaggactagaagttgttgctgctacatgcaagaagctacgaaggctcagaattgagcgtggcgacgatgatcctggccaagaagagcagggaggagtctctcagataggtttgacagccgtagccgttggctgccgcgaactagagtacatagctgcctatgtatctgatatcacaaatggggcgctggaatccattggcactttctgcaagaatctctatgatttccggcttgttctacttgacaaacagaagaagataacagacctgccacttgacaacggcgtccgtgccctactgaggaactgcgtcaaacttcggaggtttgccttctacctgagaccgggagggctttcagacgtaggcctcggttacattggactatacagtgggaacatccaatacatgctgctcggcaacgttggtgaatctgacaacggattgatccagtttgcaacgggatgcaccaacctgcggaagctcgagctgaggggctgctgcttcagcgagcgagctctggcagtggccgtgctccagatgccctcgctgaggtacatatgggtgcaggggtacagagcctctcgaacgggccaggacctcatgctcatggccaggccgtactggaacattgaattcgcgcctcccattcccgagagcgcttatcgggtgatggcagatggacagccttgtgttgacacccatgcccaggtccttgcgtattactcccttgctggaaggaggccggactgccctcagtggctggtgactttgcaccctgcgtcactgtaaatacgtcaagctgtcccgagtgtggtttttgtaccagctgcttgtgtaccgtaataaactctagtactgtagtggtggaggcgtagtgcaataaagttgcagttgttgcttgtactagtgaatctaatcctaggaggttgttgccctgtgctttcttttccccggaattgtatctttgctccactgtaaatatcagaaatggcctgtgctagatgagttgaatcaaaaaaaaaaaaaaaaaatacccggttatgctgtgctttcttgtccccggaattgtattatgttgcttcccctgtaaatatcagaaatggctttttgct

SEQ ID NO: 2784 - DNA, 384 bp, Zea mays
  Clone ID: PAT_MRT4577_84251C.1
cgcctatcttatttctgggaagcgcacaaacatcataacaaaaaactttattattgaactggaactcataagaaatctaaaacagggcaccaccaatgatgggttgctggtgtaacactgctgggtttgtcaaagcaagttacctgagtgggggcaattgttacaattcttatagggggccagccttaggcgcagcgtgctgggacaacggctacaactgtggctgcgtcaagaaggcagcagggctcacaccagctagctggctaaatggtaatagttgttgctgctgtaaataagcaggagagttcaatgctgccaggtggttgaatggaagaaactcctccgggtacgcagcagctagctggttaaatggtagttgttgtt

SEQ ID NO: 2785 - DNA, 404 bp, Zea mays
  UNSURE (1)..(404): unsure at all n locations
  Clone ID: PAT_MRT4577_84370C.1
  unsure (1)..(404): unsure at all n locations
accgggtccgagccagcgcgtctcgggagaagcgaccaccactttcttcaaccaccacaatgaaggacgaggagacagcccggcggcgagtacggggtactctcgagtaccgatagtggtcaaccgtccaccggcgagggcgagtaccgagaggtacatagaagggangagaaaggagcaccaagcaccaagcagcactcttcggcgaggccggctgccattcgccgnncggcgccttcgcacttcttacgagaanngcacgaggcganagaaaggaaccccgagcactgcgcacaaggcaccaagatcacggganngaggtcgcttgccgcggcgggccgtcgggcgccgggcggctacgtatttccacgagcacccacgnagaagaagaagggacccacaag

SEQ ID NO: 2786 - DNA, 1190 bp, Zea mays
  Clone ID: PAT_MRT4577_84406C.1
cattgggtacctcgaggccggccgggctcccggcctgtcccctcacctccctccccctatctctccaccgccgcagctagctgcgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgagctaggatttaggttgagatcaggagagggagaaggcggcggcgatggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaagctcgcggagaagcagaaagaccagcggcagcaagtgcaacgggaccaaactcaacagcagaccagttcgtcttccatgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcaccgttcctgctggggc

SEQ ID NO: 2787 - DNA, 1419 bp, Zea mays
  Clone ID: PAT_MRT4577_84407C.1
caccgctttaaatccgcctcctcccagcgtctccctcctcccggcctgtcccctcacctcctccccctatctctccaccgccgcagctagctgtgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgggctaggatttaggttgagatcaggagagggagaaggcggcggcgatggggcgcgggaaggtgcagctgaagcggatcgagaacaagatcaaccgccaggtgaccttctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggtaaattgttgagcttgctaaagttggctgttcgaacttcctcttttaagaattgtatgatttctttagctggccattagatgggcatggtttattgcaagtgttaactactttggttgccttgttacatccacaaaatatctctgctcttgcgctgtgctgcgatgcattgttaccgcaggagaagtcactgcaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccacctgagctgctgaaggtttgctctcatcgtcgcagtgtgctagcccaaaatccagcaagtcttccccggaccccggactggccaagcttctccgcctggtgcagtatcgtcgtgatcgcgagaagcagcagcagcggtttgccgtattttttaccaccgtgtataagtagcatatctgcaatgtgtatattttgttcaccgttcctgctg

SEQ ID NO: 2788 - DNA, 1264 bp, Zea mays
  Clone ID: PAT_MRT4577_84409C.1
ctcgaggccggccgggaccgctttaaatccgcctcctcccagcgtctccctcctcccggcctgtcccctcacctcctccccctatctctccaccgccgcagctagctgtgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgggctaggatttaggttgagatcaggagagggagaaggcggcggcgatggggcgcgggaaggtgcagctgaagcggatcgagaacaagatcaaccgccaggtgaccttctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggagaagtcactgcaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccacctgagctgctgaaggtttgctctcatcgtcgcagtgtgctagcccaaaatccagcaagtcttccccggaccccggactggccaagcttctccgcctggtgcagtatcgtcgtgatcgcgagaagcagcagcagcggtttgccgtattttttaccaccgtgtataagtagcatatctgcaatgtgtatattttgttcaccgttcctgctggggcggccctc

SEQ ID NO: 2789 - DNA, 1536 bp, Zea mays
  Clone ID: PAT_MRT4577_84415C.1
cattccgaccctcgactgcggccgggctgctccctcctcccctcccctccgatcaagtcggggcaacgcgcatcactcgctttaaatccgcacctcccggccggtccccttatcacctcaccttctcctttgagtcctctctctccgccgccgcagctagctgtgacgttatgctctcgccggcgccatagcgccagcgcctaccgtctacaactatccagccttaggcttacctatcccgtcaatcaagcctctcgtaaggaacaaggaaggtagctagctagttctatagctgctgtcgtcgtcgtcatcggcggcggcggcgcctgttcttagaggataaggttgtcctagcggagagggagctagccaggatttcggttgagatcaagagggggagcaggcggcggcggcggcgatggggcgcgggaaggtgcagctgaagcggatcgagaacaagatcaaccgccaggtgaccttctccaagcgccgctcggggctgctcaagaaggcgcacgagatctccgtgctctgcgacgccgaggtcgcgctcatcatcttctccaccaaagggaagctctacgagtattccaccgattcatgtatggacaaaattcttgaccggtacgagcgctactcctatgcagaaaaggttcttatttcagcagaatctgaaactcagggcaattggtgccacgagtatagaaaactaaaggcgaaggtcgagacaatacaaaaatgtcaaaagcacctcatgggagaggatcttgaaacgttgaatctcaaagagcttcagcaactagagcagcagctggagagttcactgaaacatatcagaaccaggaagaaccaacttatgctcgagtcaatttcggagctccaacggaaggagaagtcgctgcaggaggagaacaaggttctgcagaaggagctcgcggagaagcagaaagcccagcggaagcaagtgcaatggggccaaacccaacagcagaccagttcgtcttcctcgtgcttcgtgataagggaagctgccccaacaacaaatatcagcatttttcctgtggcagcaggcgggaggttggtggaaggtgcagcagcgcagccacaggctcgcgttggactaccaccatggatgcttagccacctgagcagctgaaggtttcagcaactcttcccgtttatccgcctggtgcagtatagtatcatcgtgatcgcgagagcagcagcagtgggtttgccgtatctttttttaccaatgtatgtctatatatgtaagtatcaaatctgcaatgtgttaatcaccatttccgctggggcggccctcgtgcagtatcgtcgtgatcgcgagaagcagcagcagcggtttgccgtattttttaccactgtgtataagtagcatatctgcaatgtgtatattttgttcaccgttcctgctggggcggccgcacggtactttacgcatgtaatatatgtgcttcatcaaatcactttcactaccatagcatgtgccggtttgtggtagtttcatgtctcaca

SEQ ID NO: 2790 - DNA, 1245 bp, Zea mays
  Clone ID: PAT_MRT4577_84416C.1
gagggccgccccagcaggaacggtgaacaatatatacacattgcagatatgctacttatacacggtggtaaaaaaatacggcaaaccgctgctgctgcttctcgcgatcactacgatactgcaccaggcggagaagcggggccagtccggggtccggggaagacttgctggattttgggctagcacaccgcgacggtgagagcaaaccttcagcagctcaggtggctaagcatccatggtggcagtccaacgcgagcctgcggctgcgctgctgccccttccaccaccctcccgcctgctgccacagggaagatgctgacatttgttgttggggcagcttcccttaacatgaaggacgtggaagacgaactggtctgctgttgagtttggtcccgttgcacttgctgccgctggtctttctgcttctccgcgagctccttctgcagaaccttgttctcttcctgcagtgacttctccttccgttggagcgctgaaattgactcgaccataagctggctcttccttgttctgatatgtttcagtgaactctccagctgctgctctagttgctgaagctctttgagattcaaagtttcaagatcctctcccatgaggtgcttttgacatttctgtattgtctcgaccttcgcctttagttttctatattcatggcaccaattgccctgagtttcatattctgcggaaatgagaaccttttctgcataggagtagcgctcataccgttcaagaattttgtccatgcatgaatcggtagagtactcgtagagcttgcccttggtggagaagatgatgagagcgacctcggcgtcgcagagcacggagatctcgtgcgccttcttgagcagccccgagcggcgcttggagaaggtcacctggcggttgatcttgttctcgatccgcttcagctgcaccttcccgcgccccatcgccgccgccttctccctctcttgatctcaacctaaatcctagcccaggcacgtcgcttcagccgccgccgccgacagcggctataaaacaagcagcttccttccttgttccttgcgagaggtttgcttgacacaggataagtaaggctacggctggctaattgtagatagtatgcggtggcggtggcggtggcggtggcgccggcgagtgcatgacgtcacagctagctgcggcggtggagagatagggggaggaggtgaggggacaggccgtcccggccggaccgggagggtaccc

SEQ ID NO: 2791 - DNA, 1602 bp, Zea mays
  Clone ID: PAT_MRT4577_84417C.1
ccggccgggatcccggtttcgctataccccctccccctccgatccgtcgcggcagcgctcatcaccgctttaaatccgcctccttcgaggccggccgggctcccggcctgtcccctcacctccctccccctatctctccaccgccgcagctagctgcgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgagctaggatttaggttgagatcaggagagggagaaggcggcggcgatggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggagaagtcactgcaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcaccgttcctgctgctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcgccgttcctgctggggcgc

SEQ ID NO: 2792 - DNA, 1379 bp, Zea mays
  Clone ID: PAT_MRT4577_84576C.1
cggacgcgtggggccaaaaggcactgaagaagccagtcaatagcgagttctactactagtagctagcctgctgatctgttctgttgtttagttcgcaaagccttctgtttcggcgaccatggaggatgagaggaacacacagccttctcggcaggaagaagcacgacgacgaccaggagaagaagaagcagacggatgagctggcgaccggcatggagaaggtcacggtgtccgagcccgagaagcacgggcacaaggaggaggagcacgaggtcgtcggcgagaagaaggagggccttctcgccaagctgcaccgcaccagttccagctccagctcgtcgagcgacgaggaagaggaggcgatcgatgagaacggcgagattatcaagaggaagaagaagaagatgggcctcaaggagaagctcaaggagaagctgccgggccacaaggacggccaccacacggccgcaccgtccccggcgcccgcgcccgtggagacgcatgcccaccaccaggaggaagcgcacaggccgcacgtcgtcccgaccccggccccgccgcctccaccgcacgtccaccagcacgaccacggcgtcgtcgtccaggacgacgtgaagaccgggaccccgccgcatgcaccggaggaggagaagaaaggcctgctggacaagatcaaggagaagctccccggtggccacaacaagaagcctgaagccgctgccgctgccgcaccggctccgcccgtccacgcgccggcgccggcgccgcaggcggagaacgtgagcagcccggatggcaaggagaagaagggcggcttgctgggcaagatcatggacaagatacccggctaccacaagagctcagctgaggaagcagaccacaaggcggacgccgccggcgagcacaggaccagctcctaaggtcgcagtcgcagcgcgtgtcctggccgtggccgggccttgggcgatcagaaggtagctagcgttggcatgtgggttcggttctggtttgcttttaccaaaagtttgtttcaaggtggatcgcctggtcaaggtccgtgtgctttttaaggtggatcgcgtgactggcagtgagtgttgctgcttgtgtaggacgtggtacgtacgggttttattttggttccaagtcaaaagtcacggtcggtctggatgttgtgtactgggtttgttgaattatgagcagctgcgcgttgtaattcggctgggctacctggatgcgttaataattgctttggtttctgcccagcgcgcgaacgtgttagcgtgtaatctctattttgcactatccagcgactaataaaaagaaacggatatatatatatatatatatcaattatcatttggatgttggtactgtgg

SEQ ID NO: 2793 - DNA, 1614 bp, Zea mays
  Clone ID: PAT_MRT4577_84578C.1
cccacgcgtccgaaaaggcactgaagaagccagtcaatagcgagttctactactagtagctagcctgctgatctgttctgttgtttagttcgcaaagccttctgtttcggcgaccatggaggatgaatccctaattaagccaaaaggcactgaagaagccagtcaatagcgagttctactactagtagctagcctgctgatctgttctgttgtttagttcgcaaagccttctgtttcggcgaccatggaggatgagaggaacacccagcagcaccagggcggtgaggcccagcaggacgccgccgatcaggtggacgtgaaggatagggggctcctggacagccttctcggcaggaagaagcacgacgacgaccaggagaagaagaagcagacggatgagctggcgaccggcatggagaaggtcacggtgtccgagcccgagaagcacgggcacaaggaggaggagcacgaggtcgtcggcgagaagaaggagggccttctcgccaagctgcaccgcaccagttccagctccagctcgtcgagcgacgaggaagaggaggcgatcgatgagaacggcgagattatcaagaggaagaagaagaagatgggcctcaaggagaagctcaaggagaagctgccgggccacaaggacggccaccacacggccgcaccgtccccggcgcccgcgcccgtggagacgcatgcccaccaccaggaggaagcgcatcacaggccgcacgtcgtcccgaccccggccccgccgcctccaccgcacgtccaccagcacgaccacggcgtcgtcgtccaggacgacgtgaagaccgggaccccgccgcatgcaccggaggaggagaagaaaggcctgctggacaagatcaaggagaagctccccggtggccacaacaagaagcctgaagccgctgccgctgccgcaccggctccgcccgtccacgcgccggcgccggcgccgcaggcggagaacgtgagcagcccggatggcaaggagaagaagggcttgctgggcaagatcatggacaagatacccggctaccacaagagctcagctgaggaagcagaccacaaggcggacgccgccggcgagcacaggaccagctcctaaggtcgcagtcgcagcgcgtgtcctggccgtggccgggccttgggcgatcagaaggtagctagcgttggcatgtgggttcggttctggtttgcttttaccaaaagtttgtttcaaggtggatcgcctggtcaaggtccgtgtgctttttaaggtggatcgcgtgactggcagtgagtgttgctgcttgtgtaggacgtggtacgtacgggttttattttggttccaagtcaaaagtcacggtcggtctggatgttgtgtactgggtttgttgaattatgagcagctgcgcgttgtaattcggctgggctacctggatgcgttaataattgctttggtttctgcccagcgcgcgaacgtattagcgtgtaatctaaaaaaaacactatccagcgactaataaaaagaaacgggtataaaaatatatatatatatatatatatatatatatatatatatatatatatatatatatatatatatatatatatatatat

SEQ ID NO: 2794 - DNA, 1616 bp, Zea mays
  Clone ID: PAT_MRT4577_84736C.1
ttgggaccctcgaggccggccggggccgtggagtagaggagcacaagtgagctagctagctctagctaggccacgcactgctgcctccttcatcatcaggtcgtgctagctagctagctatagctgggccgggggacgtacgacatcagcgcgcggccatgggcgtggggaagctgatgaacgacgtgaagccatacctggcgatggtgctgctgcaggtggggttctccgggatgtacatcgtctccgtcgcctccctcaagcgcggcatgaaccacttcgtcctcgtcgtctaccgcaacctcgtcgccaccgtcgtcatggcccccttcgccctcctcttcgagaggcgagtgaggcccaagatgacgccgctcatcttcctcaagatcatggggctcgccgtgctcgagcctgtgctcgaccagaacatgtactacctcggcgcgaagctgacgtccgcgaccttcgcctcggcgctggtcaacatcctccccgccatcacgttcctgctggccctcgccctgaggatggagaggctgaggctccggagcctccgcagccaggccaaggtggtcggcacggtctgcaccgtcgccggcgccgtgctgatgatcctctaccacggcccggtggtgccgttcccgtggtccgcgggtcgtcttcaccaccacgtccccgcggcggcggtggagagccagagcagcgcctcctggctcaacggcatctgcatgatcatcggcagctgcctgtgctggtccggcttcttcatcctccagtcgaacacgctgcagagctaccctgcggagctgacgctgacgactctgatctgcttcctgggctcggtgctgaccggcggcgtggcgctcgtggcggagcgccgcgacatgagcgcctgggtcattggcttcgacacccgcctcttcaccgccgtctactccgggatcgtgtgctccggcgtggccttctacgtgcaggggatcgtgacgcaggcgcgcgggccggtgttcgtgacggcgttccagcccctgtgcatgatcatcaccacggttcttggctccaccatactgaaagaggagaccaccctgggaagcgtgattggcgcggcgatcatagtggtggggctctactgcctcatctggggcaagagcaaggaccacctcggcagcaacggcggcaagcccggcgccgcggccgtcgccgagctgcccctgacctcgtcggctcctgcttggtccaacggcaagcaagctctggccgtcgtcgagacgacaccgccttcgtctttgcccaacaagtgcgttcactgacgcgcggatcggagctccatgcatgatgcggaccgtacaccaccgcacactactagtagtgcattgccagtgactgtaagccgccggccgtgtatgatcatgcatgcataccgtcataccgatatgatgtcccatactcccatcgttgcgtttaacactctcgagtttttgataacgtacttgcgtgtgctctgctgtgtgccactgccagtgccaccacaaccaatagtctaatactactacgacaattaagctttgtttagtttgtgcaaggaaagaagagaattaattactactattcgagtc

SEQ ID NO: 2795 - DNA, 1244 bp, Zea mays
  Clone ID: PAT_MRT4577_84738C.1
tacctcgaggccggccggggccgaggagaggaggagaggagcagcacaagtgagctagctgttcatctagctacgccactcctgcctgccttgcctccctccctcagcacgtcgtgctagtaatcgatcagaggggggcgtgacgtacgtacagcagccatgggcgtggggaagctgatgaacgacgtgaagccgtacctggcgatggtgctgctgcaggtggggttctcggggatgtacatcgtctccgtcgcctccctcaagcgcggcatgaaccacttcgtcctcgtcgtctaccgcaacctcgtcgccaccgtcgtcttggcccccttcgccctcctcttcgagaggagagtgaggcccaagatgacgccgctcatcttcctcaagatcatggggcttgccgttcttgagccggtgctggaccagaacatgtactacctcggcgcgaagctgacctcggcgaccttcgcctcggcgctcgtcaacatcctccccgccatcacgttcctgatggcgctggtcctgaggatggagaggctgaggctgcggagcctccgcagccaggccaaggtcgccggcacggtctgcaccgtcgtgggcgccgtgctgatgatcctgtaccacggccccgtggtgccgttcccgtggtccgcgggccaccaccaggcctcagccgccgccgccgccgcggcagcggagagccagagcagcgcatcctggctcaacggcatcgtcatgatcatcggcagctgcctgtgctggtccggcttcttcgtcctccagtcgaacacgctgcagagctaccccgcggagctgacgctggcgacgctgatctgcttcctgggctcggtgctgaccggcggggtggcgctggtggcggagcgccacgacatgagcgcctgggtcattggcttcgacacccgcctcttcaccgccgtctactccgggatcgtgtgctccggcgtggccttctacgtgcaggggatcgtgacgcaggcgcgcgggccggtgttcgtgacggcgttccagcccctgtgcatgatcatcaccacggtcctcggctccaccatactcaaagaggagaccaccttgggaagcgtgatcggcgcggcgatcatagtggtggggctctactgcctcatctggggcaagagcaaggaccacctcggcaacggcagcaagccggccgttgccgagctgcccctcacctcggctcccaacggcggcggcaccaacggcta

SEQ ID NO: 2796 - DNA, 459 bp, Zea mays
  Clone ID: PAT_MRT4577_84900C.1
ttcgaaaaggaccaggtttcattctcatctctcgcaccatcgaccttcaagtctcgctacgtacctagcgaataaaaaaagcagccgcaatggagagcagtaccatggccctctcctccacggacttcgccggcaaggccgcgaacgtgccgtcgacatccgccttcagcgaggcccgcgtgactatgcgcaagacggcgttgaaggactagtcgacgacggcgtccggcatgccgtggtacgggcctcgaccgagtgctgtacctgggcccactgtccggcaatgcgccgagctacctgacgatgcgagttcccgggcgactacggatgggacaccgcggatctgtcctacgacccagagacggtctccgagaaccagtagatgaaggtgtgccactcctgctgcatcatgcattgttgcctctttatgacagtttccacgaacagatcaaccaaaaa

SEQ ID NO: 2797 - DNA, 858 bp, Zea mays
  Clone ID: PAT_MRT4577_84959C.1
ttgggtacctcgaggccggccgggagccagaggatccaactccccttgctatttgggatttctccccgcacggcctgcgagagaaattgtacacatattccctgcctctcgctagcgccttccctccgcaaacggaaggctctcgtgaccaccgggatgtccgccatggagaccgacatcaacgcgccgccgccgcccgccccagctggcgagggatcctctgcggccggtccgtcctcctcccgcaagcccaacaagcgcttcgagatcaagaagtggaacgccgtcgcgctctgggcatgggatatcgtcgtcgacaactgcgctatctgccgcaaccacatcatggatctatgcatcgagtgccaggcgaaccaagccagcgcgaccagcgaggagtgcactgttgcttggggagtctgtaatcatgcttttcacttccactgcatcagcaggtggcttaagactcgtcaagtgtgcccattagataacagtgagtgggagttccagaaatatggccactagttcctgggcaccctcatgtgatgttggggcttacttctagtgactgctaccactcgagtgtatttttttctgccaaacagctccatcttttactgctttggatgcttgcatgtatcacaggtcaattatcactagtagtacgtccacctgggactgtatttggattgttcgttgagaggatagtagttccattttataaatgttatgtggattttcataagtgagcttgaattgtgatgtggtaccatgtctaaaggctggtgtggtcttgtcttgatcttgacttaaggagaaaaagttcgttttactctcaatccatgtggattagccagc

SEQ ID NO: 2798 - DNA, 521 bp, Zea mays
  Clone ID: PAT_MRT4577_84993C.1
atgagttatagttcaataataaaggttttttcacaaagtactttcttatttctggtgaagcgcacctaacatcacacaaaaaactttattattgacactctccctcgattggaaatctaaaagagcccccaccaatgatggaatgctggtagaacgctggtgggtttggcaaagcaagttggtatgaatgccaccaattgctccacttgctagagggtagccagccttcggcgcatcgtgctggtagaacggcaacctctgaccttgtatcaagataggtagcagggctcacaccatcttgctggctgaatggtaagagctgttgctgctgtaaataaacaggaaaattcaatgctgccagttcgttgaatggaagaaatgctgggggtaggcagcatgtaactggctgaatggtagctgttgatgttgcaaataaaaagcaaaaaacaatgcatcttgttgagttgaatggaaggaaactgctgctcctgagagtaggcagcaagggccgctagcacaag

SEQ ID NO: 2799 - DNA, 4136 bp, Zea mays
  Clone ID: PAT_MRT4577_85039C.1
atttggtatcgggtcttttactcacctctatatacaagcaatatagccaactaacagagatagctttgtacaactaatcatgcaggtttagcaaaacaacaaacatatatgagttgttgagtggctattttatttggtatacatgggacaataatggtaggctccgtttttccctgcgaatggtgacagctcttgatttgtcaaaacataacgtcgcacgcagcagcaaactgctccgtgtacccttttcatgctgcacccctgtaatggtgctgctttggccataaatcttgtaagcaagaataaatctcttatatactgtaggaatcaaaggaaaataagcattagcaatttagcattggggtcagctagcggactgtcgatccgatctcctccaatttgggccttccagaaacctccaggatccgactccaatcgaatcgccaaagcagacaggggcgctcgcgggggcgccgagctcgacggggcgagatggccgggaacgactggatcaacagctacctggaggctattctggacgctggcggggccgcgggagatctctcggcagccgcaggcagcggggacggccgcgacgggacggccgtggagaagcgggataagtcgtcgctgatgctccgagagcgcggccggttcagccccgcgcgatacttcgtcgaggaggtcatctccggcttcgacgagaccgacctctacaagacctgggtccgcacctcggctatgaggagtccccaggagcggaacacgcggctggagaacatgtcgtggaggatctggaacctcgccaggaagaagaagcagatagaaggagaggaagcctcacgattgtctaaacaacgcatggaatttgagaaagctcgtcaatatgctgctgatttgtctgaagacctatctgaaggagaaaagggagaaacaaataatgaaccatctattcatgatgagagcatgaggacgcggatgccaaggattggttcaactgatgctattgatacatgggcaaaccagcacaaagataaaaagttgtacatagtattgataagcattcatggtcttatacgcggggagaatatggagctgggacgtgattcagatacaggtggtcaggtgaaatatgttgtagaacttgctagggctttaggttcaacaccaggagtatacagagtggatctactaacaaggcagatttctgcacctgatgttgattggagttatggggaacctactgagatgctcagtccaataagttcagaaaactttgggcttgagctgggcgaaagcagtggtgcctatattgtccggataccattcggaccaagagacaaatatatccctaaagagcatctatggcctcacatccaggaatttgttgatggcgcacttgtccatatcatgcagatgtccaaggtccttggagaacaaattggtagtgggcaaccagtatggcctgttgttatacatggacactatgctgatgctggtgattctgctgctttactgtctggggcactcaatgtacccatggtattcactggtcattctcttggcagagataagttggaccagattttgaagcaagggcgtcaaaccagggatgaaataaatgcaacctataagataatgcgtcgaattgaggccgaggaactttgccttgatacatctgaaatcataattacaagtaccaggcaagaaatagaacagcaatggggattatatgatggttttgatctaactatggcccggaaactcagagcaagaataaggcgtggtgtgagctgctttggtcgttacatgccccgtatgattgcaatccctcctggcatggagtttagtcatatagcaccacatgatgttgacctcgacagtgaggaaggaaatggagatggctcaggttcaccagatccacctatttgggctgatataatgcgcttcttctcaaacccccggaagccaatgattcttgctcttgctcgtccggatccgaagaagaatatcactactctagtcaaagcatttggtgaacatcgtgaactgagaaatttagcaaatcttacactgatcatggggaatcgtgatgtcattgatgaaatgtcaagcacaaatgcagctgttttgacttcagcactcaagttaattgataaatatgatctatatggacaagtggcataccccaagcaccataagcaatctgaagttcctgatatttatcgtttagctgcgagaacaaaaggagtttttatcaattgtgcattgattgaaccatttggactcaccttgattgaggctgctgcatatggtctacccatggttgccacccgaaatggtgggcctgtggacatacatcgggttcttgataatggaattcttgttgacccccacaatcaaaatgaaatagctgaggcactttataagcttgtgtcagataagcacttgtggtcacaatgtcgccagaatggtctgaaaaacatccataaattttcatggcctgaacattgccagaactatttggcacgtgtagtcactctcaaacctagacatccccgctggcaaaagaatgatgttgcagctgaaatatctgaagcagattcacccgaggactctctgagggatattcatgacatatcacttaacttaaagctttccttggacagtgaaaaatcaggcagcaaagaagggaattcaaatgctttgagaaggcattttgaggatgcagcgcaaaagttgtcaggtgttaatgacataaaaaaggatgtgccaggtgagaatgctaagtggtcgtcattgcgtaggaggaagcacatcattgtaattgctgtagactctgtgcaagatgcagactttgttcaggttattaaaaatatttttgaagcttcaagaaatgagagatcaagtggtgctgttggttttgtgttgtcaacggctagagcaatatcagagttacatactttgcttatatctggagggatagaagctagtgactttgatgccttcatatgcaacagtggcagtgatctttgttatccatcttcaagctctgaggacatgcttaaccctgctgagctcccattcatgattgatcttgattatcactcccaaattgaatatcgctggggaggagaaggtttaaggaagacattaattcgttgggcagctgagaaaaacaaagaaagtggacaaaaaatatttattgaggatgaagaatgctcatccacctactgcatttcatttaaagtgtccaatactgcagctgcacctcctgtgaaggagattaggaggacaatgagaatacaagcactgcgttgccatgttttgtacagccatgatggtagcaagttgaatgtaattcctgttttggcttctcgctcacaggctttaaggtatttgtatatccgatggggggtagagctgtcaaacatcaccgtgattgtcggtgagtgtggtgacacagattatgaaggactacttggaggcgtgcacaaaactatcatactcaaaggctcgttcaatactgctccaaaccaagttcatgctaacagaagctattcatcccaagatgttgtatcctttgacaaacaaggaattgcttcaattgagggatatggtccagacaatctaaagtcagctctacggcaatttggtatattgaaagactaaatctttgatctttgctggtcagcagaggaatcaaagcagggaatgtaggatcgaggagagtgacaggacttcccctctgtgcacttcgccgaaaagtaataatgggattgctatgcatggcccttgttgtacactagaaaattgggcacgcaaacttgtgtcagtttttccgctgttgcgaaattcagtgatggtgtttttgtaactataccaacctgtgtcagttttgccgttgttgcaaaactcagtgatggtgttttttgtaattattatacatccgaataataagactggtgtttccagacagactatgcaagctaaggggaaatcacgattttcctagatcaaatatgtaatatgttcttttccaaaaaaaaaaaaaaaaaaggccaaaaaaaaaaaaaaaaaaaaaaaaaaaaaaaaaaaaaaaaaaaaaaaaaaaaaaaaaaaaactcgaggagggg

SEQ ID NO: 2800 - DNA, 457 bp, Zea mays
  Clone ID: PAT_MRT4577_85042C.1
ttttctctttctgcaagtgctgctaccgcaacgggttttccacaatgctgacaaggggctatagcttgcttggttcccccatacctctgaccagcggggtcctcaggatgtgaaaacccaatccttgaaccctacaggatccaacaggcaatcggaactagcatcttacctctatcacccttgtgcctccaacaaccgtaaggcctattacagcatttacctttgttgcattcggtggcacaaaacatgaaggcacaacagctacaacaacttgtgctaggaaaccttgctgcctactctcaggaacagcagtttgttccattcaaccaactggctgcattgaactctgcggcttatgtgcgacaacagctaccattcagtcagctagctgatgcctacccccagcaatttcttccattgaaccaactggcagcagtgaactctgctgcttatttac

SEQ ID NO: 2801 - DNA, 268 bp, Zea mays
  Clone ID: PAT_MRT4577_85072C.1
gcctcctctcgagttcgatctgtttgctcccccaaacatgtcggcccgcggcaaggaaggcaaggccctgggtaaggccggcccaaaacgccaccgaagggtgctccgcaacaccatccagggcttaacaaacccggccatccgaaggctgccccccagggccggcttgaaccccatttccggcctaatttacaaggagacccgcggcgtgctaaaaatctttttggagaacgtaatccggaacgccgtaacctacacggagcacgcc

SEQ ID NO: 2802 - DNA, 1325 bp, Zea mays
  Clone ID: PAT_MRT4577_85143C.1
acctcgagccggccgggataccaattgttcttgacgtcgcttgcattctattccaccgctcaccacaagaagccacctcaggctcacgccgcggttccacacgagcaaatcccgccgcttcctccccacgcaccccttcccatccttcccgaagcacgaggcgagccgggccgccggatatggcgccggcggcgccgtacggcggggccgagtcgcagcggcaggcggacctactcaagcaggagggcaacgcctttttcaggaaggaacgcctcagcgccgccatcgacgcctacaccggggccataactctttgcccaaatgttgcagtatattggaccaaccgagcactttgctataggaagcggaatgagtggactagagttgaggaagattgcagaacagctatccagcttgacagccagtctgttaaggcacattacatgctcgggttatctcttgtcaacagccaaagattatcagaaggaataaaatcactggagaagtccttggagcttggaaggggtgcacatcctgcaagctacatggttgaagagatatggcaggagctttctaaagcaaaatacatcgaatgggagagcttatcaagagaccgaacttgtcaactgcaaaagctgaaggtagcatgtaaagaggccctaacgagttacaacagccttgataacccagccgcaggtgcgccagtagaacagctaaatgagctcgaggaagttttcaagaaggctgcaaagactgatactccagcagaagtacctgaccatctctgttgcaaaatcacacttgatatcttcagagacccggtgatcaccccgagcgggattacctacgagagggccgtacttctcgaccaccttcaaacggtggggaggtttgaccccgtgacccgtgaggctcttgaaccgcaccagctggttcctaatcttgccatcaaggaagctgtgcatgcgtttttgagtgagcatggttgggcttacaagattagatgatcgctttggaatacaggttttggatactgtcggatgtgacggtgggatttttttgttcactgttggggggcagattttaatctgggatggctgcgtacagattcaccttctccagttgtgtacatatgagatgctcattatgatagtaattgtgaacagtacaccaaaggaagtgaagttgagcgtctgagttcctgactgcatcttcaaaaaaaaaaaaaaaaaaaaaaaaaaaaaataacgagggcgcggccccccccccaaaaaaaaaaaaaaaaaaaaaaaccccgccccccccctctttttgttttttttttt

SEQ ID NO: 2803 - DNA, 293 bp, Zea mays
  Clone ID: PAT_MRT4577_85159C.1
ctggcttctcctccccctcttaccaagtccttctcgggttagggttccttagggtattgtggaggggcgatggctgcggctgatgtggagtaccgatgcttcagttgcgggcttgcctgggccaccagcaacgagtcgctggagaatgccttcgccttctacggtgagatcctcgactccaatgtcattaccgaccgggagactggggagtttccgtgtcttatggcttctttaccttttcttttgagaactccatgcttgtcgctattgtgatcattatctgtaatggtgtt

SEQ ID NO: 2804 - DNA, 157 bp, Zea mays
  Clone ID: PAT_MRT4577_85189C.1
ttttagaggatccaagtttacgtccgcgtgcatgcaacgtaatagtttttttatggggtcacctaaattaaattcactggccgtggtttaacaacgtcgggactggaaaacccttgccgtacccaaattaaacggcttggaagaaatcccccttttc

SEQ ID NO: 2805 - DNA, 1870 bp, Zea mays
  UNSURE (1)..(1870): unsure at all n locations
  Clone ID: PAT_MRT4577_85206C.1
  unsure (1)..(1870): unsure at all n locations
agccttctccgttcctcctcgacgcgtctcttccacagccgcaacctctatccctcgtctggtatcgtctctcccacacccctctgccccaacccagaaaaaccctcgaaaagcggcggcggcgcgacatggcggaggtcgaggctccagctgctgcggttgcggcggcgacccctgaggtggcgacggtgaccgagggcggagccgctacggaggcgaagggtccgcacaagctgcaccgccagtggaccttctggtacgacatccagtccaagcccaaacccggcgctgcgtggggcacctccctcnnnnnggcgtacaccttcgacaccgtcgaggagttttggggcttgtatgatcatgttttccgtccaagcaagttgcctgggactgctgattttcacctattcaaggctggagtagagccaaaatgggaagacccagagtgtgcaaatggtggcaaatggactgtcccatgcaacagaaagccaacctttgagaccatgtggcttgaaacgttgatggctcttgttggggagcagtttgatgaaacagatgacatttgtggaattgttgctagtgtccgtccaagaggagataagcttgcattatggactaggactgccagcaatgaagctgtccaggtaaacattggcaagaagtggaaggatgtcatcgactacaacgacaagatcacgtacactttccatgacgactcgagaagggataagccaagcagaggtggacggtacaccgtgtaagttgcacacgaagaaggtcgttgttgttgattggaagtggagagcggaggtggggattttcttctgggatcgtcgccgacttcatttaatacagcctcagcttacctgaggcaattttcgcacctgttatgatgttattttgctctcagacagcttatgtagcacaagaaagagatgttggagacattgacgatttctgtatggcactagatttctatcttaatatgccccgattcaacagcacccagtcgagtcannnnnnnnnnnnnnnnnnnnnnnnnnnnnnngaattcggcacgagcccaagtatacaacacttaagcccttggctgatagagtgcttgtaaagattaactcttccgaggagaagacaactggtggaatcttgctccctacgactgctcagtccagacctcaaggtggcgaggtagttgctgttggagaaggaaggataattggggataagaaagttgatgtcagcattcaggttggagctcaggttgtgtattctaagtacgctggaaccgaggtcgcgttgaacgatcacagccatctggttctcaaagaggatgacgttataggtatcttagaaactgatgacgtgaaagacatgaagcctctgaacgaccgtgttctaatcaaggttgctgaagctgaagacaaaactccaggaggcctactgcttacggaaactgccaaggagaagccatctatcggaacggtcgtagcggttggcccaggnnnnntggacgaggatggcgagaggctcgcgctgtccgtctccgcggggagcactgtcctgtactccaagtacgccggcagcgagttcaagggcgccgacggcacgaactacatcgtgctgagggcgtcggatctgatggccgttctctcctgaactgggcttgggctggaggacgaacgaggtgcaggtgcaggagcaggcttagcaataccgtaggattcctcnnnnnnnnnnnnnnnnnnnnnnnnnnnnnnnnnnttgtcttgtttgactgtcttctgaggaaccgaacaacagtaataagcacaccgatgccgttcatacagatcacagtctnnnnnnnnnnnnnncacgacgtcgtgccgaa

SEQ ID NO: 2806 - DNA, 1237 bp, Zea mays
  Clone ID: PAT_MRT4577_85208C.1
cattgggtacctcgaggccggccggggtttttccccttcgcgtatcttcgtccgccgcaacccttcacgtatcgtctctctctcacacggtcacacccctgacctctctcccctccccctccccctccccctcccagaaaagacccctcgaaaaacggcggcgctgcgacatggcggaggtcgaggctccagctactgcggtcgaggctccagctgctgcggtcgcgacgacgacccctgaggtggcggcgcccgaggccggagccgctacggaggcgaagggtccgcacaagcttcaccggcagtggaccttctggtacgacatccagacgaagaccaagtccggggctgcgtggggcacctccctcaaaaaggcctacaccttcgacaccgttgaggagttctggagcatgtatgatcagatttttcgtccaagcaagttgtctgggaatgctgattttcatctattcaaggctggagtagagccaaaatgggaagacccagagtgtgcaaatggtggcaaatggactgtcccatgcaacagaaaggcaacctttgagaccatgtggcttgaaacgttgatggctcttattggggagcagttcgatgaaacagaggacatttgtggaattgttgctagtgtccgtgcaagaggagataagctggcattatggactaggactgccagcaatgaagctgtccaggtaaacattggcaagaagtggaaggatgtcatcgactacaacgacaagatcacgtacactttccatgacgactctaagagagacaagcccagcagaggtgggcggtacaccgtgtaagctggacgtcaagaaggccgttgctttggattggaattggagagcggaggtggggattttcttctgggatcgtcgccgactttcgtttgattcagcttttacacgaggcagttttcgccgctattacaatgttattttcctctcagacagcttatgtggtacaagaaagagacgttggagacattgacggtttctgtatggcactagatttctatcttaatatggcccccccggttcagtagcaaccccaacgagtcatttgctttttggagatccctgcaatgcatggccatgttttagatcttatatatattgtactgtatataaaacgtttgtgatctgtggagccattggcaccttgcatgcaaatgtgccctgtcggtaaggtattggcatttaaaaaaaaaaaaaaaaaa

SEQ ID NO: 2807 - DNA, 1167 bp, Zea mays
  Clone ID: PAT_MRT4577_85212C.1
agtcaaactcccaacacccatctttatctcatcgtcatcattagaaaggccgaagccttctccgttcctcctcgacgcgtctcttccacagccgcaacctctatccctcgtctggtatcgtctctcccacacccctctgccccaacccagaaaaaccctcgaaaagcggcggcggcgcgacatggcggaggtcgaggctccagctgctgcggttgcggcggcgacccctgaggtggcgacggtgaccgagggcggagccgctacggaggcgaagggtccgcacaagctgcaccgccagtggaccttctggtacgacatccagtccaagcccaagcccggcgctgcgtggggcacctccctcaaaaaggcgtacaccttcgacaccgtcgaggagttttggggcttgtatgatcatgttttccgtccaagcaagttgcctgggactgctgattttcacctattcaaggctggagtagagccaaaatgggaagacccagagtgtgcaaatggtggcaaatggactgtcccatgcaacagaaagccaacctttgagaccatgtggcttgaaacgttgatggctcttgttggggagcagtttgatgaaacagatgacatttgtggaattgttgctagtgtccgtccaagaggagataagcttgcattgtggactaggactgccagcaatgaagctgtccaggtaaacattggcaagaaatggaaggatgtcatcgactacaatgacaagatcatctacactttccatgacgactcgagaagggataagccaagcagaggtggacggtacaccgtgtaagttgcacacgaagaaggtcgttgttgttcggactggacagagggtgagagtggagttttgtgctgagatcggcaccagctttcatttaatacagcctcagcttacctgaggcaattttcgcacctgttatgatgttgttttgctctcagataggtttatgtagcacaagaaagatatgttggagacgttgacgattttgtatgcaactaaatttctatcttaatatgccccgattcaacagcacccagtcgagtcattgcgttctggagattcttgcagcgcatttccatgtttaagaccttattataaatgtctggcattcgtggatcaaaaaaaaaaaaaaaaaagtggtc

SEQ ID NO: 2808 - DNA, 342 bp, Zea mays
  Clone ID: PAT_MRT4577_85296C.1
acctgatccttactttccgtatttctcacacactaccctgagccttgctgccacgagagtgagccgcagagggtacgtggcgaggctgctcagatacgtctgaggcctgtgcagctgcgcccgatcgatatcaagatcaaccgccaggtgaccttctgcaaacgcctgaacgggctgctgaataaggcccaccagatctccctgctctgcgacgcagaggtcgcgctcatcgtcttcttcactaaggggaagctatacgagtactctagccattccaacatggaaggcattcttgagcgttaccagcgttactcatttgaagaaagggcaactcttaaccca

SEQ ID NO: 2809 - DNA, 215 bp, Zea mays
  Clone ID: PAT_MRT4577_85406C.1
caatactctatagtgagtcgtattaagtgtcaggttacgagcaacaacgcagtgatgaggtcatccagcagcaatgtccagcatcgggcagtccttctacgctggcgacgccgaggcggagggcgagtaccacgtggagcacgcggtggagtgcgtcaacgacaccgccggagccgcggacgacatctcgcaggtgtagcagcaccgcgccacca

SEQ ID NO: 2810 - DNA, 464 bp, Zea mays
  Clone ID: PAT_MRT4577_8543C.1
ctcctttttcttcactccgcttttgcttggttccatcgggccggcacgggagaagctagctagctagcatcagctctggtggtgtgtgtgtgtgtgtgtgtgtgggagggtagctgcacttggggctagctggaaggtcgggagccatggggaggggcctggtggagctgaagcgggtcgaaaacaagatcaaccgacaggtcaccttcgccatagcgcctcaacggcctgctgaagaaggcgtacgatctctccgtgctctgcgacgcccatattcgtgctcatattcttctccaaccgaggaaagctatacaagttctgcatcgtaccgagcatcacgagaacacttgagaggtactaaaaaaacaattatgcaggcccacatactgctgtacagaacacatagaacgatttaactcacaacactcccaacgagtaccttaaactgaaagcaaaggtggata

SEQ ID NO: 2811 - DNA, 1981 bp, Zea mays
  UNSURE (1)..(1981): unsure at all n locations
  Clone ID: PAT_MRT4577_85444C.1
  unsure (1)..(1981): unsure at all n locations
ccctcgtaggctggccgggaaaaaaaaaaaaaaaaaaaaaaaaaaaaaaaaaaaaaaaaaaatcagtgcctttccccttccttgtttgctgaagtccctggtgtggaccgtggagtctcagggagaagcgcatgcgcacgccaatcggcaatccaccaaagattccgttctcccagtcgcctctcccagtcccagatctcgttcactcgcactcgcgcaaccccgcggccccgcgcctaatggcatcctgtggcgccggcgacgccgcgtcagcgcagccgagggccagtatctcgcacgtcatcttcgatatggacggccttctcctcgacacggagggcttctacacggaggtgcaggagaagatcctagcgaggtacgacaaggtgttcgactggtcgctcaaggccaagatgatgggcaagaaggcggccgagtctgcccgcatcttcgtcgacgagtgcggcctcaacggcctcctcacccccgagcagttcctcgaggagcgcgagagcatgctccaagcgctcttcccatcctgtaccaggctgccaggagtactacgtttggtccatcatcttcatgccaacggagtaccgatggctgttgcgacaggatcccataaacgccattttgcactgaagacccagaatcaccaggaaatgttttccctgatgcatcacgttgtcatgggtgatgatccagaggtgaaggctggcaaaccatcccctgatatttttcttgctgctatgaggaggtttgagggcggcgtagaacctagcaagtgcttggtttttgaagacgctccttcgggtgtagctgcagcgaaaaatgccggaatgtctgtagtgatggtcccggatccaaggctggatgtttcgtatcacaaaggagctgaccaagttctcagttcattgctggacttcaaacctgccgaatggggcttgccggcatttaaagagtagacattccatacaagattacaagattataagagtctagtgaagaagaatgtgagatactccctaagatgcaaattaaagagtacaattctataagatgctgctcaaggaaaattccataaaatgttggtcaaacatacaattgaacattcttgtcgcctcttaactatgtctcaccaaattactctgaattagttcggttacgattccgatataataatatccaagnctgtagttttgtgccaactttgaagcgtgtagtgagaaagttgtttcagagctagttggaagcgaaaggctggggagcaacaacagtgccgaattgnnngctgaattgctggagagtatggaaaaggctgaaaatgttcgttttggcgggaatggagttagtcaaggtggccttccagaagagttagaggtatgaacaaggatacatcgtggaaatcattactgaggatcagtggcgtcaacgacccaaaattgaaggaagaattgtggagatagccaagttctaccgcttgctgggtggaatggtaagtagctcaactcccaagtttccttctggacccagatttgcaattgcggaggtttctctgacaggagatggtcgaaaatcatgccttgtaacggcatggcnnnnnccaccaaagaagatttcgtgtaagggcatagtcgaatattatgtcttgctggtacactctagatcagcatggacttttagnnnnnagnnnnnncttgttgagcagctggcttcccagagttgacttgtttgagtctgtgatgcccctgccatgctgttttctagaatagaactagatgagatgctgtgtcccctaaggcccttttgtacctctcnnnnnnnnnnnnnnnnnnnnnnnncnnnnnnnnnnnntggtacccttcatgtgatgattttgatgagttataaggtcagattttctgttttggtgctnnnnnnnnnnnnnnnnnnnnannnnnnnnnnnnnnnnnnnnntcgagagtcttctagacgccgcggg

SEQ ID NO: 2812 - DNA, 1773 bp, Zea mays
  Clone ID: PAT_MRT4577_85466C.1
cctcccactagtgcactgtctctcttcaaagcagctgcattggccgaggccggccgggctactgtgccgcgcgccctcccttctctctaatgatagcatagggagagaaggcatactccgaggcatccttctcctttccctctccttccccaaacccttttcctctttccctcgccccaagaacttcatctcatctccaggcgccccttttgcgcttgcgcaggaggagctcacggggacagtgggcggagagctcgatcgctgcaccactacttcactggaggtccgcccactcccatggaggagatcacccaacactttggagttggcgcaagcagccacggccatggccacggccagcaccaccatcatcaccaccaccaccacccgtgggcatcctccctcagcgccgtcgtagcgccgctgccgccgcaaccgccaagcgcaggcctgccgctgaccctgaacacggtggcggccactgggaacagcggcggtagcggcaacccggtgctgcagcttgccaacggtggcggcctcctcgacgcatgcgtcaaggcgaaggagccctcgtcgtcgtctccctacgcaggcgacgtcgaggccatcaaggccaagatcatctcgcacccacactactactcgctcctcactgcctacctcgagtgcaacaaggtgggggcaccaccggaggtgtcggcgaggctgacggagatagcgcaggaggtggaggcgcggcagcgcacggcgctcggcggcctggccgctgcgacggagccggagctggaccagttcatggaggcgtaccacgagatgctggtgaagttcagggaggagctgacgaggccgctgcaggaggcgatggagttcatgcgaagggtggagtcgcagctgaactcgctttccatctccggaaggtcgctgcgcaacatcctttcatctggctcttctgaggaggatcaagaaggtagcggaggagagaccgagctccctgaagttgatgcacatggtgtggaccaagagctgaagcaccatctcctgaagaaatacagtggctatctaagctcgctcaagcaagaactgtcaaagaagaagaagaaagggaagctccccaaggaggctcgccagcagctccttagctggtgggatcagcactacaaatggccttacccctcagagactcagaaggtggcactggctgagtctaccgggcttgacctgaagcagatcaacaactggttcatcaaccagcggaagcggcactggaagccatccgaggagatgcaccacctgatgatggacgggtaccacaccaccaatgccttctacatggacggccacttcatcaacgacggcgggctgtaccggctcggctagccaccggtatctcgcttccatttcacaccccacggcctagctataaagactaatggttccaggtgtctgaagtactgaagacaggggggctagctatctaatgtttgtgccgcacgcatgagctgtaaggaggccatgcttaattattctgttgccgttgctactctatctatatgcgcctatgcctccgtgcatgaactatgctttaggtggttgctgctccacactgtggtggtgtgcttttgcttttgtgtggtcgtattgtatgcgtaacctgacagatggatccctgattgctacatgtttgaataatttgcatgatctagctagtttctgcctaaaaaaaaaaaaaaaaaaaaaaaaagacaaaaaaaaaaaaaagaaaaaaaaaaactc

SEQ ID NO: 2813 - DNA, 357 bp, Zea mays
  Clone ID: PAT_MRT4577_85513C.1
ataatgcacattattgtaccaacaatggcagccaaattattttgactccttatgctccttggtctttctgcaagtgctgcttcgggcaccatgttcccacagtgctcacaagctactatagctttccttcttcccgcgtacctgttaccagcggcgtctttacgctgtgaaaaccacacattttcaaccctatgggatccaacaggcaatcggcgctggcatatgacctttatcacccttgttgctacaacattaatacaccctattacagcagtgtccttcggtgcattgattggcacaaaacatcaaggcacaacaactacaacaacttgtgctagctaaccttgctgactactc

SEQ ID NO: 2814 - DNA, 1282 bp, Zea mays
  Clone ID: PAT_MRT4577_85555C.1
cctcgaggccggccgggaatctcgcagtcctttcttcctccgacggtccgacctccgcagcgaatcggaccaggggatagggttccgccgcgcctctccaaccaggcgccactcgccagggtctaggctgatcatggaaggaaacgccgcagccgggaagaggtcccggacggagacggcgaacggggctgccggcggcgggaagcgctccaaagacatggagtcatttcaaactggtctatcaagcaaatcgaagccttgcaacaagtttttcagtacgattgggtgcccgtttggtgagggatgtcgttttctgcactttgtccctggcggttacccggcagttgcaaaaatgctcaatctaggtagccctgctgtatctgcgccatcaagaactcatgtggatcacgccgctcttactggcgcctctcattcagcttcgtcaggcaagacacgcatgtgcaccaagtacaatactacagaaggctgcagatttggtgataagtgccactttgctcatagcgaaagagaacttgggaaaccagcgtacatgccttatggagaacctcctatgggcggtcgatttggaggccgacctgaacctgtgcagccagctgccatgggccctccagcaggaaactttggtgcctcggcgactgccaagatcagtgtggatgcgtctcttgccggtggcataattggtaagggcggggtcaacactaagcagataagcagagttacaggcgtcaagctctgtatccgcgaccacgagtctagccccaacctgaagaacattgagctggaaggcaattttgaccagatcaagcaagccggcgaaatggtgagggacctcatcgcgaccatcagcacgagcatgctggcgaaaaactcatctgctgccgtggctccatctggaggccgaggcggtggtctgggtggcaagagcaactacaagacgaagctatgcgagaacttcgtgaagggtgcttgtactttcggcgagcggtgccactttgcccatggcgagaacgagcagcggagaggtgctgtttgagagttgaggtgccaactccaggcatgacatgtcctgtgctctccatttgcttctctgaatttcctccttgtagcgttagacggttagactgtcgtattgctatttcaatggtttcaactgagttcagctttaagaaaacgttaatctgttgtgcccctgaatgttgtgacttgtcagtaagttagcagctgctagccaatcttgtttggacggtcatacattcatctt

SEQ ID NO: 2815 - DNA, 205 bp, Zea mays
  Clone ID: PAT_MRT4577_85632C.1
gcctgcgagggaggagcacaagacggggggcatcctggatcgctcggggggctccagctccagctcgccggaggacgacggcctgggcggacggcggaagacgggcctcaaggagaacatcaaagagaagctgcccggaggccacaaggaccaccagcatgccacggcgacgaccgggggcgcctaccggcagcacggacacacc

SEQ ID NO: 2816 - DNA, 214 bp, Zea mays
  Clone ID: PAT_MRT4577_85749C.1
gggacctctccctccttcaaccttggctagctagccagggagggagtccatgaattccaggagaagcctcctctcttcgcccctctttgctagctcgtctccaaacttgaggagcagtgcttccgtgtactcctccccatccccatcccgcaccacagttccaatgatacatgacaccagcagcaggagagcattcacggcgtgccactactgg

SEQ ID NO: 2817 - DNA, 487 bp, Zea mays
  Clone ID: PAT_MRT4577_85964C.1
ctctcaccaatggtgtgttcggtatgtgaaaacccaattctttaaccctacacgatccaacaggcaatcgcagctgtgatcttacctttatctcccttgttcctccaacactcatcagacctattacagaagatacctttggggcatttatagtgacacaacatcagggcacaacaactacaacaacttgtgctatcaaaccttgttgtctactctcagaaacagaagattctttcatttaaccaactatatgcattgaactctgctttttatttgcgacaacaacaactaccatttagacagctatatgttgtctacacccagcaattttttttattttaccaactgacagcattgaactctcctgcttatttacagcagcaacaactactatcatttagccacctatctgttgtgagacctgctatctttttgacacaaacacacatgttgtcgctctatcagaacgctgtgcctatagctgtga

SEQ ID NO: 2818 - DNA, 270 bp, Zea mays
  UNSURE (1)..(270): unsure at all n locations
  Clone ID: PAT_MRT4577_85988C.1
  unsure (1)..(270): unsure at all n locations
tctctttccgatccgccgagtgcacaccagcnttgcctcactccgatcgagatggagggccgccnagggcgagaagaagatgatcaccctcaaaagctccgatggcgaggagttcgaggtgagaagaggcggtggctatggattcgcagaccattcgccacatgatcgaggatgactgcgccgacaacggcatccctctttctaacgttaacttcaagatcctatccaaggtaatcgagttctgcaacaagcacgtacattgcctcgtcg

SEQ ID NO: 2819 - DNA, 383 bp, Zea mays
  UNSURE (1)..(383): unsure at all n locations
  Clone ID: PAT_MRT4577_86049C.1
  unsure (1)..(383): unsure at all n locations
ggggggggggcacatggcggctctctgtttgacactagggtaccatacactaatcaccggcgttcgtcgcaggtggcgagcccanaggaggaaggcgaacaagaagaaccgcaggagaaaagactaantacgcctcctagcggcaatggnccctcctggtagtncggcgccaagctagacccagcntaagaagatgaagaaaaaaactaaaagctagctctaggcggggcggacgcgcttgtggccggngccggcgccggcgcggccgttattgccggggccggaggagtcgccctcgggggacgcgtggtccatggtgcgcgcgaggggggcggngaggtcggngtaggggccgcgcgcgcggcggctgttggtggtgggct

SEQ ID NO: 2820 - DNA, 1920 bp, Zea mays
  Clone ID: PAT_MRT4577_8623C.1
ccggccgggaaaaaaaaagacggactttttcttagaggagccctagagctgaaacctgcagaggaagccccgttaatctattctccttgcatccacaccgacgggcaattggtgcgccgtcttctccgtccgcggcggccatcttggtagcggcccgcatcccctcggccctccaaatcaacgaaccagcgcgtccccgctcctccccacgccacgggaaacttccagcaaaaggtcgcgccatcgataaggggagaaaaggagaagtgtcgccgtccccgtcagcgacggcgctggtaccgacggtccccgcgtcgtgtgccttcctcctccgcgagttcgacgacccgctgtgcgtctgctctcttccgcgcgcccaatcctcgtcgagtcgtcgtgccgctgattgacacagcctagatgtgacagatctactttgttccttgctactttttggcatggtcactccctatttgccatcatcgcacaaccatcgccgaaggctgccaattctattgaaaataggatttttgttaatgatgggagaaaataaattgatgggcaaaagatgggaggacatggacactgatgtccttgtgaagatattcaaggaactaaatttggttgagttgtcaccggtatctcaagtttgtcgtttgtggcgcttggcctgttcagatccacttatttggggcactcttgactttggattgttaaaatccaattttattcagacaagagcatcaccatatatttgggttgatgataggtctgacaggagacttgcaagaatactacgggtggctatggcaattagctgtgggaacgtcaactgcatgatatttcattacaatttgttcatgaaagatgagcaccttcatttcatctcagaaagatctcctcatttaaaacggttggttatgccagcatggaaccgcatcaccaaagtgggaatatgtaatgctatccaaaggtggcaggcgctggagtccttgacaatgcctaccatcggacatcctccatatattatggaagagatagcaaggagctgcaagaatttcacagaacttaagatcatgggctcatttgatcaacaatttgcctcggcgattttgcagttccttccaaagctgaaagtgctgagccttcgttgctcgaaggtgtccatggatgcactgcaatgtttgctgaactcgatggagtatcttgaggttctgaatatttcacactgcctgctgttggttgtcgcggcaaatgggcggaagcaagtggttcatgaactggacagccaaattctcgagagagcttcacggctgcgtgaattccactactgccaaagtaggttgtgcgtcgcgtgccagcggatggtggtggatgaaggcatcatgcgctggtacaggtacgaggattggttttggcgtcgggatgaggtgaggtcccttgatctgcaggattatgggaagctgtttgatgttggttgcgagaggttgacgtctgtggattagatgctaataataggggagcaaaacccgccctcctcagtctagaaacttgtttattggcattcataaaacatagcaagtgatgaggggtaacagtagattaataatatcgataacaatgtgcgtgaatggtgtgcgcgtgtttagctactgtaaatccatgaatagttcgtgttgtttggaggagtttgttatagccagtatggtgtcaagagtatctctgcaatttgtttttaagtgatgtggcattggacatgaatagtatttggctttatacgctagagcgtaaaaggctagacctgatactgctagttaggctgtggccagtgcacacgcaaaacactgttttatattgcagattgtactgtttataggatatggagtttgaaaaaaaaaaaaaaaaaaggcccctagggcc

SEQ ID NO: 2821 - DNA, 671 bp, Zea mays
  Clone ID: PAT_MRT4577_86264C.1
gtcggtcgggtcgggaagcttatcacttatcatccccgtccagcacctctctccatgtctctgctccgccggctccttcttgatccagccgaaccagtgatcatcatgtgcggtctcgcgcggagtaccacgttcaaatccaagggcgacgccgccgcgtgcatgaggtagccgcagaacgctggaaccgcccggaataacggattcatcgtcatcaagaaccgcccctgaaagggtgtggaggtttctacctcagcatactgggaaaaatggacatgccaaatgccactttgttggcatagacatattcaacgggcaagagctcgaagatattgatccttcgtcacacaactgagatattccacatgcgcaccgaactgagtaccaactgtattgatatatcacacgatggattggatatccttcttacttcaaatggcaacactaaggaggatcttagactcccaactgatgacactcttgggtgccagatcgatgaacggtttgcaagcgtgcatgatcctggtgagaatgtccagactgctatggaggaggagcatatctgcgcgctgaatgatgaagtccccgatcaacttccctgccttggaatactgtatctcttaacctaaatcgacaccacaagtgtatcaaggattgctacagagacctcc

SEQ ID NO: 2822 - DNA, 261 bp, Zea mays
  Clone ID: PAT_MRT4577_86377C.1
cccatttcgacccatgcgtacggcgaacatacaaagcacattagtgtactaacattttcagccaaaatattttgcttccgtatggtccttgatctttctgcaagtgctgctaccgcaaccattttaccacaatgctcacaagctcctatagcttcctttctttccccatacctatcaccatcggtgtcttcagtttgtgcaaaccctattctttaaccctacagcatccaacaggctttttgtagcacgcatattaccttt

SEQ ID NO: 2823 - DNA, 944 bp, Zea mays
  Clone ID: PAT_MRT4577_86526C.1
attggcttgttgaggtttcggacgaatataagcttgtggcagatacactttaccttacagtatatcttattgaccaatttctttctcagaactgtatccaaacgcacaagctgcaacttcttgggataactagtatgctgattgcctcgaaatatgaagagtattctgctcctagtgctgaagaattttgtaacataacggctggtacatatgcaaaggctgaggttctggaaatggagcaacaagtgcttaatgatctgggctttcatttatctgttccaacaacaaacacatttctcaggagattccttagagcagcacaggcttctcgtacagtaagatcagtacccaaaccacattgcaacgagtcctttcagtctatatgtattgtcctcaacactaagttggcaagctacatttccaggctcatctgaccactttgaattatctggcgagttatcttgccgagttgactttaatcagttacgatttcatgaaatttcttccctcagaggtggcagcatcttcgattttccttgcaaaatggacacttgaccaatctgaccatccttggaaccctactcttgagcactacacgtcttacaaaagcttcgatattagaacttgcgtgcgggctctacaggaactgcagcacaacaccagtaattgccccctcaacgccatccgtgagaagtatgggcagcagaagttcgagtgcgttgccaacctcaggtcaccggagctgctgcggtcgctcttcagttgatgtgctcccctgcactctgctgattcactcgccatttgctgcaacgatcctgacactgtataaaatatttcttcagtttctgttccatttccaaactttcttcagtttgaacatgcattctgtgacttgggtcaccgacaaaagaggcgcgacacactaatatatcaatttgtaactc

SEQ ID NO: 2824 - DNA, 2920 bp, Zea mays
  Clone ID: PAT_MRT4577_86577C.1
cctcgagggccggccgggccgggatgacattaacccgtctttggtcccggagggaaaaggacaaatcactcacacagagggaacaaaagggcacaggaatcgcgacagcgtgggaggcgtacggcgcaccgcccggccgccggatctgcgccggcgacgcgcccggacgtcggatctacgccgccgcaggaggagggaggcggcgctctggccgttccttgcccgcgagcgcccagatccgtcccgccgccggatatatatatcaatcaatgcccctgtgatatcgagcttcagttgatgcagtggtgaaaacatcttctcgaaaaactgctggctgcaagttgcaaaagtttgtctttcccttgttgtgttgttgcttccttctctggtggagtacacgggagaagtttgcagatacaggcagctcctttcaaatctcctatgtccagggatttggactgtcctgttcagacacagatggctgtggcagtcctggaccggagctttagcagcgaatatcctggaggtagcagaattgaggggaggcaactgagctggaagagagtatttgtccaaactgacaatggttctgtccttggcatcgagctggagagaggagaaaacgtacaaactgtgaaaaagaagctccagatagccctcaatgtgcccactgatgagagctcattgacctttggtgacctagttctgaataatgatcttagcagcattcgcaatgactcacccttgtttctcaaaaggaatcagattcaccggagcaattccacaccttgcctctcccctacaggtaagaatgttttgcaaagagaccggagtggacccattgaaatccttggctgttcaagtccttcatctcggatgaagcagcttgctaaggatgtcattaaagccataatgaatgatgttgacccagtcgctgttaacagtgggatgggtggtgcctactacttcaagaacatttggggagagcgtgtggcaattgtcaagccaactgatgaggaaccatttgctccaaataatccaaaaggttttgtggggaaagctctgggacagccgggcctgaaaaggtctgtacgggttggggagacaggcttcagagaggttgctgcttacctcctcgactatggtcactttgcaaatgttcctcccaccatgctggtcaagataacacacacaatcttcaatgtgaacgactgtgttggctgcaaaagtaaagtgttctgcaacaaatcagaggctgtgagcaagattgcatcgctgcaggagttcattcctcatgatttcgatgccagtgaccatgggacctcaagcttccctgtatctgcagtgcataggattggcatccttgacattagaatcttcaacactgacaggcatgctggaaatcttctggtcaagaagcttggtcctggcgccgacaattttggagagcagacagaactcattcctattgaccatggtctctgtcttccagaatgcctagaagacccatacttcgagtggatccactggccgcaggcatctgttcccttctccgaggaggagcttgagtacattgcaagacttgatcctgtaaaagatgcagaaatgctacgcatggagctacccatgatacgagacgcatgtctcagggtgctggtgctatcaacagtatttctcaaggaagctgcagcgtctggcctctgcctctcggagattggagacatgatgagcaggcagttcactgcgaaggaggaggaaccgagtcagcttgagctgctctgcatggaggcaaggaagtgggttgaggaaagagagtcctttcttcccaacgaagccggagttgaagatgacgatgatgacttcacccagttccttatcgacgacgaggatgattatccggatgccttggaaccatcagctttctgcaagtttggtagcatgaaggcaagttctaggaatccactgtccaagctagatgagcgtgacgaggaagacggagacgggaccgaggaggacgacgacgacgacatcttgaccggtgcattgcctcagaggatctcgtctatctccaagctgtcgtcatccatgaaggggcttggcttcattgggaaacccaagccctaccgcacgtgccttcggaagggtaaagcgacaggcagaactaagtacaccggcaaagccagcgagcatcagtccgggagcaggagcgccaacgagctgctcccgcccagcgccagtttcgtgaagctgtcggacatgagccctaaacagtggagcgcattcctcgacaagttccaggagctgctcccaggtgccctgagcgcccggaagcacgctgccggtgtcgtcggccagcgctcgatgccgaggctgggcacgtcttgccagttttgagagtagcagaagagaagccaccgaacccaaggtatgacgaacgcgcttctgttcgagctctggtgtgcagcagccaagcaggtacggagtattatatatgcttgtagtaggtgtctggagccggtggtggtagagagggtccgagaataagatcatccatggcatgtgagatgaggttgcgggagaaggaagggggttgtgtgtgtttgtgcatagtgtttcgcataagagatccgttgttcttttttcttcttctctgtatatagttaagtactcctactgctactgcatcgcagcaccgggcacgggctgggatctcggccgttgttacctgaacgatggtggtgagtgtgctggcgtcgcctgctctctgctctgtctttgccgctgtaccattttggaggcgcttaccatattatgaactttgaactatgatatgatgttcgctataaatatcacatgttctctgtataccaaaatgaaaagatgttcgctacaaaagaaaaaaaaaaaaaaaaaagcggcc

SEQ ID NO: 2825 - DNA, 3011 bp, Zea mays
  Clone ID: PAT_MRT4577_86650C.1
ccttagatcccttcttttatttcgatattagtgcggatcaaaatcgatgcaacgaaaacgaatgcatatccaaagacaaatataaaataaatatagaacaaataatatcgctatctatccgatatccggctctcggcctcttggctcgtcttccgttttaacgccacctcgcgacgcggcccccaacccccaccgctgcggtgctactgctaccgtgctacaccatcaggaatcggacgcgggacgctacaccaccaccacagctccccacctccaccctcgccgcgagttgctcagtcgcagactcgcagcgagcgaggcgggggcctcactcagcgcggggcgaggcgagcgtcccgggtgggcagcgtcgcggtcgcgggctcgatcgggttgggacggggaggtagggaggaggggccagggatctccactctcgtccgtgcgggagcgcgggcgtcgcatgcggcggcgcgccggggcaaatgcgggtaacctcacggtcggaggagcgctgacgcggcggcggcagccagggagcgatgcaggcgccggagcagcagcagcagcaccagcagcggcagaggaagggttcatcagagatggacttcttcagtgaatacggtgatgctaacagatacaaaatccaagaggtcattggcaaaggaagttatggcgttgtttgctcagctgttgaccaacatactggcgacaaagtggcaatcaagaaaatacacaatatcttcgagcacttatctgatgctgcacggatcctacgtgagatcaaactacttcggctattacgccatcctgatatagttgagatcaagcatataatgctgcctccatcaaggagggacttcaaagatatctatgttgtatttgagctgatggatacagatctccaccaagtcatcaaggcaaatgatgatttaaccagagagcatcatcagttctttctctatcagatgctccgtgcactgaaatacattcataccgctaatgtttatcatcgtgatttgaagccaaagaatatattggctaatgctaactgtaaacttaaaatatgtgattttggattggcaagagtggcattcaatgacactcctacaacagtattctggacggattatgttgctacaagatggtatagggcccctgaactgtgtgggtctttcttttctaagtattcaccagctattgacatatggagtatcggttgcatttttgcggaaatcttaactgggaagcctttatttcctggaaaaaatgtggtccaccagttagatttgatgactgatctcttgggtactccatcacttgatacagtttccaggattcggaatgagaaggcaaggaggtacttgagtagcatgaggaaaaaacagccagtaccatttactgaaaagtttcctaaagcagatcctgctgcactcaaacttttgcagaggcttttggcatttgatcccaaggataggccaactgctgaagaggcattggctgatccgtattttaaaggcctcgcaaaagtagagagagaaccatcatgccagccaataacaaaaatggagttcgagtttgagcgaaaaaaggcgaccaaagaggatgtcaaggaacttatattcagggagatattggagtatcatcctcaacttctcaaggattacatgaatgggactgagaaaacaaactttctatatcctagtgctgttgacaatttccgaaggcaatttgcaaacttggaggaaaatggaggaaagagtggggcacacgccgcttcatcagacaggaagcatgtttcgctcccaaggacaaccacagttcattctaatccaatccctccaaatggaacctcccaagttcctcaaaagattcccacaggtagaccaggaagagtggttggtccagtaataccatttgagaacgcagctgcagttgatccatacagccaacgtagggtctcaaggaatccagtacttcctccaaccacgtcgaacatgtcagcctatgcctaccaccggaagtcagacaactcagacagagagctccaacaggagctggaaaaggaccgcatgcagtaccagccagcacagcggttcatggacgccaaggtagtatcacagatgtcccctgacttgaggtcttcctactacataccaaaaggtgtcccaaaggctgatcccgcagatagaaccgctctgcattctagcatgattcatgggatcgcccctttcagtggcattgcagctgttggaggtggctacaacaaggtcaatgcagttcagtatggagtttctaggatgtactagttctagttgcattggccatctccgaattcctcagctgatgagttgaagtaataacatggcgaagaccagatgtaggtaccgaagaactgccataccggctctgagccaaagatagaaaacatggaatacggatctcggatcgaggacgtgtccgtcagattgaaaacagatactgggcagcagtcatggttctgtccattggacctagcttttcgggaagcaatgccatcgccccgcggaaacggtaaaataaaaggagaaaaaaaaatgcagtactgtcagttgattgctgcttataaagaagcaaagggggcagagacgacgatttttacaggtaaaattatgtactttgcaaggagggaaacatgtgggaataagtagtgagcctacgtttagctctgtatataaagtgacttgattttatatgtactattacggctggtgaaacacgcttctttaattcaaagctatggagttttggcctaaataccataggcagctcagattgatacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggttttgggggttaaaattttattttggggtgtttggaagttattattttttttatggg

SEQ ID NO: 2826 - DNA, 312 bp, Zea mays
  Clone ID: PAT_MRT4577_8668C.1
ggaagccacaagcatatggccatgcaagacactggtttgcactataaattattctggttacataaaaacttttaaaaaaataaaaaacgggtcccagtaaaaagctccaggggatagcctaagggttcaaagacccatcaaaattcaatttggtgacttgcctgaaaccaggggggggtttattggttattatgttccacagttccgggttcagcttctccgaaaaaaaaagagatctctctgtttggagattttggggaatccgaaccatgcccgcattttttttcagagtccaccccacacattgtttta

SEQ ID NO: 2827 - DNA, 441 bp, Zea mays
  UNSURE (1)..(441): unsure at all n locations
  Clone ID: PAT_MRT4577_86803C.1
  unsure (1)..(441): unsure at all n locations
ttattatccccctctagatatttctttatttccgtgatcctccgcctccttgttgatccccccaagncagggatcttcatgtctgactcggaggagcactacttcgaatcgaagaccgacgccggagagttcaagacctacccgtagcaggctgacaccgtccgtaagaacgacttcatcgtgatcaaaacacgcccctgcaaggctgtgcaggtttctacctccaagactggtaagcatggccatgataaatgccactttgttgccatatacatattcgacgggaaaaagcttgaagattctgttccttcatcacacaactgagaggttccgcatgcgaaccgtactgagcacacggtgattgatatatctgaggatggccttctgagccttcttacttcggatgtccacactaaggatgatcttacactcgcaagtgat

SEQ ID NO: 2828 - DNA, 325 bp, Zea mays
  Clone ID: PAT_MRT4577_86949C.1
acagcccacgcgtccgcgcacgcgtccgctgctacccccaatttttgcatcagatgagagcacttcttgttcacaatggaacacagccatggaaaaacgtacacgatggacaagacaggaagttgtcggtaactttcgtattggagatgtgtttggaaattgttgtcgactcaacggcctacatgcattgacatagttcacagttgtcactcacaatgctatagaccgacatgattctgagaagttccctttctcaattttcgacaagaatggcaagtagtgtgcatgccttatcgactgccaccacactgagcaacacggatgg

SEQ ID NO: 2829 - DNA, 1384 bp, Zea mays
  Clone ID: PAT_MRT4577_87182C.1
gtatattctatctccacctgacctccctccatcaagatgttccttgaaaacacggtcaaaagcacggcagaggtccagtatggtgtccagttgagcccctggatcagcagccacagctctccttatgatgtccagctctgattcaagttcgtctatagttttgttgattgtcgctgtgatactaggaatgtgtgctttgataacagattcaagatgctgagaaagaagcttagcaagatatccagaacccatacgacttgataaatgagcatagtcaggacttgtttcaaaatattccctttctttttccctcgctgaaatcatgtcaaccttcctattaatatctgcttgtgagcgattgacgattccaacccaaggattctgcagccgataggctcttccctcaagaacatcgagagcatttgttcctttgtccattaagtccagttttgtcaacacaccgaacgtcctttcacctgttggatcaacttcttttgagagcttaattgcatcagaagttgcaatatcctgatttgctggagatatagccaaaataatacagttgggcttatcaacatatgagcgaaccatattctctatatcttgcacaatactttcagattgtccctctacagcaacttttgtcaacccaggaagatcaatcattgttaagttcacaaccttgggcgagtagatgctgagatgaatagggacaggagatatttgcttagtttttccagtcagcctatccgtctcatcagcaatttcttggcgaacaagggcaaagtctgaaaaccttcttttgggcatatgcaagaactctgcatattcctgagatccatcctctgtctgttgcagctgcaacactaaaggccttcgcgtgacaattcccgatcctcggggaagaaaatcggtgccaacaatgctctcaagtacagaggacttgcccgagctctggcctccgacgacggcgatggttgggagcgactcccagagggtgggcaagtcgcttcctcctccgtggtctccgagggcggtgcaggcgcgctggatgcggttcatcatcccgatcaggctctccatggacgccatactcttgttgacttgcttgccaagttcgccggttttccagtatggtcgggactattccgttgcgtttgtgtggggaagaagaggagccaaggacgactgactggaagagcaaggttcgaagaaacagagtcggccggaaagaaagaaaacctcctagcgaaggaagccaagccattccaaggacggcgacgacttccggtatccagaagaggacacggcggagctttgaattctccacggggagaggcaaggctgggtccacatatgttcgttcagccgcccaagatcccgg

SEQ ID NO: 2830 - DNA, 390 bp, Zea mays
  Clone ID: PAT_MRT4577_87375C.1
agacctcctgtgccggcacgcgctgacactgcatgtcggcatgcagatgttagtctaccacatcgtgggcggcacgctgatggcgcgccagctctggacctccggcgtgggctagatgtcgcgatccaacgcctgggtgctggcgctctgcatctgcctatacttcgcctggttagcctggtcgtggaggccgctgggctggctcatcccttcggaggtgttggtgctgtaggttcggtcggcggggcagagcatgcgcctgtgcgtcaacaggctgctgaccttcatgatcggccatgccttactcagcatgctgggctcgctcaagttccggctcttctacgtcttacccgggtggatgttcattatgaccaccttcaatcgccattt

SEQ ID NO: 2831 - DNA, 544 bp, Zea mays
  Clone ID: PAT_MRT4577_87463C.1
ggccgcttttttttttttttttttggaagggtacttattgattaatgggaagccacagacataatgcaaaaaacggcactattgtactataactcataagcaatctaaaagagggcaccaccaatgatgggtcgctggcagaacactggtgggtttgccaaagcaagctgattgaatggcagtaattgatgcagctgtatgagggggccagcgttaggcatagcgagatggtagaacgggaacaactgacgctgtgtcaagaaggcaggagggttcacatcagttagttggctgaatggtagtagttggtggtggtgttaataagcagcagagctaaatgctgctagtgggttgaatggaagaaattgttgggggtaggcagcaggtacctggctgaatggtactggttgctgcaaataagctgcacaggtcaatgcagccagctgcactaatggaagaaactgatgttgcttgagagtatgcagcaaggtttgctagcacacggtgctgaagcctgagtgccctgatgtactgtgccaccaaa

SEQ ID NO: 2832 - DNA, 2197 bp, Zea mays
  Clone ID: PAT_MRT4577_87571C.1
aaaaaaaaaaaaaaaaaaaaaaaaaaaaaaaaaaaaaaaaaattttccttggccttctctagatctttcaagctatccttggcttcctagctccctttggcgtgctgtaccggacgacaggggtaggtaggtaggtaggtgtagctagctcggcgagcgagggagcaatccggccaacagcacacgcgtcgatcgccatgccgagcagcgactcatgacgatcctcagacgatgatgatgctgagcaagtcgtgctcgctcaccgacctcctcgacagcatcgactacgcggcgctctcctcgcagatgctcctcctcgacgcgccccacccccacgctccctcctcgtcgctcctataggtgggtggccccctcgagccggcgggaaaatttcaatgcctctctagatctttcaagctatccttgcttcctagctccctttggcgtgctgtaccggacgacaggggtaggtaggtaggtaggtgtagctagctcggcgagcgagggagcaatccggccaacagcacacgcgtcgatcgccatgccgagaagcggcggcggcggcaatggcggtggcattagtagtagtagtagggtgatgcccaacctcccggccgggttccgcttccaccccacggacgaggagctcatggtgcactacctcatgaggcaggccgcctccatgccgtgccccgtccccatcatcgccgaggtcaacatctaccagtgcaacccctgggatctccctgccaaggcattgttcggcgacaaggagtggtttttcttcagcccccgggaccgcaagtaccccaacggcgcccgccccaaccgcgccgccgggtccgggtactggaaggccaccggcaccgacaaggccatcctgtcgtcgtccacgcccacgagccacggcggcgccaacatcgtcgtcggcgtcaagaaggcgctcgtcttctacggcggcaggccgcccaagggcaccaagacggactggatcatgcacgagtaccgcctctcgggcgcggcggacgacgactgcaagggcagcaccaggcgcagagtgtcttcctcctcgtcgtcctccatgaggctggacgactgggtgctgtgcaggatccacaagaagagcaacgatttccagttgtcgtcgtcgtcggagcatgagcacgagcaggaggagccggcggcgggcggctcagcgacgactgtggaggaactagacgctctcgtcgtcgtcgacaacagcagcagcagcgacaccaccaccaccaccatcaccaccaacgacaacaactctactgaaacagctgcgactcatcacgatcctcagacgatgatgatgctgagcaagtcgtgctcgctcaccgacctcctcgacagcatcgactacgcggcgctcctcgcagatgctcctcctcgacgcgccccacccccacgctgatgacccgccgccacacatggtctactacccaccggcggcgtcggcgacgcaccagcaagcaataatagctaataacaccaacagtaatgacgactactatgacgacgacaacttgttgccgactgctgctgctactgcggtagacgcggcggcggcggcggtgctactcagctcgtcgcctgcagacaccaacggtgtgaacaagtcggagcgagtgacggccgtggactactacggcgccgctgaaccgccgaccttcttccaccaccacctcgatgatggcggcaacagcttcttcagtacgaccaagaagctcaagccgccgccgccaagtgattcgaggcatggcggccatttcggcaccgccacagcgagcagctaccgcgacagccagcagctcgtggacagcgcgagcagcagcggcgtcttcttccatcagtatgggtacggctacagcagcagcaacccgttcttgaacttgaaccagcagcagcagctgctactcaacagccacatcgggatgcagtagagctcgagagatcgagagagagagagagagagagatgatatatcattggaaggatcagcacgcgtacgtgcagattaattgcagcgagttctatcttgtttgctttcattattatatactccgtatgtgtcgttcatgtaaaattagtttaaattgtaaattagtgtgctgaaattcatgtgcctgctctctgctcatcaatgaatggatgatgacgacccatgcacgtt

SEQ ID NO: 2833 - DNA, 828 bp, Zea mays
  UNSURE (1)..(828): unsure at all n locations
  Clone ID: PAT_MRT4577_87573C.1
  unsure (1)..(828): unsure at all n locations
cattgggaccctcgaggccggccgggaaatttcatgcctctctagctagatctttcaagctatccttgcttcctcctttcactttcttattgagcgctctctggcgtgctgctgtaccggacgacaggggtaggtaggtgtagctagctcggcgagcgagcgagcaatccggccaacagcacacgcgtcgatagccatgccgagcggcggcaatggcggtggcagtggcagtagtcgtagtagagtgatgcccaacctcccggccgggttccgcttccaccccacggacgaggagctcatggtgcactacctcatgaggcatgccgcctccatgccgtgccccgtccccatcatcgccgaggtcaacatctaccagtgcaacccctgggatctccctgccaaggcattgttcggcgacaaggagtggtttttcttcagccctcgcgaccgcaagtaccccaacggcgcccgccccaaccgcgccgccgggtccgggtactggaaggccaccggcaccgacaaggccatcctggtcgtcgtcgtcgtcgtccacgaccacgagccacggcggcgcccaacgtcgtcgtcggcgtcaagaaggcgctcgtcttctacggcggcaggccgcccaagggcaccaagacggactggatcatgcacgagtaccgcctctcgggcgcggcggacgacgactgcaagggcagcaccaggcgcagagcgccttccctcctcgtcgtcctccatgaggctgggacgaactgggtggctgtgcaggatccacaagaagagcacggatttccagnttgtcgtcngtcgtcggagcatgag

SEQ ID NO: 2834 - DNA, 2073 bp, Zea mays
  Clone ID: PAT_MRT4577_87628C.1
cattgggtacctcgaggccggccgcaaccgcgcatctcccccccgccggggtcttccccgacccgcgtttctttattatattttcccccaaattccacctccaccaacctcctctcccaccaccgcccccgccgtcgcctgctgttccatgaaggactaatccgtcggtccacttctcagctatggcgcagctcgcggtgcggtcgctgctgctgtccctgctcctggtctcgccagttgtggcttcacctggtattgtgaagctcaactcgtcgtcgaccctcttcggcatcgagttcccgccgttcaacaccgccgtcgccgcgaccggctgcgacagcaagctggttgcagccgacgaggcgggggatgagcagaagcagccggcgagctcgtccccgtcgctgcagctgcgcatgaagcaccggtccgcggaggggggcaggacacggaaagagtcgttcttagataaggccgagaaggatgccgtccgcatcgagacgatgcaccggagggcggcgcgctccggcgtggcccggatgccggcgtcttcgtctccgcggcgggcgctgtcggagcggatggttgcgacggtggagtccggcgtggcggtcgggtccggcgagtacctgatcgacgtctacgtcggcacgccaccgcggcgtttccggatgatcatggacaccggcagcgacctcaactggctgcagtgcgcgccgtgcctggactgcttcgagcagcgtggcccggtgttcgaccccgccgcgtcctcctcctaccgcaacgtcacctgcggcgaccagcgctgcggcctcgtggcgccgcccgaggcgccgagggcgtgccgccgccccgcggaggactcctgtccgtactactactggtacggggaccagtccaacactaccggcgacctggccctggagtccttcacggtcaacctcacggccccgggcgcgtcccgccgtgtggacggcgtagtgttcgggtgcgggcaccgaaaccgcggcctcttccacggcgcggcggggctgctggggctcggccggggcccgctgtcgttcgcgtcccagctccgcgccgtgtacgggcacaccttctcgtactgcctggtggagcacggcagcgacgccggcagcaaggtggtgttcggggaggactacttggtgctggcgcatccgcagctcaagtacacggcgttcgcgcccacgtcgtcgccggcggacacattctattacgtgaagctcaagggcgtgctggtgggcggcgacctgctgaacatcagctcggacacgtgggacgtgggcaaggacgggtccggcggcacgatcatcgactccggcacgacgctgagctacttcgtggagccggcgtaccaggtgatccggcaagcgttcgtcgatctcatgagcaggctgtaccctctgatcccggacttcccggtgctgaacccgtgctacaacgtctctggcgtggagcgaccggaggtgccggagctgtcgctgctgttcgccgacggtgccgtgtgggacttccccgcggagaactacttcgtccggctggacccggacggcatcatgtgcctggcggtccggggcaccccgcgcaccggcatgtccatcatcggtaacttccagcagcagaacttccacgtcgtgtacgacctgcagaacaaccggctgggcttcgcgccgcggcggtgcgccgaggtgtagtgtatagccgccggcgaggcctcctgagactgagaggacgaacaattcgaactcagtcctcgcttgattgattggattgggaggcaaattgggtgtagaaatttttggttgggaaggacggtggcacgtacgcaagctctaatacatagttttttttgttgcatttatctccaaggagagaaggttagggatattttattaaggaccgtgcaggtgggttgtaacgggaaaatactgattttgttcccatgtacaatacccgtttcttcactcaaattttagaaattgtaagttgtagattaagaatgagagtgcacacaatcttttttaaaaaaaaaaaaacgtcgaccaaggaaaa

SEQ ID NO: 2835 - DNA, 401 bp, Zea mays
  Clone ID: PAT_MRT4577_87657C.1
ggcaatcgcagctggcatgttacctttatcacccttgttgctgcaacaatcatcagtcctattacaacagttacctggggcgcattgattggcacaaaacataatggcacagcaactacaacaacttgagctagcaaaccttgctggctactcttagaaacagcagactattccattcaaccaacttgggtcatggaactctgcttgttatgtgcaacaacaacaactaccattcagccagatacctgctggctaccgccagcaatttacttccatcaaaccaaatagcaggattgaactttcctgcttatatacagcagcagcagctactaccattcagccagctagctggtgtgagccatgatgccttcttgacacaaccacaggtggtgccgtgctac

SEQ ID NO: 2836 - DNA, 1093 bp, Zea mays
  Clone ID: PAT_MRT4577_87713C.1
gcttttgctcctgtatcagcgcacagtgatgcatctctcctggagtctcaagaagcacttgatgtctcctcaacactgtctaatgaagaggacgagagggcaacacatggcactgtttctatagagtgtgatggtgatgaagctgagactgtatctaaaagaaggaagctggaactagatgctttagaagctactcttactgctactacctccaccaccagtaccatcgacatggggcctgcagcctcaagagctgtccgggagcctagggttgttgttcagaccacaagtgaggtagacattcttgacgacggttatcggtggcgcaagtatgggcagaaggttgttaagggcaatccaaatccaagtgcgcaagcatgtggaaagagcatcgcacgatctgaaatcagtcatcacaacgtatgagggaaagcacaaccatgaagttccagcagccagaaatagtgggcaaggcagttccagcgctccatctgcatcacaagctggtggttctcaccgtaggcaagaacctgcacaggccagctttgctcacttcggtacggcttctttcagctcgttcggtctcccaccgagtggtcagttgggaccaacaactggcaatttcggcttcgggatggttcccccaggcatgacgatcccagtgccctctctaggatcgcttgcccctgtaaagatggttggaaattcatcagctatgcaggggtacccagggcttatggtgccgggagaaccaaaggtagagcctgtctcgcaaccactcatccaaatggcaaatgcatctccaccagcttaccaacagatattgagcaggcctcctttcggtcaccagatgtaaataataggaaagagaaaggggataatagatttgcttcagcttgtatacatgatagctacgctgcaacatggctttagtgttcatggatcgtccaattttttatttctattttatttttctgcccacgcatgtctttgaagcaaagaatgctgaggatgataccctgtcgtgcctgttgtaatcacgtaaaggatacctttcgtctttttgagactcgaaattggaaaacgatcaatc

SEQ ID NO: 2837 - DNA, 1340 bp, Zea mays
  Clone ID: PAT_MRT4577_87716C.1
tgccaccccttccttcccctaatcccctcctcggtcaaaccgcctcactctcctactcttctctccctagtccctacccggctctctccctcccccctctctctaaaaaaagtagcgcccggagaaccgagaggctggagaaataaaggcggaaagagggagggaaatctcactttgttggggattctttcctccgtttccgactcctttgttctcttaagtgttcttggttagtggaatggaagctcagcagccccatttatgcccccgagagcctcgtcgttcccctcgtgtgtaggtgtagcctttcactcggttggtggaagggcgaggcacagaagaacatcgataaagggtgtgtctattttttagctcttcgtgttcttgtaggaggaattcccgttcacatgatccgtgcctgcatcctcaagagctgtccgggagcctagggttgttgttcagaccacaagtgaggtagacattcttgatgacggttatcggtggcgtaagtatggacagaaggttgttaagggcaatccaaatccaaggagctactacaagtgtacacaccctggctgttcagtgcgcaagcatgtggaaagagcatcacatgatctgaaatcagtcatcacaacatatgagggaaagcacaaccatgaagttccagcagccagaagtagtgggcaaggcagttctggttctggcagcggtccatctgcaccacaagctggtggttctcaccgtaggcaagaacctgcacaagccagcttcgctcactttggtacatctcctttcagctccttcggtctcgcaccgagcggacagttgggaccaacaactggtaatttccgcttcggcatggttccgccaggcgcgacgatcccaatgccctctctaggatcacttgcccctacaaaaatgattggaaatccatcagctatgcaggggtacccagggcttatgatgccaggagagccaaaggtagagcctttctcgcgaccacacttcccaacgtcaattgcacctccgccagcttaccaacagatactgagcaggcctccttttggtcatcagatgtaaataataggaaggggatagatttgctccggcttgtatacatgatagctacgctgcaacatggctttgttctagttttgttgatggatcgtccgatttttacttctttttaaattttcagctcacggctcacgcatttctttgaagcaaagatggctgaggatgataccctgtcgtgatgtgtaatcagggaaaggatacttttcgtccttttgatactatcgaaatttgaaaatgatcaatccgattttttagttgtggat

SEQ ID NO: 2838 - DNA, 1026 bp, Zea mays
  Clone ID: PAT_MRT4577_87719C.1
ggtccggaattcccgggtcgacccacgcgtccggtaaccatttaagacttgatgcagacattgtactgaattcgctggtactctttttcaggaagttggaattagatgctttaggagctattgctattgctactacctccaccaccagtaccattgacatgggccctgcatcctcaagagctgtccgggagcctagggttgttgttcagaccacaagtgaggtagacattcttgatgacggttatcggtggcgtaagtatggacagaaggttgttaagggcaatccaaatccaaggtcacactttcactaccatttcttacactaaatgactaaactgtatccctccatcccctgaagctagtaacattgattcacttgcatgcaggagctactacaagtgtacacaccctggctgttcagtgcgcaagcatgtggaaagagcatcacatgatctgaaatcagtcatcacaacatatgagggaaagcacaaccatgaagttccagcagccagaagtagtgggcaaggcagttctggttctggcagcggtccatctgcaccacaagctggtggttctcaccgtaggcaagaacctgcacaagccagcttcgctcactttggtacatctcctttcagctccttcggtctcgcaccgagcggacagttgggaccaacaactggtaatttccgcttcggcatggttccgccaggcgcgacgatcccaatgccctctctaggatcacttgcccctacaaaaatgattggaaatccatcagctatgcaggggtacccagggcttatgatgccaggagagccaaaggtagagcctttctcgcgaccacacttcccaacgtcaattgcacctccgccagcttaccaacagatactgagcaggcctccttttggtcatcagatgtaaataataggaaggggatagatttgcttcggcttgtatacatgatagctacgctgcaacatggctttgttctagttttgttgatggatcgtccgatttttaaaaaaaaaa

SEQ ID NO: 2839 - DNA, 2473 bp, Zea mays
  Clone ID: PAT_MRT4577_87724C.1
ccgcgaggcctgtggggccgggcaaccgccggccgctcccctactcttctccctccctccccgtctctctctctctaaaaaaagtagcgcccggagaaccgagaggccggagaaagaaaggcggaaagagggagcaaaatctcactttgctgggagttctttcctctgtttccgactcctttgttctcttagtgttcttggttggtggaatggaagctcagcagctccatttgtgttccagagatcttcgtcgttctcgttcccctcgtgtgtagcctttggtaggttggtggaagggcgaggcacacaagaaaattgatagaggggggatccccattttcagctcttcgtgtttttttgtaggaggaattcccgttcacatgatccgtgcctggacgtgacggttttgccgcgctctgctgcttccctttcggggagaagaggactcgactcaaatcatttggtatcgcagacgtcgcccttcccagttcagttgagagagatttctggcatgtccggcgcaagtaactatggatccctcatcgatgaatggttgccgccccctacacctagcccaagaactctcatgtctagctttctgaatgaagaattcagctctgcgccattctctggtccccatgatcaatctgaaaagagcagagaagttttgaattcgagcgatgaggttccttcacatgctgtcaaaggcctatttcaaaatggtttctcaaatttgttcagtgctaaatcaaactccaatggtggtttggcggagcgcagggctgcgagagcaggtttcagtgtcccgaaaattgatacttctcgagttggttcatccacagttattcgatctcctgtgtcaattccacctggtctaagtccaactacacttcttgagtctcctgtttttctttacaataaaatggcacaaccgtctccaaccactggcacattgccatttttgatggctacgaatgataagtcaacaatatcaccagctgccaagataactgaagattctacatttgataatgatgtgttttctttccaaccccacttaggttctgaacaaacagggttctctactgcagaaaaaaaaaaaagaaaaagtccgaaaaagcagtccttgtcgaatattcatcagcaggaatccagtcttcagtcaagctttaccgcagtcaaggataacactagtgcaacaattgttaaagcgaagccatcttctagttccatgttcagtgatagtcactattcagctgaccaacagcaagctgacgagacaaacataaaggtgcaaggcaaaggtgtggaggctagatcagctgcttttgctcctgtatcagcgcacagtgatgcatctctcctggagtctcaagaagcacttgatgtctcctcaacactgtctaatgaagaggacgagagggcaacacatggcactgtttctatagagtgtgatggtgatgaagctgagactgtatctaaaagaaggaagctggaactagatgctttagaagctactcttactgctactacctccaccaccagtaccatcgacatggggcctgcagcctcaagagctgtccgggagcctagggttgttgttcagaccacaagtgaggtagacattcttgacgacggttatcggtggcgcaagtatgggcagaaggttgttaagggcaatccaaatccaaggagctactacaaatgtacaaacccgggctgttcagtgcgcaagcatgtggaaagagcatcgcacgatctgaaatcagtcatcacaacgtatgagggaaagcacaaccatgaagttccagcagccagaaatagtgggcaaggcagttccagcgctccatctgcatcacaagctggtggttctcaccgtaggcaagaacctgcacaggccagctttgctcacttcggtacggcttctttcagctcgttcggtctcccaccgagtggtcagttgggaccaacaactggcaatttcggcttcgggatggttcccccaggcatgacgatcccagtgccctctctaggatcgcttgcccctgtaaagatggttggaaattcatcagctatgcaggggtacccagggcttatggtgccgggagaaccaaaggtagagcctgtctcgcaaccactcatccaaatggcaaatgcatctccaccagcttaccaacagatattgagcaggcctcctttcggtcaccagatgtaaataataggaaagagaaaggggataatagatttgcttcagcttgtatacatgatagctacgctgcaacatggctttagtgttcatggatcgtccaattttttatttctattttatttttctgcccacgcatgtctttgaagcaaagaatgctgaggatgataccctgtcgtgcctgttgtaatcacgtaaaggatacctttcgtctttttgagactcgaaattggaaaacgatcaatcaaaatttctggttgcgaatgc

SEQ ID NO: 2840 - DNA, 216 bp, Zea mays
  Clone ID: PAT_MRT4577_87804C.1
gaaacaatcaaccagcaacactcctctcctataacatagtacagcgaaagtaactcacattggaacttccaatgggtgtctcggcctggtcctgccttgcttcctctcctcctcccagtgccgtccctgtggcacccatgggtggcttgttcccacagttctaagaccattcgtgccccaaagcgaaggaggatgtgcagtcaattgtggcacagg

SEQ ID NO: 2841 - DNA, 699 bp, Zea mays
  Clone ID: PAT_MRT4577_87810C.1
tcgagccggccgggttacttcctggtggctacaggccgtttcagaaatgaccaacctgggtggcgcaacaattgcacctcctggaggaatgatgatggatgggccacctacacccatcgtgaagactcgcttgtgcaacaagtacaacactgcagagggatgcaaatggggggacagatgccactttgcacatggtgaaagggagcttggcaagtctatgatggacaactatatgccaccccccatcggaccaccaccaaccggttattttgcacctccacctatggcacctccacctatggcgcctccacccatggcacctccacctatggcgcctccacccatggcacctccacctatggcgcctccacccatggcacctccacctatggcacctctacctatggcgcctccacccatggcacctccacctatggcgcctccacccatggcacctccacctatggcgcctctacctatggcgcctccacccatggcccctccacctatggcgcctccacccatggcacctccacctatggcgcctccgccaatggcacctccacctatggccaaccctggtttggccactccagctagcttcggcgcttatgccacggccaagatcagtgtcgatgcgtcccttgcaggtggcatcattgggaagggtggagctaacataaagcaaatatcttccgt

SEQ ID NO: 2842 - DNA, 1413 bp, Zea mays
  Clone ID: PAT_MRT4577_87811C.1
aaaaccggacgctcctgggcgccgctgttcgcaacccaagcagtagccgagccaacgaaggcgtgcgagcggaggcaatcatacatggacggcagccgcaagagggtggacgcggaagacgtcaaaggggattccaccggcgggaagcgattgcgagcatcggagtcatttcaaagtggcgtaggaagcaaagtgaagctatgcaccaattttttcagtacttatggttgtccctttggtgagggctgccattttgtccattacttccctggtgactaccgggccgtttcagaaatgaccaacctgggtggcgcaacaatcgcacctcctggaggaatgatgatggatgggccacctacacccatcgtgaagactcgcttgtgcaacaagtacaacactgcagagggatgcaaatggggggacagatgccactttgcacatggtgaaagtgagcttggcaagtctatgatggacaactatatgccaccccccatcggaccaccaccaaccggttattttgcacctccacctatggcacctccacctatggcgcctccacccatggcacctccacctatggcacctctacctatggcgcctccacccatggcacctccacctatggcgcctccacccatggcacctccacctatggcgcctctacctatggcgcctccacctatggcacctccacctatggcacctccacccatggcgcctccacccatggcacctctacctatggcgcctccacccatggcacctccacctatggccaaccctggtttggccactccagctagcttcggcgcttatgccacggccaagatcagtgtcgatgcgtcccttgcaggtggcatcattgggaagggtggagctaacataaagcaaatatcttccgtcacaggggccaaggtggtcattcaggaggaccgccatgaatcagacaccagcttgaaaaacattgagtttgagggcacctttgatcagatcaggaacgctagtgctatggtcatcgagctgattgttagcatcagtggcataggaagcaacttcaagaccaagatgtgtgagaacttcgcaaaagggtcatgctcttatggcggcaaatgccactttgcccatggtgagagtgagctgcgcaagcctgccgctgcttgagatccatgccctgtttcttacctcatagtcattagtcaatgtaactcaaaacttggcctctgatgatggatttgttggcttctttaggtctacgctaatgaattgctggcttcaggcctactactaaatttgctgacttctttagtccttcgctgttggccaactaaatctgttttctgcgtttgttctaaggggggggggggggggggggggggggggggggggggggggggggggggggggggggggggt

SEQ ID NO: 2843 - DNA, 201 bp, Zea mays
  Clone ID: PAT_MRT4577_88005C.1
tcggccatggcgctttttgtggagaagaccttgtctggaccggagtacaaggtcaaggatcttttgcaggcggacttcggtcgccttgagattgagctggccgaggtcgaaatgcccggccttatggcgtgccgcgcccagttcggcccgttcaagccctttgccggcgctaggatcttgggggctttttacatgacccat

SEQ ID NO: 2844 - DNA, 474 bp, Zea mays
  Clone ID: PAT_MRT4577_88118C.1
ggtctttctgcaagtgctgataccgcagccatttttgcacaatgctcacaagcttctatagctttctttgttgccccatacctataaccagcggtgttttcagtatgtgaaaacccaattcttcaaccgtacaggatccaacaggcggtggcatcgggcatcttaccttgatcagcctagctcctgcaagagcggtcagacctattacaggagttacctttggtgcatacgtgggcacacaacatcaaggcacaacaactacaacaacttgtgctaggaaaccttgctgactactctcagaaacagcagtttcttgcattcaaccaactggctgcattgaactctgctgcttatttgcaacaacaactaccattcagtcaggtagctgctgcctacccacagcaatttcttccattcaaccaactggcagcattgaactatgctgcttatatacaacagcagcagctaccacca

SEQ ID NO: 2845 - DNA, 325 bp, Zea mays
  Clone ID: PAT_MRT4577_88143C.1
ctttccttttttttttttttttttttttttttttttttttttttttttttttttttgggaaaaaacaaacttttttcataaccaaaatgggtccacagttttttttccatacctacatgctcttgtggggggacgcatcttgaccccctaaagctgcttacttacttattcagaccgatccagcggggggcaccctgggaagttcacatgcttacggacgacaaattttcataacaatagctggggtggggtgcttcacagaaaacccaaacgacacccccgaaattgcgacgatttaaaatcccacccgtccgaggccccgtgg

SEQ ID NO: 2846 - DNA, 449 bp, Zea mays
  Clone ID: PAT_MRT4577_8821C.1
tgacttccagaggtgcctttggtgcatttatatggcgcaaaaatgagggcacaacaactacaacaacttgtgctagcaaaccttggtgcctacttttagcaacaggagtttcttccattcaaccaacttgggtcattgaactctggttcttatttgcaacaacaacaactaccattcagccaggtacctggtggctacccccagcaatttcttccattcaaccaactagcagcattggactctcctgcttatttacaggagcaaccactactaccattcagccagcttgctggtgtgagccctggttcctttttgacacaaccgcagttggtggcggtctaccaggacggtgggcctaaggcttgcccccttttacaactgtaacaattgctggcattgaagcaacatggtttggcaaaaccagagggtggtaccgacgactcatcaat

SEQ ID NO: 2847 - DNA, 453 bp, Zea mays
  Clone ID: PAT_MRT4577_8822C.1
atggagcctaagggtggcacaacgtctagcaacacgccatctatgacgcatgaagctgcccttgtctacagcattgaggacattcgacccgtcaggggcctgaagaagatccagcctgctacttactccaactgcacgaagaatccatgctgatgtcgcttgtggcgtcctcattctagtagtacaggatttcttttctgacactcagattctgaccaatcactctggcctgctgcttcctgatgatagaccagcatacccattcttgctcattgcactacttcctccatctacagcattgggttctgatccacctgctccaatggctgctcttactgctgctgatgcttccccgggctcagatatcgatggtgagggctatgagaatcgccttgagatcacattttgtgatgcacctgtctttgctgaccctcatgggcgtgggttgcgtgc

SEQ ID NO: 2848 - DNA, 2132 bp, Zea mays
  Clone ID: PAT_MRT4577_88255C.1
gcacgagcgtgtctccatttcccgcagcagggcccattggaagtttggaattggaaacccaaaaagcataggcgggggtggcaggggaagcacggagcaagagattcgtttgctgccattattaaccgagccgagccgagagagggcaagcaacggacccccattcgcatccgcctccttttccttggagccgaagaagagggaaaggaagggaggacagccgccgccgccgccatcaccaccgtcaggatgcattccacgaacctcctgctcgaggagcccatccggatggcctccatcctcgagccctccaagcccagctacttcccggcgatgaccaagatcgtcggcactctcggccccaagtcgcgctccgtcgacacgatctccgcctgcctcaaggccggcatgtccgtcgcccggttcgatttctcgtggggggacgccgcgtaccaccaggagacgctggagaacctcaagctctccatcaagtccaccaagaagctctgcgctgtcatgctcgacaccgtgggcccggagctgcaggtggtgaacaagagcgagaccccgatctccctcgaggagaatggcacggtcgttctcacccctcaccggggccaagacgcctcctccagcttgctgcccatcaacttctctggactcgccaaggcggtgacaccaggggcaacaatattcgtgggacaatacttgttcactggcagtgagaccacctcagtttggttggaggtttctgaagtgaaaggagatgatgtggtgtgtataatcaagaacacagccaccttggctgggtcactgttcacgctgcattgctcccagattcacattgacttgcccaccctgtctgatgaggataaggatgtcattagaaaatggggtactcccaataagattgacttcctttctctgtcctacacaagacatgcagaggatgtgcgccaggcacgggaattcctgtcaaaattgggcgatctaagccagactctgatttttgccaaaattgagaatgtcgagggcctgaaccaatttgatgaaatactggctgaggcagatggtatcattttatcaagagggaacctgggaattgatcttccacctgagaaggtctttttgtttcaaaaatctgctcttcacaagtgcaacatggctggaaagcctgctgttgtcactcgtgttgtggacagtatgactgacaacctcaggcctactcgagcggaggcaactgatgtggccaatgcagtacttgacgggagtgatgccattctccttggtgctgagactctccgaggtttatatccagttgagactatttcgacagtgggcagaatttgtgctgaggctgagaaggtattcaaccaagatttatacttcaagcaaactgtgaaatatgtcggagaacccatgacccatttggagtccattgcttcctcagctgtgcgagctgctatcaaagttaaggcttcggtgatcatttgcttcacctcttctgggagggctgcaaggctcatcgccaagtacaggcccaccatgcctgttctttctgttgtcattcctcgtctgaagacaaaccaactgagatggagtttcactggtgcttttgaggcaagacagtcgctgatagttagaggcctctttccgatgcttgcagatcctcggcatccagccgaatcaaccagtaatacaaatgagtcagttctgaaggttgctctagaccatggcaaggcatgtggtgtgatcaagtcccatgaccgtgttgtcgtttgccagaaggtgggagattcatcggttgtgaagatcattgagctggacgactagggcatactttgccgatttttttttttgacgaggccggaatttgttggctatatgtataatcctatagctttctttacaaatgagcagtttttccctatggtgccacatcataggacttgcttagcgatttaaaactcgattatgtgccacctaaaatgggcagatggaacaatgaaatcatactgtgccctttatccgttgctattgttaaactaaaaaagaaaatttaaaaactcaagactagttctctcctcgtgcaaaaataaagggcgtcataaaaaaaaaaaaaaaaagcggcc

SEQ ID NO: 2849 - DNA, 2477 bp, Zea mays
  Clone ID: PAT_MRT4577_88257C.1
ggtaccctcgcgctccggccggggcaccgtggcgttgctgttttattcgggtacagaacacccattggtttggatttggaagccatcaccaccaccacctataataaattgcacgagactcgccgcgggccggcatctccatcccgcatcgcgcatcgcatccaccgccgagctttctttctttctttcttttttctgggagaagaggaagaagaggggaggcgcgacaaaaagggcgccgcgcccccgcatcgcccccgacgccggcatctctccctcgctctccttctcccgatctgatccgaagcgcggcgtcgacgacgacgacctaagggcacgatgcattcgaccaacctgctgctggaggagcccatccggatggcctccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctaccaccaggagacgctcgagaacctcaagctcgccatcaagtccaccaagaagctgtgcgctgttatgcttgacacggttggaccggagctgcaggtggtcaacaagagtgaaacccccatctccctcgaggagaacgggactgtcgtgctcacgccgcatcagggccaagaagcctcctccaccttgctgcccatcaacttcgatggactcgccaaggctttgacaccaggtgcaacgatatttgtgggccaatacttgttcactggtagcgagactacttcagtttggttggaggtttctgaagttaaaggagatgatgtggtttgtatcatcaagaacacagctaccttggctgggtcgctcttcacgctgcattgttcccagattcatattgacttgcccacgctgtctgatgaggataaggatgttatcaaaaaatggggtgctccaaataagattgacttcctctctctgtcttacacaagacatgcagaagatgtgcggcaggcacgtgagttcctctcgaaattgggtgatcttagccaaactcagatctttgccaaaattgagaatgttgagggcttgaaccattttgatgaaatactggcagaggcagatggtatcattctgtcaagaggaaaccttggaattgaccttccacctgagaaggtctttttgtttcaaaagtctgcgcttcacaagtgcaacatggctggaaagcctgctgttgttactcgtgtcgtggacagcatgactgacaacctcagacctactcgcgcagaggcaactgatgtggcaaatgcagttcttgatgggagtgacgccattctccttggtgctgagactctccgtggtttatatccagtggagactatttcaacagtgggcagaatttgtgctgaggctgagaaggtattcaaccaagatttatactacaagcggactgtgaagtatgtgggagaacctatgacccacttggagtctattgcttcttcagcagtgcgagctgcaatcaaagttaaggcatcagtcatcatttgcttcacctcttctggacgagctgcaaggctcattgctaaagtacaggcccaccatgcctgttctttctgttgtcattcctcgtctgaagacaaaccaactgagatggagtttcactggtgcttttgaggcaagacagtcgctgatagttagaggcctctttccgatgcttgcagatcctcggcatccagccgaatcaaccagtaatacaaatgagtcagttctgaaggttgctctagaccatggcaaggcatgtggtgtgatcaagtcccatgaccgtgttgtcgtttgccagaaggtgggagattcatcggttgtgaagatcattgagctggatgattagacaatcaggctatgctgttgtctactagggcacgtttttgccaatttttttgcctaggccgaaacttattggctatgtataatcctatagcgcttgaaaactgagcagtttttcctatggtgccatcataggatttgcttttacagttccaattatggtgtagttcaaaaattgctcgactaaactgcggtgtaacagttaaatgggcagatggaataatgtaatcatactgttccctcgttaggttgtcacttgaattgataatctggccttttttttttggttggcagatggaataatgtaatcatactgttcctcgttacttgaaaaaaaaaaaaaaaaaagcggccttatccgttgctattgcctacctgagcctgtttttgtgctacaacataacaaaagaagcgggcggtcctacacctgcagctttcgatcgctctctcgagcattaactgaacgctgaccccacttacctgcataggtggcacctcaagacacttgccatctactgaatcaacgacacgtgcactcacctggaatgctatcgtgc

SEQ ID NO: 2850 - DNA, 261 bp, Zea mays
  UNSURE (1)..(261): unsure at all n locations
  Clone ID: PAT_MRT4577_88302C.1
  unsure (1)..(261): unsure at all n locations
aagcgtcgatacctgctcctcgtcgnccggtctttacaagcgatggcgggccgtggcaaggctatcggcgctggcgccgcgaagaaggcaacgtcgaggagctccaaggccggactccagttccccgtcggnaggattgccaggttcctcaaggcgggcaagtacgcggagcgcgtcggcgtcggcgcccccgtgtanctcnccgccgtcctcgagtaccacgcggntgaggttctcgancttgccgggaatgctgcgagg

SEQ ID NO: 2851 - DNA, 398 bp, Zea mays
  Clone ID: PAT_MRT4577_88348C.1
gtccttcctcggcctcggcatgaccacctacaccggctggtacctcaccatcgccgcggccgtccacggccaggtcccaggcgtcacccactctggccccagcaagctcgtgccctacttcaccggcgccaccaacatcctctacaccttcggcggccacgcgatcactgtggagatcatgcacgcgatgtggaagcctcgcaagttcaagtacatctacctgctggcgacgctgtacgtgttcacgctgacgcttccgtcggcggcggccatgtactgggcgttcggcgaccagctgctgacgcactccaacgccttctcgctgctgccgaggacgccgtggcgcgacgcgcggtggtgctgatgctggtccaccagttcatcaccttcggcttcgc

SEQ ID NO: 2852 - DNA, 261 bp, Zea mays
  UNSURE (1)..(261): unsure at all n locations
  Clone ID: PAT_MRT4577_88697C.1
  unsure (1)..(261): unsure at all n locations
actttgtacaacgccttttgatagagatgggtgcttgagcttcttcgtttttgcaccaaaagacaggcaggatgtcttgcagctgcggatcaagctgcaactgcggctcaagctgcaagtgcggcaagaagtaccccgacctggaggagaagagcaccgcggcgcaggccaccgttgggggggggggcgccccggagaagacagctgctgccgagttcgaggccggggcggagtccggngccgagacctcccacggctgca

SEQ ID NO: 2853 - DNA, 635 bp, Zea mays
  Clone ID: PAT_MRT4577_88720C.1
ggccgcttttttttttttttttttctttttttttttttttttttttttttttttttttttttgttgttttcttttttttggttcttgttccatgatcatacacaagcacatgcatacacacacgtatacatacgatagatcacgaagccacgctaatccgggcataacacgagcgcatacatacgtacgcgcgcacaacacggcgggcgctcgatatcactcgccacacacgcacgcgtagcacacggggagggacgacgatacgggaggatcaatcagcccaagaagtggagcttcttcgcgccgacggcctcctgggcgtccttgcggcccttattctgtgggtggtgctcgcggaaggcgaagccgccggagccgacggccgccgcctccgcgacctcctgctcgatcttgaggcggggcgcgcgctccgggtccttctttgccccgggcttctcgtacagtgcgaaggcgccggcggcgatggcgccggcctccccgaggtgctgcttgtgcttgtgctgctggccctccttcttgtactccccgcactcggtctggcccgtggacacgacctccgacaccgtggcctccgagaactcgggggactcgccggacccgccgccggcgagctg

SEQ ID NO: 2854 - DNA, 1594 bp, Zea mays
  UNSURE (1)..(1594): unsure at all n locations
  Clone ID: PAT_MRT4577_88792C.1
  unsure (1)..(1594): unsure at all n locations
tgtcaatggacaagccctgcagtttgtttacgggagcaagcaagtctttacccaagggggcattctcgcggcgactgatgacgacaaatctgtacaggagtcaacgtttcaaggaagcgatgaaggacgtcatgactcagtgctgcagtcctgatgaagtcatctttggtcctgacttccatcagtctttgtactgccatctattgtgtgggttaatctactcagacgaaatccagtttgttttctcgccgtttgcgcacagcctcgtccatgcatttcacagtctcgaggaggtatgggaagatctatgtgctgacataagagatgcctccctctcggagagagcgcgcaggtcatcaaccactacctcagcctcggcagcgccgtgccgaatcctgagctggctagctcgatttacatcaagtgccagagcttgagcaattggtatggggtgatcccaacactgtggccaaacgtgaagtacatctatggcattatgacggggtccatggagccatacctgaagaaattgagacactatgctggtcacttgccgctgctgagtgctgactacggtgcatctgaaggatgggtcggctctaatgtaaacccaacgttgccacctgaggaggtgacttacgctgttcttcctaacattgcttatttcgagttcattcctctggaaaaaccaaaatgggaggaaacggagatctgttcctctgttcactacatagagtcggagcctgtaggcctaactgaggttgaggttggcaaaatctacgaagttgtaataacaaattttgcaggtctataccgatacagactgggagatattgtgaagatagcaggcttccgcaacgcaacaccagagctccagttcatctgccggagaagcctagtcctcagcgtcaacatcgacaagaacacagagaaagatctgcagctggccgtggaagccgcggagaagctcttggccgcggagaagctggaggtggtggacttcacgagcctcgtggacaggtcgagcgagccagggcactacgtcgtcttctgggagctgagctccgacgacggcgccagcgaagacgtcctgagcggctgcgcgagctgcatggacctggccttcgcggacgcggggtacgtcgggtcgaggaagacccagaccatcggcgccctcgagctccgggtcctccggaagggagccttcgcgcaggtcatgaaccactacctgagcctcggcggcgccgtcagccagttcaagacgccgcggttcgtgagccagtccaacagcaaggtgctgcagatactgagccggaacgtcacccggagctacttcagcactgcgtatgggctctgatcgacgatgctacggcgctacgcaccaagtactggtaaggctggaagtatagtgatcgagagtgcatggcgcacgacgacgatccatcatgctggcagcctgggagttgcacgacggctgacagatgtatcatataactgtcggtgtaaatataggcctgtttgtttgtaggccaaggttgctgcctatagtttaaatgtagcatattaatatctnaaaaaaaaaaaaaaagcggcc

SEQ ID NO: 2855 - DNA, 373 bp, Zea mays
  Clone ID: PAT_MRT4577_88848C.1
attcggctcgagggcgtcttcctcccctttatatacgtcctcctagggttagggttcctgagggttttgtggaggggcgatggctgctgctgatgtggagtaccggtgctccgacggcggacttgcctgggccaccagcaacgagtcgctggagaatgccttcgtctactacggcgagatccttgactccaaggtcatcaccgaccgccagacggagaggtcccgcaggcttcatgcttagttaccttctcctgcgagaactccatgctcgacgctatcgagaacatgaacggcaaggagctctacggcctgaacattaccgttaaccatgcccatacctctgacggtagcggacgcagctgttgccgtggct

SEQ ID NO: 2856 - DNA, 315 bp, Zea mays
  Clone ID: PAT_MRT4577_88850C.1
agcaagcaaaaattccccaatcctctcgtctttgtttcgaacatgtcggggcgcggcgggggcggcatgggcctgggcgagggcggcgcgaatcgtcaccggaaggtgctgcacgacaacatccaggggatcacgaagccggcgatccggaggctggcgcggcagggcggagtgaagcgcatctcggagctcatgtacaaggagacccgcgacgtgctcaagatcttcctgtagaacttcatgctagacgtcgtctcctacactgagcacgctcgccgtaagaccgtcacagccatgtacgtatgatacgcgctt

SEQ ID NO: 2857 - DNA, 698 bp, Zea mays
  Clone ID: PAT_MRT4577_88950C.1
tgattctactgtcacacacaccagagagagactgtggtttccagagccaagtgtgtactagcagtttaggaaccagctagatcggatggcagcagggaggcatcatgtcggaggagaagtaccaccacttcttcgaccaccatcaataaggacgaggagcagcccgccggtgagtacgggtactccgagaccgaggtggtgaccgtcaccgttgagggctagtacaaaaggtacaagaaggaggagaaggagtacgagcactagcagcacctcggtgagggcggcgccatctgccgccggagccttcgcactctacgagaagcacgaggcgaagaaggacctcgagtacgcgtgcaggtacaagatcagggaggaggtcgctggcgcggtggtcgtcgtggtcggcgagtacgtattccatgagcaccacgagaagaagaaggaccacaaggacgccgaggaggctagcggagagaagaagcaccgccacctcttctgatgagcgaagtaccggacggagcgcgaccgagctaggtggctccgaggcacacaaccacgcacctgtttaattctgtactgcatgcgtgtgtaatttgatggttcacaataatgagtccctctccggaccttggtagctggttgcttgtggtgagtgagagtgtgatactgatggacaaaaggtgctgggcgtgaggcta

SEQ ID NO: 2858 - DNA, 2908 bp, Zea mays
  UNSURE (1)..(2908): unsure at all n locations
  Clone ID: PAT_MRT4577_88994C.1
  unsure (1)..(2908): unsure at all n locations
aattcggcacgaggaagggatccttgcgaagacccagacgccagaggggagtgagggagaggggagggagaaataaataaacccgaattcagccaaacttctctctcccaccgcgcttgcatcctctcatcgccaccccaccctcctcctccctgtctttctccccccctctctctccccctcttgacaaattttcctccacccattcccttcctcccctcttcttcttctccacccactccaccgatccccctctttctctctgaattctctctcgtcgtgcccacccttcccatctgtctgctgcccctctctcgcaatcagtcactcggctcttgtttcttccgtctgctgggttgattctctctcttcctctccgtggagaaacaggaggagagagagggaagaagagaaatcggaaccagcctgttctttttgcctggattgcggttcttgcgagttgttcagaaactctgggccagtttctggtcctttaaactactggaaagaggaaccatcagagatgccaaggcagccaacaaattgatatctaattgccctactttggatcatcataatgcaaggacagaggaattctatggagcattttgctgatgtctttggattcgacgttgcatcgagttcaggcaaccctgtgatggatcagcagtcatattggaataatgttcttggatcagtagaatcacataatcttcaaggttatcagatggctcacagtgatgccgccatgccatatggaaatgaaccacagcaagatggtacatttcttggtttctgggaatcaggcgaagcaagttcaagtgccagtgcactaaactatggcagctctaataatgtcaaaacagagcatcttaacattggtggtggaggtggactgaggattggtgaaagccgactggtagctgacaatggcatttctctggatgtggatatcaaccttaacgccaacgttaacgatctttgtggtcaaagttcaaatgttaactgtgcctctcaaggtcctgagcagtattgtggcagtgatcgtaatgctataaattctcagccgactgacctgggattacacccattcaggacattcctactagatgcacagcaagcagaatcttttactttgaatcctagtgaaaaccctttgggtgatttttcatcaatgcaagaaagcattgaacaaagaccaggtggttccctggatggtcgccggctagcgtgcaagagaaaaaatattgaaggagccaatggccagagttcagcaggtgctagtacaagttttccccacaggaacgataatgcattccataacattgcttcttcaagttacaatcctgcacctatcagaaattcatcctctcccaagtgtttgccagttccaagttctattgaagatcaactcccacggtatggaactaatgtagggctctcagccggtacttatgaccttcatggaggggtcaacaatgctgtgaattcacagagaagtttccgagcaagaactaccacatctcaacaggttgctccctgtagtgtatggccctcttcaaatgctatcagactttctaattcatggaatcaccagccacctcatttccaaagtgcatttgatgatccccaggaggttattcctgtggtcagcagcctcaacttgcaataccaacatccaatgaatgttcctggtgtgccacaggctgctaaccgtttcactgaccatggagcttcatcatcgagagctgggagtttggagaacagaattattggtagtgaagaggctcctagaaggtatgccgcgcctaccaactactctgatttagttcccccacctgcagtagacccgagacgtttgctgccagaaccatctaattggagttctgatgtccgaggcactgcaatatcaggaagtattcctcctgtatcaagagctaataacagtgcaactgttaatccgccagcaggattcagtcaccaaaacctcacccggcgccatcctcgaaatttatcagaggagattggtcggctatctggagcacttcgcggccatcaacccccacgcttaaggccggggtttctgctggagcgccagggcgatggtgtttggggtgttcctttatcaacaaggggtagagaaggaagaaggttaatggagattcggaatgcacttgaaatgatccatagaggggagaatgtaaggcttgagtctatcttctatggcggtgttgacattcacgatagacacagggacatgcgccttgacattgacaatatgtcctatgaggagctattagcactcgaggaaagaataggaaatgttggcactggcctcagtgaggaagctgtgataaggttgctcaaacaaaggaaattttcatcttggacactaaaagcatctttggaccctgaaccatgttgtatctgccaggaggagtacgctgatggagacgacctcgggaggctggactgcgggcacgacttccacgctggctgcatcaagcaatggctggtggtgaagaacgtgtgccccatctgcaagagcaccgcattgaagaagacctgaaacccgaacaaaggctcgtgtcagagacacccccccatgtttctatgttcactcgatcgttcgcgagatcctttgccgattcgtattgctacgttttttttggtcgggaaaattttgccagacacctgcatgctattgggaaaggaaaagagagagaaaaagagagagagagagaggatgcggttgcggtcctctgtaaactgctgctgcagtaaataatccctggaatatgtctccctgcatccaaccaaatatttagttagctgttatagtggacgccgtangattaaaacctggaagagagcctgttggctgttgcccacaaaaaaaaaaaaaaaa

SEQ ID NO: 2859 - DNA, 544 bp, Zea mays
  Clone ID: PAT_MRT4577_88998C.1
tatgaggagctattagcactcgaggaaagaataggaaatgtcggcactggcctcagcgaggaagctgtgataaggttgctcaaacaaaggaaattttcatcttggacactaaaagcatctttggaccctgaaccatgttgtatctgccaggaggagtacgctgatggagacgacctcgggaggctggactgcgggcacgacttccatgctggctgcatcaagcaatggctggtggtgaagaacgtgtgccccatctgcaagagcaccgcattgaagaagacctgaaacccgaacgaaggctcgtgtcagagacacccccccccccatgtttctatgttcactcgatggttcgcgagatcatttgccgattcgtattgctacgctttttttttttggtcgggaaaattttgctgccacctgcctgcaattgggaaaggaaaagagagagaaacagagagagagagaggatgcggttgcggtcctctgtaaactgctgctgcagtaaataatccctggaatatgtctcccctgcattcaaccaatt

SEQ ID NO: 2860 - DNA, 1328 bp, Zea mays
  Clone ID: PAT_MRT4577_89080C.1
ggaaggtcttcgggaattctgttcagcagaatccgagtccactagccctcctcagtcctccccagggatttcgacttccccgagacaccatcgctacgacgagcaagcagagcaccatctcggctgccttaaactgtctctccgccggatactacacccgccgccgcagcgccgaccttgtctcaatcgagcggagcgggcgatcggattggttgcttccttcccccatctcatgttggtggactgagagatggagttttgatttcaaatagcatctagagaactgccactaagtttttaagttagtatataatgggtggctgttgttgctgttcgtcgagaacatctgaagccgatagagcaccaattgatatatatcgtcaacaaaatcttgaggagcatgagccgctgtcttcagcttttgatggatcatctccaccatcttcaattgttgcagtagacacaaatctggatacttccacacctgacacatatcgagcaccacctgcacccttgccttatgatgttgttttggcagtcccaactacccctggtttggagaagctagacaacaagagcaaaactgatgaccaacaagagtccataaatgatcaggagtctttaaaggtggatgagtcatgtaagaaaaatgtcactgaagataaggctgaggaggaggatgtttgtcctatctgccttgaagaatacgatgaagaaaatccccgctctgtaactaagtgtgagcaccatttccatctttgctgcattcttgaatggatggagcgaaaagatacttgcccagtttgtgaccagacaattttggtggatgagatgtccgaatagacttggtaatcctggtggatcatcacttgaagctgtttgttactgaggaagtgcaggcaacaactactacactcttgatattcgtccattctgggtggctctcagagtaatgaattgatggggcaaaaattgaaaggatgaacgacatgaaatgtatttacgccccctcctttaccctgcattctgtgtcatgcttttgctgttcatagcaacaggtggactaggaaactgcttggttgaattatatatagagagagatatgtcggcttgcaggttgattcagttaaaagtgcaaaactatgccatttcgcttttctgaattcagagtttcagacatctgctggttcttccaggaatccagtcagctttttacatggtatattaggtggttgcaggtaaaaatggtctagatggaggtgggggtttctttgtataatccacatgctattcaagcttcctgtatataatatttcctgttttcttcg

SEQ ID NO: 2861 - DNA, 987 bp, Zea mays
  Clone ID: PAT_MRT4577_89293C.1
ccacgcgtccgaaaccctcccttgccttgcccagttgcccccaaaccccagccaccagctaccaatggcggccaccgcgatggaccatgacggcggcgacgacgtggtcacaccaggggagcttctcggaaactcattaaccctcgcggccggacgtggcgcctacgccgacggtcgctctgtgcgcgcgtcggtcaccgggcgccgccgcatcgtgccgcccgcacctgcctccgacgaccagagatccacggtggaggtggtggggcacaaggcccatggagctgtgccgcagccgggaagcgtcgtcatcgcccgagtaacaaaggttatggctagaatggcctctgcagatatcatgtgtgttgactcaaaggctatcagagaaaagttcactggcatgataaggcagcaagatgttcgtgcaactgaaattgacaaggtggatatgtaccaatcatatcgtcctggggacattgttaaagctatggttctttctcttggtgatgcaagggcatattacctttccactgcgaaaaatgaacttggagtcgtttcagcacaaagcatagctggtggtacattggttccaatcagttggactgagatgcaatgtgatttgaccggtcaaattgagcaaaggaaagttgcaaaggtggaatagatgtgctgtggccctcctgataaatggtggtggcggtatacaaattgtggaccagtgacaccaggtccttgggcggactacccaattctgcgacgtccaacttcattacagctgcattgagcatgggtttttaaaaccctggctgaatttaactagacatgaatcgtagccatgggtcctgtaacccaaccttgggatctgaatcatagccatgggttctgtaacccagtaaccttgcccttgtgatttgttactctgtgagctaatgacattgcagttttccaccttgtgatttctaggaaaaaataaaaagaaaagccagt

SEQ ID NO: 2862 - DNA, 388 bp, Zea mays
  Clone ID: PAT_MRT4577_89333C.1
cggacgcgtgggctcgccgtcgcttgtggcagaggagcagcttcacggttccaaagacaccttgaccttgaagggcgagaaggctttgctcgagttgcttctaggcatggctctggaccagcacgttgacggcaggaagctcattacccaacaggaggctgaggatagtgatttcgagagctatttgagagaagcaacaagccgagtgctttaccagccaacattcattgaagaggatgatgatgatgattctgtttcggagagctcttcagcatcattggccaaaccagctggaactttggatcttggcaagctgacagaggaaccacagcctcaccgcagtgtggatccaaaccattcgtatgatcaagtgtttattagatccact

SEQ ID NO: 2863 - DNA, 304 bp, Zea mays
  Clone ID: PAT_MRT4577_89355C.1
ataaaatactgcaaatgttagccttaaaaaaaaaaaaaaaaaaaaaaaaaaaaaaaaaaaaaaaaaaaaaaaaaaaaaaaaaaaaaaaaaaaaataaaaaaaataaaaaaaaaaaaaaaaaaaaaatataaaaaaaaaaggggggggccgttttaaaggaccaaagtttacgtccgcgtgcttgcaacgttattgtttttttttggggccccctaatttaaattaactggccggcgttttaaaacgtttggactggaaaaaccctggcttacccaaatttattggctttgaaacaaatcccctt

SEQ ID NO: 2864 - DNA, 749 bp, Zea mays
  Clone ID: PAT_MRT4577_89477C.1
ccccgcgtccgcggacgcgtgggggcgctttgcttctccaccacgcgcggctggccctcggcctctttcttcgtccaagggaaatctccggatacaaggaggaaatctaggaaaggtgcaattcaaactaatgatgaagaaagctgattcgtttgtgctatgttgcaagggaagggcgggcctagtacagcgatagagcctaccgtctataatcggaaggtcccgggttcgagccccagcctctgcatattatgcgggtaaggcttgacgcttaaagatacccttccccagaccccgcacagtgcgggaagcctacggcactgggctcctaaaaggaaacgcagtgcagagtttaatgactgccatgatcaatgtacatttggatgggaatgagccatttgctggtaaaccatggcacctgctactgttgatgttgcctcatccgacctggaagatatatctgtaaattcaggctgaagctcaggtggttattgtatcaacaagccctggcacaaaaggcttcgtttgtaacaaactaacaataaagcatcgattgacctgtttgctgaatgtgtgatacggtacttccaatactaggtcagcatcagtccagaagctgtaccctgaacaaagattctggatggcttcttgtgccagctaggaacaatgtaaaattgatgtaagcgtctgtgcgcactcctgatccatgtacaactaagttaaaattttaaactgttatagattgttgt

SEQ ID NO: 2865 - DNA, 519 bp, Zea mays
  Clone ID: PAT_MRT4577_89488C.1
gggagcaccaaaaaacaccattttttccttaaaattaaattaaaaaaaagcctggggggggggaaaaaatccattgatccccaatccatgctgtttgatgcatgggtctgctgaaacccggggtgaacacagaattaaaaactgacacagagggaccttgcaataaaaaacacagagggggaaaaacaaacaccacccgaacgaaaataaaccctttggactgggggaaaaatcacgggggcaaaaaggataacttgggcgggggggccccaccggtaaatttcttcagttcccgggggagttgccgaaaccccccccacggttgccaccgccgaaacccccgccaccaccaccgtaaccgccgcccccaccggagcccccgccaccgccgtagccgccaccgccataagggggcccgccaccgccgtagccggcgccttcaagggcaccaacggacccaccggcggcgctttaaaggggggggggggaatgggcctttttgaaggggattttgcggcc

SEQ ID NO: 2866 - DNA, 1860 bp, Zea mays
  Clone ID: PAT_MRT4577_89553C.1
aattcggcacgagggggaggagaaccgtggtctgtcctttatgtatgatggtgtacctcttctagctatgttggatgagtatgttatgctcagacaagaaagggaagaagaaaagaaaagaatgcgggaacaaaagcgctacattgagcagcaactgaacaccgatcatgaagggccatttggatcgcgggtgagtccaaaccggcctgccagttcgaagaaggctgttggcgtaaaggtgaacggcagcgtctcaaacggcactcctccaaacagaaggctctcaatcagtggccaacagaacggtggtggccatggcgtcaggtctggagggaaggatagcaagaaagacacggcgaagacagcatctccagggaacaatgcagttgcagctgctcctgtggacgcggtctcccaaatttctgtcaccgatccggttccgagcacaccatgatctttaacctagcatcgtatattagatataagcgactctttttctgatgttctgttgttttgtggtaatatcttataatgccttcgtagagtaattatgatgcctgcccatccttcagctgctttggcttcatggtgtaattcttgttttagttccgctcggccgtgctgtttcgacctgtcagacggtgtagtgtagtcttactgagatgtattgcattaatcagtgtgctggacatatagctgttgaaaccttttctgttccaaaaaaaaaaaaaaaaatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcgggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgtccaaaaaaaaaaaaaaaaaagcggccaaaaaaaaaaaaaaaaaaaaaaaaaaaaaaaaaaaaaaaaaaaaaaaaaacaaaaaaaaaaaaaaaaactcgaggccggtaccagccccccaatggccttgggtttgctttgcgggcccccggttttcgtcttggggtgcttttaatcgggcacaggtttttaaattaaaaaaatgaaaacttttttgtcccttcccttttaaaaaaaaaaaaaaaaaaaaaaaaaaaaaaaaaaaaaaaaaaaccaaacccaaaaaaaaaaaaa

SEQ ID NO: 2867 - DNA, 282 bp, Zea mays
  Clone ID: PAT_MRT4577_89796C.1
tagttcgcgtggggcccgaatgaatattctacaggcatgggttatttttcaactgccaccggcttagctacatttacaatgatgttgttaggaagagtgatcctcagaaagttcgggtggggagttgcagatacgatcacgcctgtagtgttactcctcacaggagtagggttctcctcactgactttgtttggtgagccatagactcctcttatgaccaagttttgggaagacaccctctgcttgcggcagtcttatgttggaagcaatgcataacatttt

SEQ ID NO: 2868 - DNA, 593 bp, Zea mays
  UNSURE (1)..(593): unsure at all n locations
  Clone ID: PAT_MRT4577_89874C.1
  unsure (1)..(593): unsure at all n locations
gtcgggatcgtcattctgctcttcatcaactccacaatcagcttcatcgaggagaacaacgccggcaatgccgccgccgccctcatggccagcctcgcgccgcagaccaaggtgctgagggacggcaagtggtcggagcaggaagcggcgatcctggtgccgggcgacatcatcagcatcaagctcggcgacatcatccccgcggacgcgaggctgctggagggcgatccgctcaagatcgaccagtcggcgctcacgggcgagtcgctccccgttaacaagatgcccggcgacagcatctactccggctccacctgcaagcagggcgagatcgaggccgtcgtgatcgccaccggcgtccacaccttcttcggaaaggccgcccaccttgtcgacagcaccaacaacgtcggccacttccagaaggtgctgacggcgatcgggaacttctgcatctgctccatcgcagtcgggatgctggtcgagatcatcgtcatgtacccgatccagcaccggcagtaccgcgagggcatcgacaacctgctcgtgctgctcatcggcggaatccccatcgncatgcccaccgtgctgtc

SEQ ID NO: 2869 - DNA, 290 bp, Zea mays
  Clone ID: PAT_MRT4577_8991C.1
cccttaaaaaaaactaaaaaaaaagcctgacgggggtaacagcatccatcgacccgaaacccgggctggttgatgcatgggtctgctggacccggggatgaacccagcattaacaactgacacagagggaccttgcaataaaaaacacaggggggcaacaccaaacgggacgaacgaagataaccccttgggactggggaaaacatcacgggggcaaacaggataactgggccgggcgggccccaccgttaagttcctccaattcccgtaggagtttgccgtaccccccc

SEQ ID NO: 2870 - DNA, 723 bp, Zea mays
  Clone ID: PAT_MRT4577_89934C.1
ctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggctacggcggtcggcgcgaaggtggcggcggcggctacggaggcggtggcggctacggcggtcggcgcgagggtggcggtggcggctacggcggcggtggcggcggcggctggagggactgatgtgtgggcccatcctggcttcggccgagttatcttatctatctatagtatcgtgttaccgttcgcttctgtcaccgtgttagtgtccgttctacctttggattaggtgttggtaccctgttgttcgctttggttgctcccgctatgaaacgagacgagagaagaatgagcaaggtttttgttcgcagctatttttgtccaatgatattgatatattgttcccctgtc

SEQ ID NO: 2871 - DNA, 763 bp, Zea mays
  Clone ID: PAT_MRT4577_8997C.1
cggccgctcaggcggcgggcgggaatacaaatctctctcggctccccgctccgagtcgcgtcgcgtgaggagaaaggaagggaagccggaaagggttctcgccgacgcggaaggaggagatggccgggaagggaggcaagggcctgctcgcggccaagacgacggccgccaagaccgccgagaaggacaaggggaagaaggcccccatctcccgctcgtcccgcgcggggctccagttccctgtgggccgtatccatcgtcagctgaagcaaaggactcaggccaatggccgtgttggtgctactgcggcggtctactctgctgctatcctggagtacctgacagctgaggtcctggagctggctggcaacgccagcaaggatctcaaggtgaagcgtatcacccctcgtcacctccagctggccatccgtggagacgaggagcttgacaccctcatcaagggcaccattgctggtggaggtgtgatcccgcacatccacaagtccctgatcaacaagtcctccaaagagtgaacagaaaaaatagcaaaggagcatctctagcttaaactggacattttctcagtcgtctgtgagataagtttatcgtcgtgtcgtttagcgtttagctgtgctccttccagatcgaagtcgttgtctgtctgtgtaatgtttacctggtactgattcagtcatttggacattggtgtttatgttcgtcgttgactctgtgattggactctgaatgcaaaaaccttttaagc

SEQ ID NO: 2872 - DNA, 401 bp, Zea mays
  Clone ID: PAT_MRT4577_90005C.1
cagacaaaaaactttattattgaactataactcataagaaatttaaaagagggccccaccaatgatgggttgttggtaaaatgctgttgggtttgtcaaagcaagttggttgaatggccccaattgttgcagttgaaaaagggtgccagcgttaggcgcaccgtgttggtaaaacggaaacaattggggttgtgtaaaaaaggtagcagggctcacaccaactagctggttgaatggtagttgttgtggctgctgtaaaaaagccggaaagttcaaagctgtcatttggttgaagggaaaaaattgctgggggtaggcaacaaatagctgtctaaagggtaattgttgttgttgcaaataagaaccagagtttattgcacttagtgggttgaatggaaaaa

SEQ ID NO: 2873 - DNA, 350 bp, Zea mays
  Clone ID: PAT_MRT4577_90066C.1
ctttccctcgcgccgacgccaacgcaacccttgtaggcccaatccctcacagcaaccatgggtggcgctcatgagtccctctatctggggggcacgatgcgcggacacaaccgcgaggtgacgggcatcgcgaccccgatcgacagcttgccgtgcatcgtgttgtgctcccgggacaagtccctgctggagtgggacctgaccaacccggtccactccaccccggaatgtcggcgccaccggccactaccgcgtacccttgcggcgcctgaccggtcactgccacttggtacaggacgtcttccttagttccgacaggcagatagccctttccggctcctgggatggag

SEQ ID NO: 2874 - DNA, 191 bp, Zea mays
  Clone ID: PAT_MRT4577_90173C.1
ggggaacaaaaacttggtcattcttttctcgggtcgtttcatagcggggagcaaacaaagggaacaacaggggtgccaacacctaatccaaagggggaacgggcactatcaggggggctgaaaacaaacggtaacactattctatagatagataaaataactcgggcgaatcctggatgggcccacacatt

SEQ ID NO: 2875 - DNA, 371 bp, Zea mays
  Clone ID: PAT_MRT4577_90388C.1
ggagatcggtgatcagacacagggcattacatgcgtgtgctggatagggcagtcttcaactctactctatgcaaattacagcggtaacattaagatcttataaatggactgaggagtgtgcatgtgtttgattttgaggtctaaatagaccgacttcttaggccgggctcaacagatcattcatatagccgggttagatgtcactgtctaggcagtttagttgaaaatgagagatggaatgagtaatgctgctagagatagcttactaagttgagcgcgtgcatgacttcaaaatttgcatcgagtaaatgcagagttgccaactgtgcaagttaatatcagttgcacagtttgtaaaggtagcaactgta

SEQ ID NO: 2876 - DNA, 166 bp, Zea mays
  Clone ID: PAT_MRT4577_90405C.1
agcacggtgagcataaagctgggcttgccgcaccggaacgccggcgcggacgagcgcagcgagagctgcgagccggctatggacgagatacaacgcgaggtgtactcgaataaaggcgtgatgcttcagctgatgcggtggacacgtccgcgatgggccacggttg

SEQ ID NO: 2877 - DNA, 1997 bp, Zea mays
  Clone ID: PAT_MRT4577_90458C.1
cggccgatccatcgatggagctgtgagctgagctgagctgagctcaccaccaccacacacgggagatagctatagctagcatagcaagccagccagtcagcgacttagcagcagctagctagccatgctgccgtccttcgtgtcgccgacggcgagcgccgcggcctcggtgacgcctccgccgcggccgataccaggcagctacgggccgccggtgctgggcccgctgcgggaccggctcgactacttctggttccagagccaggacgagttcttccggaagcgcgcggcggcgcaccgcagcaccgtgttccgcaccaacatcccgcccaccttccccttcttcgtgggcgtcgacccgcgcgtggtcgccatcgtggacgccgccgccttcaccgcgctcttcgacccggacctcgtggacaagcgcgacatcctcatcgggccctacaacccgggcgccggcttcaccggcgggacgcgcgtcggcgtgtacctcgacacgcaggaggaggagcacgcgcgcgtcaagaccttcgccatggacctcctccaccgctccgcccgcacctggtccgccgacttccgcgcgagcgtcggcgccatgctggacgccgtggacgcggagttcggcaaggacgacggcagcgacaagaagccctccgccagctacctcgtccccctgcagcagtgcatcttccggttcctctgcaaggcgttcgtgggcgccgacccgtccgccgactggctggtggacaacttcggcttcaccatcctggacatctggctggcgctgcagatcctgcccacgcagaagatcggcctcgtccagccgctggaggagctgctcatccactccttcccgctgccctccttcctcatctggccgggctactacgtgctgtaccgcttcatcgagaagcacggcgccgaggccgtggcctacgccgaggcgcagcacggcatcggcaagaaggacgccatcaacaacatcctgttcgtgctcggcttcaacgccttcggcggcttctccgtgttcctgcccttcctcgtggccaaggtcggcggcgccccggcgctgcgcgagcggctgcgggacgaggtgcggcgcgccatggtgggcaaagacggcgacggcgacggcgagttcgggttcgccaccgtccgcgagggcatgccgctggtgcggtcgacggtgtacgagatgctgcggatgcagccgcccgtgccgctgcagttcgggcgcgcgcgcagggacttcgtgctgcgctcccacggcggcgccgcgtaccaggtgaccgcgggcgaggtgctgtgcgggtaccagccgctggcgatgcgggaccccgaggtgttcgagcggcccgaggagttcgtgccggaacgcttcctcggcgacgagggcgccaggctgctgcagcacctcttctggtccaacgggccggagacggcgcagcccgggcccgggaacaagcagtgcgccgccaaggaggtggtggtggacacggcgtgcatgctgctggccgagctgttccggcgctacgacgacttcgaggtggagggcacctccttcaccaagctcgtcaagcgccaggcgtcgccgagcgtggcgcaggcagccgccgccgccggagcgcagcagtgagtgcgctgtataggatccatcggtggcgtgcgacgtcgccggcgccggcgccggccaagcaataaagtaatgagtaggccctcctcgtcatccacatgctcgtctgtgttcgacttcgatcggtgtctcttcctcccggccggccgctggccgccaaacagccgttgtggtaataaaaaaatcacttgtggaattgcagagtgtaccgtggtcacacacacttgtacattgaattctttagtgatgctgcaatcaaattgaatgaacatgtactcgctcaaaaaaaaaaaaaaaaaaaaaaaaaaaaaaaaaaaaaaaaaaaaaaaaaaaaaaaaaaaaaaaaaaaaaaaaa

SEQ ID NO: 2878 - DNA, 111 bp, Zea mays
  Clone ID: PAT_MRT4577_90583C.1
gggctggcttctgctccccctcttatcaagtcctcctcgggttagggctccttatggctttgtggacgggcgatgtcggcggctgatgtgcagtaccgttggttcttcggc

SEQ ID NO: 2879 - DNA, 763 bp, Zea mays
  Clone ID: PAT_MRT4577_90667C.1
caaccaactccctcacgatgtttatatatatatgtgtacatcctgcagtgctagctttggagttcgatccaatgatgatgccgactgatgatgctatgcggtggtggacgcagatgtgcggcgagggggcacacgttgctgtcgcgtacgtcgagcggctttattttggagagcttctcgccgctttgttggttcgctcaaaaaagaagtacagtacagatcaggagcaccaccaggtctagtcgtgatcgtcggctagcgttcagctagcagcccatggaagtatggaacgagtgacgccacccgatcaagacagggaagctccaaaggagcagtactgcggctgcaatgcgtttgccagggaatagtagtgtagcagctgttgtattcattcgtatggatccatcttgtctgcggcagccagcagcagggggttcatctactctgccagtctgcgtgatgcctgagagcaaagcaaactgattagcatgcagggtttgcagcttgcaggcggcaagcggcatgcatgatggcatcggcatcggcatcggcatcaatgatttcgctgcatatgacgccgcttctgctggcgccgcgccaacgacgattgggctggcctgacaagcgagaaaagcagcagttgtagctagactagatagaaacagtcggcggtgacaagacagaccaacacaacacaccgttcgtctctcgcgcctgccagtgatcgcaattggacgggtgtgcttgacctcaattaattact

SEQ ID NO: 2880 - DNA, 237 bp, Zea mays
  UNSURE (1)..(237): unsure at all n locations
  Clone ID: PAT_MRT4577_90691C.1
  unsure (1)..(237): unsure at all n locations
tccggctctgatctgggccagtctgggttgcgcgaacagtcggaaccctaattccctccccggcgccggcgccggcgcccccctagctgcgcccccacgaccagcagaatccagatcgaagttttgctcttgccgcggncccgnctaaactccaaaagtgcgaaccccctaagtcatcgatcccagnctggctccgnctacgcgnctcgtgacggcgtggagcnctcccgtatctgc

SEQ ID NO: 2881 - DNA, 686 bp, Zea mays
  Clone ID: PAT_MRT4577_90705C.1
ctctgagttcatcagctaccccatctctctctggacggagaagaccactgagaaggaaatttctgatgatgaagatgaggatgagaagaaggatactgaggagggcaaggttgaggaaattgatgaagagaaggaagaaaaggagaagaaaaagaagaagatcaaggaggtttctcacgagtggaacctgatcaacaagcagaagcccatctggatgaggaagcctgaggagatcaccaaggaggagtatgctgccttctacaagagcctgacaaacgactgggaggagcaccttgccgtcaagcacttctcggtggagggtcagcttgagttcaaggccgtcctcttcgttcccaagagggccccctttgacctctttgacaccaggaagaagctcaacaacatcaagctctatgtgcgccgtgccttcatcatggacaactgtgaggagctgatcccagagtggctgagcttcgtcaagggcattgttgactctgaggatctccccctcaacatctctcgtgagacactccagcagaacaagatcctcaaggtcatcaggaagaaccttgtgaagaagtgcatcgagctcttctttgagattgctgagaacaaggaggactacaacaagttctatgaggctttctccaagaacctcaagctcggcgtccacgaggactccacca

SEQ ID NO: 2882 - DNA, 890 bp, Zea mays
  Clone ID: PAT_MRT4577_90817C.1
ccccgcgtcccgcgacgacaatatacgaaacaaattaatccccaatcaacacagcaagtcagcaacaagcaaagcagcgatccgagagatggacgcgaggatgttcgggctggagaaccccctggtggcggcgctgcatcacctgctggacgtgcccgatggcgacgccggagcgggcggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcgggtgctgatgatcagcggcgagcggcgccgggaggagcgcgaggacgccaagtacctgcgcatggagcggcggatgggcaagttcatgcgcaagttcgtgctgccggacaacgccgacgtggacaaggtcgccgccgtgtgcagggacggcgtgctcacggcgaccgtcgagaagctgcccccgccggagcccaagaagcccaagaccatcgagattaaggtcgcctgaggggagaccgttgtcggagcagtgccagtgagctgggtggcaacctgcgggactctggtgaggaagagcaaatggtagaaagcagtagctgtgcttctgaacattgtgtgtgtttgtttccctttttaccggcaatcatcctacctgatgcgtctggggtttcgtttgaaccatgctgggtttggagctttgtgatgcaaagcagaacgtcctgatgctttctttctccatagaataaatctctcctgttacctaaatgtcacttgttttttttcttcgcgaccgatcacgtttttcgttaacaaggattatcaaggag

SEQ ID NO: 2883 - DNA, 918 bp, Zea mays
  Clone ID: PAT_MRT4577_90818C.1
aattcggcatcggcacaattacgaaacgaattaatccccaatcaacacagcaagtcagcaacaagcaaagcagcgacccgagagatggacgcgaggatgttcgggctggagaccccccgggtggcggcgctgcatcacctgctggacgtgcccgacggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacgtggacaaggtcgccgccgtgtgcagggacggcgtgctcacggtgaccgtcgagaagctgcccccgccggagcccaagaagcccaagaccatcgagattaaggtcgcctgagtgtagaccgttgtcggagcagtgccagtgagctgggtggcaacctgcgggactctggtgaggaagagcaaatggtagaaagcagtagctgtgcttctgaacattgtgtgtgtttgtttcccttgttaccgccaatcatcctacctgatgtgtcgtctggggtttcgtttgaaccatgctgggtttggagctttgtgatgcaaagcagaatgtcctgatgctttctttctccatagaaaaaatctctcctgttacctaaaaaaaaaaaaaaaaaaacggccgcggccgatcacgttcttcgttaacaagggttaacaaggagacatgttcttcccaacgggcggcttgctgaatcctttgcatacaact

SEQ ID NO: 2884 - DNA, 432 bp, Zea mays
  Clone ID: PAT_MRT4577_90897C.1
caaacatggaagaaaaacagagttgcgtacattttggcgggccccggcccacgatcattcacaagcccatgcatacacacacgtttacatacgataggattacggggccacccttattcgggcatgaaacgagcgcatacatacgtacgcgcgcacaacacggggggcgctcgatatcactctaacacgcacgcgtagcaaacggggagggacgacaatacgggaggatcaatcaaccgaaaaaggggggctttttttggccgccgggctcctcgggctccttgggggccttctttttttcggggggctcgaggaaggcgaaacccccggagccgacgggcgccggcgccgcaaacttcttcttgaacttgggggggggcgcgtgctcccggtccttttttgccaacagcttttcggaaaaagcgaaagccc

SEQ ID NO: 2885 - DNA, 543 bp, Zea mays
  UNSURE (1)..(543): unsure at all n locations
  Clone ID: PAT_MRT4577_90917C.1
  unsure (1)..(543): unsure at all n locations
ctagcaacatagnaaagcacaatagtgtaccaacaatggcagccaaaaattttgcttccttatgctccttggtctttctgcaagtgttgctaccgcaaccattttcccacaatgctcacaagctcctatagcttcccttcttcccccatacctctcaccagcggtgtcttcaatgtgtgaaaccccaattgttcaaccctacaggatccaacaggcaatcgcacacaggcatccttaccattatcacccttgttcctgcaacaaccggcacacctattacagcagttaccttaggtccatttcgtggcacacaacatcacggcacaacaactacaacaacttgtgctagcacaaccttgctttatactttcagaaacatcctgtacttccattcaaccaactgtctgcattgaactatactgcttatttgcaacaacaattaccatccatccagttaggagctgcctacccaccacattttcttgcattcaacacaactagcatgtttgaactctgctgcttatgtacagcactcacaactac

SEQ ID NO: 2886 - DNA, 301 bp, Zea mays
  Clone ID: PAT_MRT4577_9092C.1
cggacggtgggcggactcgtgggtggacgcgtgggatcgacctttaagtctctctacgtagcagtgcaataaaaaaagcagtcgtaatggcgagctacaccatggccctctccttcatggccttctccggcacggccgtgaacgtgctgtcgtcgtccgccttcggcgatgcccgcgtgacgatgcgcaagacggcggtgataggctaagccggctgcggtgatcgtgagcccgttgtacggctccgaccgcgtgctgtacctgtggccactgtccgtctgatcgccgagctacctgacgg

SEQ ID NO: 2887 - DNA, 338 bp, Zea mays
  Clone ID: PAT_MRT4577_90935C.1
tcgcccacgcgtgcggccacgcgtccgggtgggttggtttctcctacccctacggttaaggttcgggttcgtgaggttctccggggttccggttcgtgggtgagcggatcgatatgggggcctcggatgttgagtaccgctgcttcgtcggaagactcgactgggccaccgacgaccactccctacacaaaggccttagaacctaccgggaggttctcaagttcaagatcatgctcgagcgggagactcacaggtcccacacgcttaagctttgtcaccttctccacagaggaggagatgccgaacgccctccaaggcatgaacgggaaagagctgga

SEQ ID NO: 2888 - DNA, 401 bp, Zea mays
  Clone ID: PAT_MRT4577_91008C.1
caccaaggaaggatcagttgctttttacttgaggcggtacttgaaaacgtcaaggtcaactacttgtaggactacaaggggcattttatttatgtacataaacagccgcctgatgttctccctagaaaaggtatccatgtccaccacgtggttgccgtgggtgtatatccacaggctgcccggtttcactttttccaggcaggcccaaaaaaaggggcaggactttaatttcgggttccaatcctaaaagcaccgtatgcaaagcttgtggccacagtcgggcaacacaaccttggggctaacctggaggcaaatcccgcactcgagctccttttccgggtccacctccaaaagctgctaatccctgctcctaaattttttaaggaaaagtttcttttgtt

SEQ ID NO: 2889 - DNA, 601 bp, Zea mays
  Clone ID: PAT_MRT4577_91098C.1
ggaggagggcacgacgcctctgcctgtcccaggcacaacaagacactcgtagtaaaacggacgtgcctttgcctgtagccccacattggacaaaagatatctcccacattaatatgggggcatgatcggacagaggaaaacgtactgtactcctcggccgccactcataatagtacaagcttattgcccttaactaatgtatatcttacacaaacacaagcaaagcaaaccgagctattaacggacgaaaaacacccaacgccggggagggggaggcgcctagtactatactagtagcggggggggtatctgggctgggcctgggcctgggcctggatcttgggtccccttcccgggttagtacccaggcccgaccttattgacaagcgcgagcgcgttgctggtgacctgcgcgacctcgacgaccttgccccggatgggggggcgcgtgccggcgtcaacggcgcgggacaagaggccctcaaggcaggtgtcctcgtcggtgagcgcggggctgcaccaggtctgcacgttgctgaggggccacctgaacgccggggtccccgcgcgggccatcccggggccgcccattttctgcgcc

SEQ ID NO: 2890 - DNA, 1122 bp, Zea mays
  Clone ID: PAT_MRT4577_91099C.1
tttttttttttttttgcccaaaagatatctcccacattaattaatgttaatgatggcatgatcggacagagaagaacgtactgtaagtctgtactcctcggccgccactcataatagtacaagcttattgcccttaactaatgtatatcttacacaaacacaagcaaagcaaaccgagctattaacgaacgagaaacacccaacgccgtggaggtgtggaggcgcctagtattatactagtagcgggtgtggtatctggcctgggcctgggcctggatcttgggtcccctcaccgtgttagtacccaggcccgaccttattgacgagcgcgagcgcgttgctggtgacctgcgcgacctcgacgaccttgccccggatggcggcgcgcgtgccggcgtcgacggcgcgggacgagaggccgtcgaggcaggtgtcctcgtcggtgagcgcggcgctgcaccaggtctgcacgttgctgaggtgccacctgaacgccggcgtccccgcgcggcccatcccggcgccgcccatctcctgcgccgcgtcgcggaggtggcccacgctgtccgccagattgtccaggcagtctcgcacgggacctgccgacgccgaccccgaccccgaccccgaccccttcttcgcgcctttgccgttgctggcgccgcacaggcggcccacgtacgccgacgcggcgcgcgcgcggtccgcgctcaccgacagcgcggcgcgcgccagctcccgcgggctccgcggcggcggcgacccgccgtacgacgccaggctctgctcgcacaccgacgggtactgcgtcgtgcggcacgacttgcggacgaagtcgctggctgccggcgacgcggcggacacgagccccgctgcggcggcggcggcggcggcgagcagcaggaggggggcagcggcagcggcagcgacactgcgcgggcgagccatgattgattgtcttggtgagctgcgctgagctgagctggtgcggtgtgcggggtgtgtgtgctgtgcttgtgcagcagggcaggcaggtcacggagtcacagtggagagggtggtggctgcttcgcttgaatgattgaatgcctattgtcccggccggcctcgaggtacccaatg

SEQ ID NO: 2891 - DNA, 1278 bp, Zea mays
  Clone ID: PAT_MRT4577_91100C.1
gacaggtcaccacaaactctctgtttggcaactgggggtccggtccttgtccttccatcgatgagtgcacgacgcctctgcctgtcccaggcacaacaagacactcgtagtagaacggacgtgcctttgcctgtagccccacattggacaaaagatatctcccacattaattaatgttaatgatggcatgatcggacagaggagaacgtactgtactcctcggccgccactcataatagtacaagcttattgcccttaactaatgtatatcttacacaaacacaagcaaagcaaaccgagctattaacggacgagaaacacccaacgccgtggaggtggaggcgcctagtacactatactagtagcgggtgtggtatctgggctgggcctgggcctgggcctggatcttgggtcccctccccgtgttagtacccaggcccgaccttattgacgagcgcgagcgcgttgctggtgacctgcgcgacctcgacgaccttgccccggatggcggcgcgcgtgccggcgtcgacggcgcgggacgagaggccgtcgaggcaggtgtcctcgtcggtgagcgcggcgctgcaccaggtctgcacgttgctgaggtgccacctgaacgccggcgtccccgcgcggcccatcccggcgccgcccatctcctgcgccgcgtcgcggaggtggcccacgctgtccgccagattgtccaggcagtcgcgcacgggacctgccgacgccgacgccgacgccgatcccgaccccttcttcgcgcctttgccgttgctggcgccgcacaggcggcccacgtacgccgacgcggcgcgcgcgcggtccgcgctcaccgacagcgcggcgcgcgccagctcccgcgggctccgcggcggcggcgacccgccgtacgacgccaggctctgctcgcacaccgacgggtactgcgtcgtgcggcacgacttgcggacgaagtcgctggctgccggcgacgcggcggacacgagccccgctgcggcggcggcggcggcggcgagcagcagcagcaggaggaggggggcagcggcagcggcagcaacactgcgcggacgagccatgattgattgtcttggtgagctgagctgagctggtgcggtgtgcggggtgtgtgtgctgtgctgtgctgtgcagcagggcaggcaggtcacggagtcacagtggagagagtggtggctgcttcgcttgaatgattgaatggctatattgccgagttcgtgccggatcaaaccccggccggcctcgaggtaccca

SEQ ID NO: 2892 - DNA, 145 bp, Zea mays
  Clone ID: PAT_MRT4577_91134C.1
actctctatagtgagtcgtattactgtggccatcacagcataatcgatgccctcagatgctctttcgcttccattactgataatatctgtgcagatcttgtccctttcacccgagctgactacctctttcagagcactgattgtg

SEQ ID NO: 2893 - DNA, 3748 bp, Zea mays
  Clone ID: PAT_MRT4577_91136C.1
ccactttcttcttctcttccagaaggcctagccctccaccctccgggtaccagtgcgtgcgccgtcgacttcctctcaccttctcgactccatagcgcaccacaccagcgcggcgacagccagcccgcgaggagaaaaactagaagaggaggaacagggagagccatacatactcactggttggattcggtccaatccaatccagccggccgcggcgtgaccagccgatccagagggcgccgaatcgatctgcgggggcggcgcggcgatgcggagggctaccgctggggagcccggtcgccgcgggggatgcgcatgagggcgtccggcccgcgaatcttctggtttggcgggagcccagggggcgcgcaccccggatcggcggcgcgcggcgagggcaggatcgcgtcggtggggctgcggcagtgaccacgggcgcgggggagggtgagaagcggcaactagcacttcggaggcgagcgggcgcgatggtgagcggccacatcttccactgccggaagaactcgtggccggcggaggagtacgtcggccggaccgcgctgcagctgttggatttcgatggcggggcgccgccggagcaggcgtggcggaggcggctcaacagccacgcgaacatcctcaaggagttcagtgtcactttcatggaggcaatgaggatgatgagccttggcctgagactatggtcgtatgttcgggaggaggcgtcacatggacggaaagcaccgatcgatccgttcactaaagagcgctgtaaaccgtcagcttcccagggtgtgccacttggtgggatggggagcggaagcatttcaagaggtttcaggggagagttcaagaattggcacatcatacctggtctttgtgaaagttcgccggtcatggagaaccagttctctatatttgtatctcgagacgggggtaataagaaatactcatcagttttggctcctggacatcatgaaggtctgaagaaaaatagtgactctggaatttcttcatgggactggaatttaagtggtcaacactcgacctatcatgcattgttccctcgggcatggactgtttatgatggtgaacctgatccagaccttaaaatctcatgtcgtcagatatcacctttcattcctcatgattacaaggatagcagtcttccaacatctgtgtttgtgtatactctagtaaacactgggagagatcgtgcaaaagtaagcctgttaatgacatgggcgaattctattggaggtttttcgcataattcaggaggccactacaatgagcccttcattgcggaagatggagtatcaggagtgcttctgcatcacaaaacagccaaggataatccacctgtcacttttgctgttgctgcctgcgaaactcagaatgtgaatgtgacagtcttgccagtgtttggtctttctggagaaaaccatgtttccgcaaaggaaatgtggaacaccatgctacagaatggtcactttgatcgggaaaatttcagtgctggtcccagtatgccttcttctccaggacagaaactctgtgcagctgtctcagcctcaacttgggttgagccacatggtagatgtactgttgtgtttgctctggcttggtcctcacctaaagtaaagtttcaaaaaggatgcacatataacaggaggtacacccaattctacggaacttctgagaaatcggctgttaatttggtacatgatgccttaacaaaatataaactttgggaagaagaaattgagaagtggcaaaaccccatactgaaggatgaaaggcttccagaatggtataagttcactctttttaatgagctttactttctggtagctggggggactgtttggacagatggtcaacccccagcaatcgatgagaaaaagagtcctggttttaatcaccagaagtcctcaaagaggggtactaaagacacaaatcagggatctgttaaagatagacatgtcaacctggcagtggagcaagtacctcatggtggttacatggctaatggtgatgatcatagtgtatccaagttcgcagcagttcatggatcagaattgcaagaacaaaccaatggactcaagtcagaagagccaattccttacttgatttcaaaggatggccctgaacacgttggcaagtttttgtatctagaaggagtggaatacatcatgtggaacacatatgatgtgcatttctacgcatcttttgctctccttgatttgttcccaaaaatagagttgagtatccaacgtgattttgccaatgctgtgctgtatgaagatcggcgcaaagtaaaatttttggctgatggtacatccggaatccgcaaggctaaaggtgcagtgcctcatgacctcggaacgcatgatccgtggcatgaaatgaatgcatataacatacacgatacaagcaaatggaaagatttgaaccccaaatttgtgctccagatatacagagactttgctgctacaggtgatatgcaattcggtcgagatgtttggcctgcagtctgtgctgctatggactatatggatcagtttgaccgtgatggtgatggtctcattgagaatgatggatttcctgatcaaacctatgatgcttggactgttcatggaatcagtgcttactgtggttgtctttggcttgctgcacttcaagctgcagctacaatggctcatcgccttggggatcggcactttgctgagaagtacaagctcaagtttataaaagccaaagcagtatatgaggcgaagttatggaatgggtcatatttcaattacgacagcggcacaagtagcaacagtagatccattcaggccgatcagctggcaggacagtggtatgctgcctcgtcgggcttgcccccgcttttcgatgagcacaagataagaactgctctgcaaaaaatatttgaattcaatgtgatgaaggttaaaggaggacggatgggagctgtaaatggtatgactccaaagggaaaggtggacgagacatgcatgcaatcacgtgaaatctggactggtgttacatacgctgttgctgcaaatatgctgctccatggaatggagcatcaaggctttacgaccgcagaaggaatttttactgcgggatggtcagaagaaggatatgggtattggttccaaacaccagaaggatggaccacagatgggcattatagatccctcgtatacatgcggcctcttgccatttgggcgatccagtatgcagtttctcctcccaaggctattcttgaggcccccaaagttaacctaatggaccgaatacatatctcccctcacatggtccgagcaattagcgagataagcattagaaaggtagcacccgacaatagatgtttgcctagctctgccttccactgtgaatgctgatccgaaggtaaacatgcagctgctgagcaacttgcaacctttttcggcttttttcggtttctctccttgcccccctttcaaggtccaggtgggggctcaggagttcttttcttggatcagagggcatatccaaaccaccaccaaactcgtgactcaagagagttcatgttgtataattgtacagcaaactgttagtcacataatctttttttttccactttgaaagttttgtgctgttcacttggaatagagctagaaataaaagaactgggaagctagctggtgtctacactggcttataaaaactaaaaataaacattaaggttttttttaaa

SEQ ID NO: 2894 - DNA, 1609 bp, Zea mays
  Clone ID: PAT_MRT4577_91254C.1
agagatccagccacctgcccgcgtaacttcttcttctttcgtcgttctactcccatcctacttccaagctaccaaggacgggcgcagacggaggaccagcgccgtcgtccaatcccctactagcggcaccggcacgaaggtcagtcgtccaatcccctactaggggaacagccggcggcacgaatgcgggattcttgatgccgatttattagaagatctccatgcctgccattactgagtgaagtgatgggtagtcttcatcttgtttcatctcttcttgataaagttgttgtagatgctgcacttactctcgtcaatgatgagttgtatcctattgttactcacttgggaatcaatgcacatttccctttttaatcatagtgccttgttgacaccttttgtctctgtgcaagcaggaaggatttggaggatgacagaagctgcagttacaaggtactggtgccatggatgtgtgagggttgttgaggaggccatgggggaggagatcaagtgcccattttgtggtggtggattcattgaagagatgattggtgaggaatttgatgggttggccagccagcagtcagagcgggattcatcacaatggggagcgtcgaacaacccctttgagcagccaagggcggaggcggacagtgaggatgaagaagatgatgatgattacgatgatgatataggccgtgcatttgagagtttcatcaggaggcatgggcggccatcagctctccgtcgggcgtttgacagcatccaggacgaccttagagctgatagggatagtgacttctccattctgatcaatgccttcaaccaagccctcgctttgcaacgctcagtgcttgatgctgatgaggcccgagatgaccaaggtggatctagcaatgatgatggcttgatggaagaatatgtcctgggggctgggctaaccctgctgcttcaatatttgactgagaatgatccaagccagtatggcacccctcctgcaaacaaagaggcggttgacgctctgcccactgtccaaatagcagaggctgtcagctgttcagtctgccttgatgatcttgagctagggtcccaggcaaagcaaatgccttgtgagcataagttccactctccttgtatactgccatggcttgaactccatagctcctgccctgtgtgccggtttgagctgccatctgaagagacagaagatttggatgagcctagcaatgtggacagaacagagaacacccatgaggaagtcagggccgatggccctgaagatgacagtgagagcagtaacagagcgtgggcccttgttccttggttcagtgggctattctcaacacctgaaccacaaactgtcagaggcgctttcactgatcagcagactcgctccacttctggaaccaacatgaatgctggcgaaagctgatctcttcctcctttgtgaataatgcccatacatctgagaatagcaatggaccttgtcagtagataacttatttttctgtactgataatccttcttggatgaatcgcaaggtacaaagtttgtgacagctccattttttgccaggattttagcgatcatttcactgttgattgatttc

SEQ ID NO: 2895 - DNA, 452 bp, Zea mays
  Clone ID: PAT_MRT4577_91282C.1
gggggccacacataacaccggtctcacttattattgaacacaattatagacccctgccggaaaaaacgaagcgaggacaggattacaggaacaccccttttttgacgtagccccacgcccaccaccttttttccctcagtctcacactttcactcaccaaaagcaagcagctaccaagggccggagagggactcattattgggaaccatcaaattacacacccctgcagtacaaaattaaacaggggtgtggttgtgtgcccccgaactagctaactcggtcgccccccggccggtactacggtcaacccaaaaggggggggggctttttttcgccggtggcctcctcgggggccttgggggccttttttttctcggggggctcggggaatacctaaccccccaggggctgcttgggcttgggctccttctcctcctttttggacctctcgg

SEQ ID NO: 2896 - DNA, 466 bp, Zea mays
  UNSURE (1)..(466): unsure at all n locations
  Clone ID: PAT_MRT4577_91378C.1
  unsure (1)..(466): unsure at all n locations
ttgatcgggcagcaattgtttcagttgtaaggaaggtgccagcgttatgcgcagcgtgcttggtagatcggcaccaattgtggtttgtgtcaagatgggtagcagggcttcacaccagctagctggctgaatggtagtagttgtttctgctgtaaataagcaggagagttcaaagctgtcagttggttgaatggaagaattgctgggggtaggcaagaaaaagctggctgaaatggtggttgttgttgttgcaaataagaagcagaattcaatgcagctanngttggttgaatggaaaaaaactttgttgttgcttgagaatgtaggcagcaagggtttgctagcacaagttgttgtagttgttgtgcctgatgntttgtgcaataaatgaccaaaggtaactgatgtaatagggctgatgattgttggagaaccagggtgataaaggtaagatgccagctgtgat

SEQ ID NO: 2897 - DNA, 264 bp, Zea mays
  Clone ID: PAT_MRT4577_91459C.1
tgattgagaccaactagcaacatacaaagcacaatagtgtaccaacaatgttagccaaaatattttgcctccttatgctggatggtctttctgctagtgctgctacttactaccatcttaccgtaatgctcataagctcctatagcttttctttttaccccatacctcttaccaactttgtcttcagtatgttaaaacccaattctttaaccctacatgatccaacatgcaatctcatcattgcatttttacctttatcatcct

SEQ ID NO: 2898 - DNA, 1755 bp, Zea mays
  Clone ID: PAT_MRT4577_91500C.1
gcgtgagatcgaggagaagaaggcaagcaggcagagaaagagagagagagagagagatggatgaggagtacgacgtgatcgtgttggggacggggctcaaggagtgcatcatcagcggcctcctctccgtcgatggcctcaaggtccttcacatggacaggaatgactactacggaggagaatcttcgtccctgaatctaaccaagctctggaacaggttcaagggcaacgacagccctcccgagcacctgggcgtcagcaaagagtacaacgtcgacatggtgcccaagttcatgatggcaaacggcgcgctggtccgcgtcctgatccgcaccagcgtgaccaagtatctcaacttcaaggctgttgacgggagctttgtgtacaacaatggcaagatccacaaagtcccggcaaccgacgtggaggccctcaagtcgaacctgatgggcctgttcgagaagcggcgcgcccggaagttcttcatatacgtgcaggactacgaggaggacgaccccaagtcccacgagggcctggacctcaacaaggtcaccaccagggaagtcatctccaaatacggattggaggatgatacggtggactttatcgggcatgcgctagcacttcaccgggacgacagctaccttgacgagcctgcaatcgacactgtcaagaggatgaagctctatgcagaatcactcgcacgctttcaaggagggtccccttacatctaccctctatacggtctgggagagctccctcaggcctttgcccgcctgagcgctgtttacggtggcacgtacatgctgaacaagccagaatgcaaggtcgagtttgatgagagtggaaaagcgtatggagtcacttctgaaggggagaccgccaagtgcaagaagatcgtctgcgatccttcgtatttgccagacaaggtgaagaaggttggaagggtggcccgcgcgatatgcatcatgaagcatcctatcccggacaccaaggactcgcactccgtgcagatcatcctccccaagaagcagctaaagcgcaaatccgacatgtacgtgttctgctgctcctacgcccacaacgtcgcgcccaaaggcaagttcatcgccttcgtctccaccgaggccgagaccgacaagcctgagatcgagctcaagcccgggatcgacctgcttggccctgtagaggagaccttcttcgacatctacgacagatatgaacccgtcaacaaccctgacgacgactgctgtttcctcacaaatagctatgactccaccacccattttgagacgacggtcaaggatgtgctcgccttgtacaacaagatcactggaaaggagcttgatctctcagtcgatttgaacgcggctagtgctactgagcaagaagctgcttgaacaccccggcggcctctttttttgcagctctacacaatagctatttcttcgattttttttttaaaatgttccatagatggataagtttattgatgaaatccattattgtatgttttttggagttccgtttttgtcacatgcatgtaatgaacaacggtggcaatcatctataaaggttccattattcgctcgcgaaaaaaaaaaaaaaaaaaaaaaaaaaaaaaactagtgagaaaaaaaaataaacaaccaaaaaaaaaaaaagacaaaaaacgcgcatacacaagaaaaaaatatagaacagcgtcaaatcataaacaacgagacactatatggagcataacattaaaaatta

SEQ ID NO: 2899 - DNA, 2096 bp, Zea mays
  Clone ID: PAT_MRT4577_91548C.1
tgggaccctcgggccggccgggccctcgttgccttcacactcctctctgcctgccttccaccgcactgcgctgctcttccttccttccttcccgtctcttcttcccacttccttccacttcttgtccctgctcctgttggttttagcatcctgctcggccgaatgctggatcagaggctgcagcaaaggtagtaagtcgcttctcgtatttcccgtcgagagagggacagggggggagaacccccaaccgaggcgctgcaagttccccacggccggggcgggcttctcttgcgggaacatgaggaagctgttgttcatctccttcgtcctctcgctgtccgctgcagcagttcacggtgaagacggtgcgtacattggcgtgaacattggcacggccatgtcgtcggtgccagcgccgacgcagatcaccacgctgctccggtcgcagaacatccgccacgtgcgcctctacgacgcggacccggcgatgctggcggcgctgtccaacaccggcatccgcgtcatcgtgtccgtgcccaacgagcagctgctggccatcggcaactcgaacgcgacggcggccaactgggtggcgcgcaacgtggccgcgcacttccccgccgtgaacatcacggccatcgccgtggggtccgaggtgctctcggcgcagccgaacgcggcgccgctgctcatgcccgccatgcgctacctccagaacgcgctggtggccgcggcgctggaccggtacatcaaggtctcgacgccgcactcgtcgtccatcatcctcgactcgttcccgccgtcccaggccttcttcaaccggtcgctggacggcgtgctggtgccgatgctcaggttcctgcagtccacggggtcgccgctcatgctcaacgtgtacccttactacgactacatgcgctccaacggcgtcatcccgctggactacgcgctgttccggccgctgccgcccaacaaggaggccgtggacgccaacaccctgctgcactacaccaacgtgttcgacgcggtggtggacgccgcctacttcgccatggcgtacctgaacgtcaccaacgtgccggtgatggtgacggagaccgggtggccgcacaagggcgactcctcctccgagcccgacgccacctccgacaacgccgacacgtacaacagcaacctcatccggcacgtgatgaacagcaccggcacgccgaagcaccccggggtggccgtgccgacctacgtctacgagctgtacgacgaggacacccgcccgggctccacgtcggagaagtactggggcctgttcgacatgaacggcgtccctgcctacaccctgcacctgacgggctccggcgtcctgctggccaacgacacgacgaaccagacctactgcgtggcgcgggagggcgcggaccccaagatgctgcaggcggcgctggactgggcgtgcggccccgggaaggtggactgctccgtgctgatgcagggccagccgtgctacgacccggacaccgtggacgcgcacgccacgtacgccttcaacgcctactaccacggcatgggaatgggctccgggacgtgctacttcagcggcgtcgcggtggtcacgacgaccgacccgagtcacggatcttgtgtttatgctgggaagaacgggacgtcgttgatgaacggcacctccctggcgccgtcgtccaactccacggagggaggctccggcgcgcaccgggcgttcggcgacgtctcgtcactcgtccgcatcgtctccaccgcgctgctcttcagcgtcgtcctcctcctgttgtaggcagtagttagtactagaggtagaaggcaccttggaatggaaccatgcagtctttgcagaattaggcattggagagggagggatgattctttttgctgtcaagtggcgggccgggaacgttctgatgatctattctcccgtctggtattggtatggtatggaacaaaaattggtttgcatcccctgatatgatgctcttgtcatctgctgggtttctctattggcatcgaacggaaagcaattgctccgttgagcaaaaaaagaaaaaaaaaaaaaaaaaaggccccta

SEQ ID NO: 2900 - DNA, 738 bp, Zea mays
  Clone ID: PAT_MRT4577_91549C.1
ccggccgggagtgcgctgcacttccttccttccttcccgtctcttcttccccctcccttcccttcttggccctgctcctgttggttttagcatcctgctcggccgaatgctggatcagaggttgcagcaaaggtagtaagtcgcttcttgtatttcccgtcgagagagggacaggggggagaacccccaaccgaggcgctgcaagttccccacggcccggaacatgaggaagctgttgttcatctccttcgtgctctcgctgtccgctgcagcagttcacggtgaagacggtgcgtacattggcgtgaacattggcacggccatgtcgtcggtgccagcgccgacgcagatcaccacgctgctccggtcgcagaacatccggcacgtgcgcctctacgacgcggacccggcgatgctggcggcgctgtccaacaccggcatccgcgtcatcgtgtccgtgcccaacgagcagctgctggccatcggcaactcgaacgcgacggcggccaactgggtggcgcgcaacgtggccgcgcacttccccgccgtgaacatcacggccatcgccgtggggtccgaggtgctctcggcgcagccgagcgcggcgccgctgctcatgcccgccatgcgctacctccagaacgcgctggtggccgcggcgctggaccggtacatcaagggtctcgacgccgcactcggcgtccatcattctcgactcgttcccgccgtcccagccct

SEQ ID NO: 2901 - DNA, 955 bp, Zea mays
  Clone ID: PAT_MRT4577_91553C.1
gccggccgggccgggatttataaccccaagttgccttcgccgtctgcctgactgcctgcctccactcctctcccttcccttcgcgtctcttcttcccccttccacttcttggccgagcccctcttggtgttggcatcctgctcgatcgaagaatgctggatcaggcatattggaggttgcagtaaaggcggtaggtgcttttcttcttccccgttggtggttagagggactggggagaactacaacagattggaggctgcaagttctcgggaggagccgggcttctcttgcggcggcaaacatgaggaagctcttcttcgtctacttcgtcctcctgctggccgctgcagtagttcacggtgaagatggtgcgtacattggcgtgaacattggcacggccatgtcgtcggtcccggcgccgacgcagatcaccacgctgctccgctcgcagaacatccgccacgtccgcctctacgacgccgaccccgccatgcttgcggcgctctccaacaccggcatccgcgtcatcgtgtccgtgcctaacgagcagctgctggccatcggcaactccaacgcgacggcggccaactgggtggcgcgcaacgtggccgcgcacttccccgccgtcaacatcacggccatcgccgtgggctccgaggtgctctccgcgcagcccaacgcggcgccgctgctcatgcccgccatgcgctacctccagaacgcgctggtggccgcggcgctggaccggtacatcaagatctcgacgccgcactcgtcgtccatcatcctcgactccttcccgccgtcgcaggccttcttcaacaggtcgctggacagcgtgctggtgccgatgctcaagttcctgcagtccacggggtcgccgctcatgctcaccgtgtacccttactacgactacatgcgctccaacggcgtcatcccgctggactacgcgctg

SEQ ID NO: 2902 - DNA, 1086 bp, Zea mays
  Clone ID: PAT_MRT4577_91585C.1
gccggccgtttcggggcctcgaggccggccgggccgggcctcaaagccagcgtagataaacgtcgaccattatgggaccttacagcaccgccgtcgccgtaagcgcatcgccggtcctgcaggcttcctcactcttgacgcgagcccgtggttcttggaggcccacggtggcggcgttgcggctttctgcttccgtgaaatgccgtcggcgggcactcaccgtgacctgtgcgctcccggagaaagaacggccggcggcattcaacatcccgcccactgctctgctgtgccccgtgcccccgccggacggcaaggaacggtgggacatcaaggaggaagatgaccgcgtcacgctgtggctccaggtgccagggctgtcggcgagcgacatcgaggtgaccaccagcgaggacgtcctcgagatcaaacgcagggtcgtcgccccacagcagccggcgcccgtggacgcgcacggcgtcggcgcgttccacatccggctgctgttgaccaaggagtacgacggcagcaacgtcacggccgatctcaaggccggcatgctggaggtcaccgtccacaagaacccgcaacgccccggcgaacgcgccgtgatgatgggggcgaccaagcccccgcccgagccccgtcaaaacgaggagagcagtaccaaccaaaggtcctcgaccgcaagaaaggaaaccggaacccccatggggagacaaaatccaaatggagtctagctggttgagggctcggaccctgctttgaataagcttctcatttctagctgcggatggactcaaaccagcaatcgccttctgttatatcaattgcctggagagagcttacgctgcttgtagtatcatgtgtgtttccttaaaaaaacccttctttgtttctttatttattatgagggtttttttttggtgtgcggtcacacagagtgaaaacaattccattttctaagcaaaattccaatggtcgtcttccctgtactgcaaaatacaccttagactttgtttaggtattgtaatattaactctaatccacgtgtgttgaagtggattgatatataaattagtttaagtt

SEQ ID NO: 2903 - DNA, 275 bp, Zea mays
  Clone ID: PAT_MRT4577_91680C.1
gcagtacctgtcaccagaggtgtatacactatgtgaaaacccacttctacaaccctacaagatacagcaggcgatgacagctggaattgtacctttatcacccttgatacttcaacaatcatcagacctattacatcagatacctttggtgcatattattgacacaaaacatcgtggcacatcaactacaacaacttgtgctagcaaaccttggtgtctactctgagcaacagcagttgctttcattcaaccaactagctgcattgaactctgct

SEQ ID NO: 2904 - DNA, 1857 bp, Zea mays
  Clone ID: PAT_MRT4577_91692C.1
gccggctttatccagggacacgagccacccatggtttcgtatcaggaaaagctttctttatatatattcgggcattgcgttatcgtgtagctttgcagaacagagaaggagaagggggagctgtaatcctacctaagaagcggcgatggggcggtcaggaggcggcgacggggacggcgacggcgaccggctcctcctcggcaagcccttggagtcgtcgtcgtcgtgcagctcgtccgacgagagcctggtcaagagaaccggcacggtatggacggcgatggcgcacatcatcacggcggtgatcgggtccggcgtgctgtccctggcgtggagcgtggcgcagctggggtgggtgggcgggccggcggcgatggtgttcttcgccggcgtcaccgcggtgcagtccaccctcatcgccgactgctacatctgccaccacccggagcgaggcgtcgtcaggaaccgctcctacgtcgacgccgtgcgcatctacctgggcgacaagagccatttgttttgcggcttcttcctcaacctgagcttgtttggcaccggtgtggtgtacacgctcacttccgccactagcatgagggcgatccggaaggccaattgctaccacagggaaggccacgacgcgccgtgctcggtgggaggggacggctactacatgctgctcttcggcctcgcgcaggtgctgctgtcgcagatacccaacttccacgagatggcggggctctccatcttcgccgccgtcatgtcctgcttctacgccttcgtcggcgtcggcctcggcgtcgccaaagtcatcgcaaacggggtgatcatgggcggcatcggaggcatcccgctggtgtccacgacgcagaaggtgtggcgagtctcgcaggccctcggggacatcttgttcgcctaccctttctcgttggtgctgctggaaatagaggacacgctgaggtcgccgccgccggagagcgagacgatgaaaaaggcgacgagagcgagcatcgctatcaccaccctcttctacctctgctgcgggtgctttggctacgcgtcgttcggcgacggcaccccgggcaacctcctcaccggcttcggcttctacgagccctactggctcatcgacctcgccaacctcgccatcgttctccacctcctcggcggctaccaggtgtacacgcagccggtgttcgcgttcgcggaccgcaagttcggcggcggggccacggtcgtcgaggcgccgctgctgccggtgccgggcgcgcgccgcgtgaacgcgaacgtgttcaggctgtgcttccgcacggcgtacgtggcggcgaccacggcgctggccgtctggttcccctacttcaaccagatcatcgggctgctcggctccttcaccttctggccgctcgccgtctacttccccgtcgagatgtacctcacgaggaacaaggtggcgccgtggaccaaccagtggctcgccatccatgcgttcagcctcgtctgcctgctcatcagcgcgttcgcctccgtcggctctgcggttggcgtgttcgggtcggagacgagctgattcaaactctgcaaatgcaattgccggccacttttcggacatgcatgttctgtgcatatactgcgcttgtatatttagcgttatacctagtactgggacggtcaggccgggccccgagcctcgtgcttaggctcaaacgggtctgggcccataaggtccaaatttttttttggatcataccgtgtcagccgtagaaatagtggtttagtcaggctctaaaacacttcctatctttgttgggccatgccgacccatatatttaaattatataaaattcaaatattacaacgaaa

SEQ ID NO: 2905 - DNA, 351 bp, Zea mays
  UNSURE (1)..(351): unsure at all n locations
  Clone ID: PAT_MRT4577_91694C.1
  unsure (1)..(351): unsure at all n locations
gttgtgtttatccaaggacacgctgaggggggggccgccggtgagtgagacgatgaaaaaggcnacnagagcgagcatcgctatcaccaccctcttctacctctgctgcgggtgctttggctacgcgtcgttcggcgacggcaccccgggcaacctcctcaccggcttcggcttctacgagccctactggctcatcgacctcgccaacctcgccatcgttctccacctcctcggcggctaccaggtgtacacgcagccggtgttcgcgttcgcggaccgcaagttcggcggcggggccacgatcgtcgaggcgccgctgctgccggtgccgggcgcgcgccgcgtgaacgt

SEQ ID NO: 2906 - DNA, 2985 bp, Zea mays
  Clone ID: PAT_MRT4577_91710C.1
gcacgaggcgagacgcgtcgcctcctcccttcccccaccccgccgccgccctcgcgtccgtccgtccgtgcctagttattagggttcggtcgccgccatggcgatcctctcggcgctcgccaccgaggtgctcatccccgtcgccgccgtcatcggcatcgccttcgccgtcgtgcagtgggtggtcgtgtcgcgcgtgaagctctccccggccgcgtccggcggcagcggcggcaaggccggctacgccgactccctcatcgaggaggaggaggggctcaacgaccacaacgtcgtcgtcaagtgcgccgagatccagaacgccatctccgaaggagcaacatcgtttcttttcaccgagtaccaatatgttggtatcttcatggctatcttcgctgttgtgatcttcctcttccttggttcggttgagggattcagcacgaagagccagccctgcacatatagcaaggacaagtactgcaagcctgcgctgttcactgcactctttagcactgtgtccttcttgcttggagccatcacctctctggtctctggtttccttggcatgaagattgccacatatgcgaatgccagaactaccctggaagctaggaagggtgttggcaaggcttttatcactgctttccgctctggcgctgttatgggtttcctgcttgcatcaagtgggcttgtggttctgtacatcacaattaatgtatttaagttgtattacggtgatgactgggagggtctttttgagtccatcactggctatggtcttggtgggtcgtccatggctctcttcggaagagttggtggaggtatctacacaaaggctgctgatgttggtgccgatcttgttggaaaggtcgagaggaacattcctgaggatgatcctaggaacccagctgtgattgctgataatgtcggtgacaatgttggtgacattgctggaatgggatctgatctctttgggtcatacgcagagtcttcttgtgctgcccttgttgttgcgtctatttcatctttcggaatcgaccatgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccaccgttctgatgacttttggtattgctctaatcagctggttggcccttccagctaagttcaccatctacaacttcggtactcagaaggaggtttccaactggggtttgttcttctgtgtttcaattggtctgtgggctggtttgattattggttttgtcacagaatactacactagcaatgcatacagtcccgtgcaagatgttgcggattcgtgcagaactggtgctgccactaatgtcatttttggtcttgctcttggatacaagtcggttatcatcccgattttcgctattgctgttagcatctatgtcagtttctccattgctgcgatgtacggcattgcagttgccgctcttggtatgctgagcacaatcgcaactggtcttgctattgatgcttatggtcccatcagtgacaatgctggtggtattgctgagatggctggaatgagccacagaatccgtgagagaactgatgctcttgatgctgctggcaacacaactgctgctattggaaaggggtttgccattggttcagctgctcttgtgtccctggcgctttttggtgcctttgtcagcagagctggagtgaaggtcgtcgacgtcctctcccccaaggttttcattggtttgattgttggagccatgcttccctactggttctctgccatgaccatgaagagtgttggaagcgccgccctgaagatggtggaggaggtccgcaggcagttcaacaccattcctgggttgatggagggaacagccaagcccgactacgcaacctgtgtgaagatctccactgatgcttccatcaaggagatgattcctcccggcgctctggtcatgctgactcccctcatcgttggaaccctcttcggcgtcgagactctctccggtgttcttgctggtgcccttgtttctggagtgcagatcgccatctctgcctccaacaccggcggtgcatgggacaatgccaagaagtacattgaggctggggccagcgagcacgcgaggaccctcggtcccaagggatccgactgccacaaggccgctgtgatcggtgacaccattggtgaccccctgagggacacctccggcccgtccctcaacatcctcatcaagctcatggccgtggagtccctcgtgtttgcccctttctttgccacccagggtggcctgctcttcaagtacctgtaaaaggggcaacaccaagcacacagcagaagtatacgatctcccgaccgaccgtggacaatatcgaataactcctgccaaatcgccagttctttttgtgtactgtgcgctagccgccgcctagctgcactgctgtatttttgtttcaggattgctgctgctgttcgcacattccatctttggctcctcccggagccgccggaggcgcgtttttactgttagccttactactcttactccctgtagctccacgtagaagagaactgttgtcctgcaggtctggcaaattttcccagtctcttgatgatggcgatgatgttgaaatctttttttgaacaatgatacatgatgattgttgcgttgaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaatggggggggccgttttaaaggaaccaagtttatatcccctttcttgcaacgtattatttttttttttgggacaccaaaatcaatttcactgcccgacttttaaaaacttggggattggaaaaac

SEQ ID NO: 2907 - DNA, 3058 bp, Zea mays
  Clone ID: PAT_MRT4577_91711C.1
ggccgcgggttttttttttttttttgccgaagaagagaaatatattatcccctgagcccacctgccatcccgggccagcccaccagcaaaaggctctaaaacaggacagcccacagacactgacacacaggcctgcagcttttacacctaacccttccaagttaatcgcattcacgacccgccccttctctcctggccacctccatcattccacactccccttccacatgcaccttccccgctatataagacacgcgccccgagctcagggaagagagctgcagagagcgtgacgcgtctcccacacggccgccgccctcgccttcgtgcgttccccgcgtagagtttagggttttgtcgccgccatggcgatcctctcggcgctcgccaccgaggtgttcatccccgtcgccgccgtcatcggcatcgccttcgccgtcgtgcagtgggtgctcgtgtcgcgggtgaagctctccccggctgcagccgcgtccggcggcagcaagaacggctacggcgactacctcatcgaggaggaggaggggctcaacgaccacaacgtcgtcgtcaagtgcgccgagatccagaccgctatctccgaaggagcaacatcgtttcttttcactgagtaccaatatgttggtatcttcatgtccatctttgctgttgtgatcttcctcttccttggttcggttgagggattcagcacgaagagccagccctgcacctatagcaaggacaagtactgcaagcctgcactgttcactgcactctttagcactgtgtccttcttgcttggagccatcacctctctggtctccggtttccttggcatgaagattgccacatatgcgaatgccagaactaccctggaagctaggaagggtgttggcaaggcttttatcaccgcttttcgctctggtgctgttatgggcttcctgcttgcatcaagtgggcttgtggttctgtacatcaccattaatgtatttaagttgtattacggtgatgactgggagggtctttttgagtctatcactggctatggccttggtgggtcgtccatggctctctttggaagagttggtggaggcatctacacaaaggctgctgacgttggtgctgatcttgttggaaaggtcgagaggaacattcctgaggatgatcctaggaacccagctgtgattgctgataatgtcggtgacaatgttggtgacattgctggaatgggatctgatctctttgggtcatatgcagagtcttcctgtgctgcccttgttgttgcgtctatttcatctttcggaatcaaccatgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccactgtcctgatgactgttggtattgctgtaatcagctggttggcccttccagctaagtttaccatcttcaactttggtactcagaaggatgtctccaactggggcttgttcttctgtgttgcaattggtctgtgggctggtctgattattggttttgtcacagaatactacactagcaatgcatacagtcctgtgcaagacgttgcagattcttgcagaactggtgctgccactaatgtcatttttggtcttgctcttggatacaagtcagttatcatcccgattttcgctatcgctgttagcatctatgtcagtttctccattgctgcaatgtacggcatcgcagttgccgctcttggtatgctgagcacaattgcaactggtcttgctattgatgcttatggtcccatcagtgacaatgctggtggtattgctgagatggctggaatgagtcacagaatccgtgagagaactgatgctcttgatgctgctggcaacaccactgccgctattggaaagggatttgccattggttcagctgctcttgtgtctctggcgctttttggtgccttcgtcagcagagctggagtgaaggttgtcgatgtcctctcccccaaggttttcattggtttgattgttggagccatgcttccctattggttctctgccatgaccatgaagagtgttggaagtgccgccctaaagatggtggaggaggtccgcagacagttcaacaccattcctgggttgatggagggaactgccaagcctgactatgcaacctgtgtgaagatctccactgatgcttccatcaaggagatgattcctcctggtgctctggtcatgctcactcccctcattgttggaaccctcttcggtgttgagactctctctggtgttcttgctggtgccctggtttctggagtgcagattgccatctctgcttccaacaccggtggtgcatgggacaatgccaagaagtacattgaggctggtgccagcgagcatgccaggaccctcggccccaagggatctgactgtcacaaggctgctgtgataggtgacaccattggtgaccccctgaaggacacctcgggcccgtccctcaacatcctgatcaagctcatggcggtggagtcccttgtgtttgcccccttcttcgccacccacggtggcctgctgttcaagtacctgtaagggccacaccaatcatcacagcagaaatatacgaccgaccgaccgtggacatctcgaataactcctgccaaatcgccagttcatgtgtattgtgcgctagccgcctagctgcactgctgtttttttggtctcattgttcgtattttctccttggccccctccccctagaggcgttactgttagccttactcttactccctgtagctgcacgtagaagagaactgttgtcctgcaggtctggcaaattttcccagtctcttgatgatggcgatgatgttgaaatctttgaacaatgatacatgattgttgcattttactggtggtatggtatctcgtacatcgtattggactgcaaaaaaaaaaaaaaaaaaaaaaaaaaaactcgaggggggggcccgggtacc

SEQ ID NO: 2908 - DNA, 382 bp, Zea mays
  UNSURE (1)..(382): unsure at all n locations
  Clone ID: PAT_MRT4577_91728C.1
  unsure (1)..(382): unsure at all n locations
ggtcgactcgggccaattttaattttataaaagtaaatattcagaactccagctccaaactaacagaaacaactttgttcgcatcgacaaacttaaacaaaaatgcgtggggcacgactaccgggggcgataaatgccatagcacaaatactgatcgccgcataagatagcacttcttcggtgggaccaaactttactcggcatcctcattggcgncatctgcgccgcccggggagttgagttggttgagcctttcaatgagactggccttcctttggtcgttcgttngttttttgggggtgtcccttttgggctcctttggtgggtggttggttggctggcccccccncgggtcctcccgggtgggggcttggcccttttt

SEQ ID NO: 2909 - DNA, 1424 bp, Zea mays
  Clone ID: PAT_MRT4577_91807C.1
ttggccgggaaaacgttttcccctggaatgggaaaagagaaaaacggagattccttgccccctttccccttcaccatcgtcgaaaccctagccccgcctcgccgccggcacgccggatcggtcggtgccatgtccaaggccagggtctacgccgacgtcaacgtgctgcgccccaaggagtactgggattacgaggcgctcaccgttcaatggggtgagcaggatgactatgaagttgtcaggaaggtcgggagaggaaaatacagtgaagtatttgagggtattaatgttaacaataatgagaaatgcatcattaagatcctcaagcctgtgaagaaaaagaagatcaaaagagaaattaaaattcttcagaatctttgtggaggccctaacattgtgaagctgctcgatattgttagagatcagcattcgaaaacgcccagcttgatctttgaatatgttaacaacacagatttcaaagtgctgtacccaacattaacagattatgacattcggtattacatctacgagttactcaaggcattagattactgccattcacaaggtattatgcaccgagatgtgaagccccacaatgttatgatagatcatgagcttcggaaactccggctgatagactggggtcttgctgaattctatcatcctggcaaggaatataatgtccgtgttgcatccaggtacttcaaggggcctgagcttcttgttgacttgcaagattatgattattctttggacatgtggagtctgggctgcatgtttgctgggatgatttttcgtaaggaaccatttttctacgggcatgacaaccacgatcaacttgttaagatagccaaggtacttgggacagatgggctgaatgcttatttgaacaagtacagaattgagcttgaccctcagcttgaagccctcgttggaaggcatagcaggaaaccctggttaaagtttatgaatgcagataaccagcacctagtgtctcctgaggccatagatttccttgacaagcttttgcgttatgatcatcaggagaggcttactgcacttgaagctatgacgcacccgtacttccaacaagtgagagccgctgagaacagcaggacgcgagcgtgacaggcaaagagcgaagaccatctgctcttttatcagtcagtcaggttgtatgagatgagtagccgttgggtcacttggcagaaaataaacaatagcggtagagcctgtactgtactgtactgtacgtaacgtaacctcctcgagaaggggttgtgaggtttgggacgtgattgcgaacatggtatattaatgatgattgttcatgtaagatgtttgtcataaaatgtttgtccgtttgctgttgagttcttgggggctactttcccgtatttaggtcaagtcaaaaaacttgaggc

SEQ ID NO: 2910 - DNA, 807 bp, Zea mays
  Clone ID: PAT_MRT4577_91808C.1
gggtacctcgaggccggccggggagcgccatccagctaggagtaccgagtgcactctgtctctgcagtatccttcccggccgatctgcatttcagtcgttccacaccgtcgttggccggcccatagctctccccctcctggttagtgtagtgagcgcagcgacgagtgcaacggtgagagtaccgagatggctgagggaagaggcagtgcaagggccatcggcgccatggcgttcgccgttgcctgctgctactgctgcgtcgccatcgccgacgcagccaccacctactacgtcggggacagcaacggctggtccttcagcagccccagctggcccaacggcaagcacttccgcgccggagacactctcgtgttcaggtacatcccctggatccacaacgtggtggccgtggacgaggacgggtacaacggctgcacgacgccgccggggtcgcggacctacacgtccggcgccgacagcgtcacgctcgccaggggggacaacttcttcatctgcacccggttcggccactgcaacctcggcatgaagctcgtcgtctatgccgcgtgatctgtcagagctagcgactggtggtggtattgttgactgggtgcgctcaatgatcggctgtgcttgctctcgagcgaactggtctgtttgatttgtgctatttcgtgtaggctcagtcagtcgcttggttctaatccgtaacggcttctactacttttacaatgttgttgtaacaatacaaacatccagctttaattgaagctaacggatatcgcatgtttgaacatttgctctcc

SEQ ID NO: 2911 - DNA, 1708 bp, Zea mays
  Clone ID: PAT_MRT4577_91809C.1
agcatttgttttaccattaccatttgggttacattttttgaaccaaacagcaccttacatgaacaatcattaatataccatgttcgcaatcacgtcccaaacctcacaactcctcgaggaggttacgttacgtacagtacagtacaggctctaccgctattgtttattttctgccaagtgacccaacggctactcatctcatacaacctgagtctgactgactgataaaagagcagatggtcttcgctctttgcctgtcacgctcgcgtcctgctgttctcagcggctctcacttgttggaagtacgggtgcgtcatagcttcaagtgcagtaagcctctcctgatgatcataacgcaaaagcttgtcaaggaaatctatggcctcaggagacactaggtgctggttatctgcgttcataaactttaaccagggtttcctgctatgccttccaacgagggcttcaagctgagggtcaagctcaattctgtacttgttcaaataaacattcagcccatctgtcccaagtaccttggctatcttaacaagttgatcatggttgtcatgcccgtagaaaaatggttccttacgaaaaatcatcccagcaaacatgcagcccagactccacatgtccaaagagtaatcataatcttgcaagtcaacaagaagctcaggccccttgaagtacctggatgcaacacggacattatattccttgccaggatgatagaattcagcaagaccccagtctatcagccggagtttccgaagctcatgatctatcataacattgtggggcttcacatctcggtgcataataccttgtgaatggcagtaatctaatgccttgagtaactcgtagatgtaataccgaatgtcataatctgttaatgttgggtacagcactttgaaatctgtgttgttaacatattcaaagatcaagctgggcgttttcgaatgctgatctctaacaatatcgagcagcttcacaatgttagggcctccacaaagattctgaagaattttaatttctcttttgatcttctttttcttcacaggcttgaggatcttgatgatgcatttctcattattgttaacattaataccttcaaatacttcactgtattttcctctcccgaccttcctgacaacttcatagtcatcctgctcaccccattgaacggtgagcgcctcgtaatcccagtactccttggggcgcagcacgttgacgtcggcgtagaccctggccttggacatggcgccgaccgatccggcgtgccggcggcgaggcggggctagggtttcgacgatggggaagggaaaagggggcaaggaatctccgtttttctctttccaggggaaaacgttttgggaataaagctaggtggtgggggtgctgtggtcagacagagtggccgacgtgtgggccctcttcctgttcgggcggggggcaggccatgtaacttttgtccgccggcgggatggggtcctcaccgcaccggagccggaggagatcagatatctcgctggctgacaacctcaacctgtcgagctcatttccgaccaaccaagaagatggcgatctcagcctagttgtcaacttgtcatcagatgctcatgcatgccacgtaatccgtcgtctaaatccactactcgatcgaaacacttctggcataattcatacacttttgtcggtctcagtctcagtg

SEQ ID NO: 2912 - DNA, 300 bp, Zea mays
  Clone ID: PAT_MRT4577_91841C.1
gtgggttggcttctcctccccctccggttcgttttcaggttcgcgaggttctcctgacttcggtttcgggggtcagcggatcgagatctcggcgtctgatgctgagtaccgctacttcatcagcggcctctactgagccaccgactaccacttcctacacaacgccttcatcacctacagcgacgtcctttagtccaagatcatcctggatcgctatacgcataggtcccgcggcttctgcttcatcaccttctacacggacgacgcgatgcggaacgccataaagggcatgaactgcaa

SEQ ID NO: 2913 - DNA, 1432 bp, Zea mays
  Clone ID: PAT_MRT4577_91890C.1
tcgagccggcgggagaactcagacttgtccagccaacagtggcgttcatgaggaaggcgggggtgacctccgcctccagtggtggaggagaaggatggccgtgcggtggtggcctcaacctcggtgtgaagctgaacgtgctgctactgctgtcggtggtggccaccaatcgtgctgtgccctgtcaccactcgtctccctcctgcgtcctccactccgtgcccattgggtccctcgaggccggccggggaaataccaattgccacttcgcgccgtcccgcacgacggcacgagtcatcgtcgccttcccctccctccacacgccaaacgcgaactcccgtgccgtgacctcccgatctccggcgatggccgcgcggcgcctcggatcccccgcctctaggtggctgcgcccgtccgcgctgctcctcctggtcgcttctgctctcctctcggccccgtcgccggcccgcgcgctgcggttcgacctcgagtccggccacaccaagtgcatctccgacgagatcaaggttaacgccatggccgtcggcaagtaccacatcgtcagccccgaccccaacttccccgatgcccagctccccgaatcgcaccgcatctccctcagggtgacgtcgccgtacgggaacagcatgcactacgcggagaacgtgcagtcgggccacttcgccttcacggcggcggaggccggcgactacctggcctgcttctgggcgcccgaccataagccaccggtcaccatcgggttcgagttcgactggaggagcggcgtctccgccaaggactatcccagcgtcgccaagaagggcaaggtcgatatgatggaattggagctgaagaagctagaggaaactataaaaaatatacatgaagagatgttttatctgcgtgaaagggaagaggaaatgcaggacctgaacaggcgaacaaactcaaggatggcttggttagggttcctctcccttggcgtctgcttatcggtggcaggtttgcagctgtggcacctgaagaccttctttgagaggaagaagttgctgtagttgccccatcggtatatttttgggtgaactgtcgatctgttacagagcttggaatcccatgtagcaaacgctatgccagatactagagaaatatgcttcacaatgcttggaatcccatgtagcaaacgctatgccagatacttgaaaaatatacttcactatgcgtcccatgtagcaaacgctatgccagatactagagaaatatgcttcactatgctttagcctgtccagtgaacctctaaggaacttcaaagagaaactaaattgtcttcattttagctcgtgttgtaatttggacatctggattctggagcagtgttgactttttttaaaaaaaaaaaaaaaaaaaaaaaaaactcgagggggggccgacacca

SEQ ID NO: 2914 - DNA, 1373 bp, Zea mays
  Clone ID: PAT_MRT4577_91891C.1
caactgtcctcaatccagcagccctcgagtctcgtccccgcacatcagcagagagacgccactaccaccaccgcaagcgacgacggggagatgtttctgcgacggatcctgaccggcggaggtggccacgcgtccggtcgccttcccctccctccacacgccaaacgcgaactcccgtgccgtgacctcccgatctcaggcgatggtcgcgcggcgcctcggatcccccgcctgtaggtggctgcggccgtccgcgctgctcctcctggtcgcttccgctctcctctcggccccgtcgccggcccgcgcgctgcggttcgacctcgagtccggccacaccaagtgcatctccgacgagatcaaggttaacgccatggccgtcggcaagtaccacatcgtcagccccgaccccaacttccccgatgcccagctccccgaatcgcaccgcatctccctcagggtgacgtcgccgtacgggaacagcatgcactacgcggagaacgtgcagtcgggccacttcgccttcacggcggcggaggccggcgactacctggcctgcttctgggcgcccgaccataagccaccggtcaccatcgggttcgagttcgactggaggagcggcgtctccgccaaggattatcccagcgtcgccaagaagggcaaggtcgatatgatggaattggagctgaagaagctagaggaaactataaaaaatatacatgaagagatgttttatctgcgtgaaagggaagaggaaatgcaggacctgaacaggcgaacaaactcaaggatggcttggttagggttcctctcccttggcgtctgcttatcggtggcaggtttgcagctgtggcacctgaagaccttctttgagaggaagaagttgctgtagttgccccacggtatatttttgggtgaactgtcagatgtgttacagagcttggaatcccatgtagcaaacgctatgccagatactagagaaatatgcttcacaatgcttggaatcccatgtagcaaacgctatgccagatactagagaaatatacttcacaatgcttggaatcccatgtagcaaacgctatgccagatactagagaaatatgcttcacaatgcttggaatcccatgtagcaaacgctatgccagatactagagaaatatacttcactatgcttggaatcccatgtagcaaacgctatgccagatactagagaaatatgcttcactatgctttagcctgtccagtgaacctctaaggaactttaaagagactaaattgtcttgcattttaggtcgtgttgtaatttggacatctggattctggagcatgtgttgactcttctttgtgataaaaaaaaaaaaaaaaaagcggcc

SEQ ID NO: 2915 - DNA, 1076 bp, Zea mays
  Clone ID: PAT_MRT4577_91892C.1
ccccgcgtccgcccacgcgtccgcccacgcgtccgcccacgcgtccggccttcccctccctacaagccaaacgcgaataccacccccgtgacttcccgatctccggcgatggccgcgcggcgcctcggatcccccgcatctaggtggctgcgcccgtccgcgctgctcctcctggtcgcctctgctctcctctcggccccgtcgccggcccgggccctccggttcgacctcgagtccggccacaccaagtgcgtctccgacgagatcaaggtcaacgccatggccgtcggaaagtaccacatcgtcgggcccgaccccaactcacccgacgcccagctccccgagtcgcaccgcatctccctcagggtgacgtcgccgtacgggaacagcatgcactacgcggagaacgtgcagtcgggccacttcgccttcacggcggcggaggccggcgactacctggcctgcttctgggctcccgaccacaagccgccggtcaccatcgggttcgagttcgactggaggagcggcgtctccgccaaggactatcccagcgtcgccaagaagggcaaggtcgatatgatggaattggagctgaagaagctagaggaaactataaaaaatatacatgaagagatgctttatctgcgtgaaagggaagaggaaatgcaggacgtgaacaggcgaacgaactcaaggatggcttggctagggttcctctcccttggcgtctgcttatcagtggcaggtttgcagctgtggcacctgaagaccttctttgaaaggaagaagttgttgtagactgtagttggcccatggttcacggtagacctcagcgcaggtgtaacctatttttgggtgaactgccgatctgttacggagcttgaaatcccatgtaacaaacggtatgtcgtacttgagaaaatatgctttagcctgtccagttgaaattctaagaaacttgaaatagatactaaattgtcttccattcaatagttcgtgttgcaatttggacttctgcagcaccgtgttgactcttcttcacgtgatggttgtgaatatggagcgcctttttttct

SEQ ID NO: 2916 - DNA, 619 bp, Zea mays
  Clone ID: PAT_MRT4577_91971C.1
cccacgcgtccgcggacgcgtgggatctgcagagagcacaatggtagcttataaggcagcccaggatattgcattggctgaactggcacctactcatcccataaggcttggacttgcacttaacttctcggtgttctattatgagattctgaactctccggacaaagcttgcaaccttgcaaagcaggcatttgatgaggctatttctgagttggacacgcttggtgaggaatcatacaaagatagcaccttgattatgcagctcctaagggacaacttgaccctctggacctctgacatcacggaggagggcattgaggagggcaaagaagcctcgaagggtgatgctgagtagcctggtaaaccttgatggatggttcggcatgtttttctagcccatcttgttggacgccctgtgctgatagaaggtgtttgctgctccatgcattccaagattctgtcttctcgttccctccctgctgtagctggtggtagtagtcaaattagccccattgctttagttggctctgggtccatttggactgatgtattgttactgctgttgaagtcattcgttctcgttttgttcttgcagtagattgctgttgggttgtgcttt

SEQ ID NO: 2917 - DNA, 292 bp, Zea mays
  Clone ID: PAT_MRT4577_92095C.1
gggggggaaagcaagttattggtgaacgacaaataacttgggcaaatcgtttacaactgataatcagataagcagagtgaacaagccaaaactgtatctggcaacgcacataggcttaccccagccgactaccccatttttcttaagcaaaagcgaacgggtgcttccctccccctgagcttaagggataaccataaggaaacctggtacgcgactgggtatatgataatgcatatgcatgcaaaagataactgacaggccagtgttgcgaactttatagcacacaacgggc

SEQ ID NO: 2918 - DNA, 404 bp, Zea mays
  Clone ID: PAT_MRT4577_9211C.1
aaaacaaccaattcgcccccgggacacttttttgaactaggcccgccgttaacgtttaagcccccaaacggggggaaaacaaggggacagacggggggacagttaaccacacatagaaatcacttaatttccgccatttttcgcccataaggggtttggaccgggctccccttgggggccgggggaataatggggcgtttttttgtacttgtaccaactggggatgaccaggtaggcaaggaagttgggggggctgaccactgggagcagccaaaaaaagtagtcgggggggccggggttggggttttccgggatccacccgatgcggccgtgcctgggggggatgggggggaccatggtcaccaggaccgtgctggggtagttgccgagcgcgacggggggga

SEQ ID NO: 2919 - DNA, 2232 bp, Zea mays
  Clone ID: PAT_MRT4577_92205C.1
caacagagaagagcggacgccaccggacgccaccgccgccaatcaatagattaggcgcggataatggtgctggccggaccgcgacgggcggaggagggcgccgcggcccccgcccgccgccgctgacagagtatacctgcttaaccagccgtctgcaggcacggcgcacgcgcggtggtacctcgcgaggggctcgggttgactgggcgctactcgtggccgcggggatggaggaggaggcgtctgcagatccaccgaccgcttcgtcctgcaccggcgtctctggttccggccgctgctgaatccgacgcttcggttcgcgtccccagtccccttggcggaggcgtggatcgtgtgtttggggggtttgggtatggtgggcggcggtgagggggatcgcgtgggcggcggcgtaggggttgggggaggccagcagttcgtggaccgcagcaaggtgaggattcttctctgcgacggcgacgccagcagctcccgggaggtgctgcggctcctctgcaactgctcgtaccatgtaacttgcgccaagtctccgcggcaggtgatcaatattctcaactacgagggcggcgagatcgacatcatcctggctgaggttgatctgccggtctccaagtgcttcaagatgctcaagtacattgccaggaacaaggacctgcgccacatccccatcatcagtaggcagccttcctattctgagccttgtgcggttgtgcctattactgtgatgtgctttctgtgaccgtcctccctgtcttatggaactgtgcagtgatgtccaacagagacgaggtgtctgttgttgtcaagtgcttgaggcttggtgcggccgagtacctggtgaagccgctgcgcacgaatgagctgctgaacctttggacccatgtgtggcggcggagacggatgcttggtttgcccgagaaaaacttcttcaatgacaacttcgagttggtgctctcagaacctagtgatgcaaataccaatagcgccaccctcctctcagatgagacagacgacaggcctaaagaaaacacaaatcaagaaacgggcacctcaaatcagcttgaatacgagtctaatccttccgttgctgagcgcgaccagagagacaagatcggtgctccaggctctgccctagatgccagtcaatcatcgactccgggaagaatgttttcacgtcctataaaaactaacctgaaggttgctgagtcgtctgcatttctagcatatgttaagtcaagcaccccagccaccagttcatttgatagcggactacaaagaggtgacagccggttagattctttggataaccatggtaattgctctagtgcaacagatagaagtgacaccggtactgatgtaaatattcggaataaagaagcttttgagatgcctgtgcagtatcctatggtatgcttttcttcctctagcatgcatatggagcgaagcaatgaaggccataatgacacttcaggaactccacctgcataccatttcccattttattatccagggatggtagaacacaacatggcactttcatcagtgcaaaattttcaagcaaacataaacagtgctcaagcacatacaccaccagcgatgcttcatcagtacaatgttttctcccaatgccatagtttacccatgatatcatcatttcagtttaatacttctggcatgagtatgcactcaagtcatttaccgacgcaaaatgtgtggtcatcggcatcgagcacaccaacgcctgacgaaacatgcaatcgctccgagagaagggctgcagcacttgctaaattcaggcagaaaaggaaagagcgctgttttgacaagaaggtgaggtatgtgaacaggaagaaacttgctgagacgaggccaagggtgcgaggtcaatttgttaggcatgcaagcaatatggatatcataagcactggagatgatatatctgaagacgaagatgacgatccaacctccagggaggtagatatgatttcttctccagagtagtggagaggtcctcttgtgtgaaaaattagagtgcagatggttactgctcactttgttacaactcagtaggactagacaatacattcttctactggcaacaaggcaatacaccctttttgctcacacacagtataaacttttgtccccaaatatctggctgttactccggttgctttaatcgagaaatcatctttttgataaaaaaaacgc

SEQ ID NO: 2920 - DNA, 1676 bp, Zea mays
  Clone ID: PAT_MRT4577_92370C.1
gccggcctcgaggccggccggcgtcatctcattttccttttcacgcccactcactcacccgccgccgccatcccctccttgccgtctccgggcacggcctcgtcgaatcctttgctcctcctccgccgcagccgctgccatggactccacgccggcgcacgaggcggctcccggagcctcctcttccgccaccgccgccgccgaggatctggcgggtggcgtggcggcgatgaccctggatgagcggttcgctctgctgcgggggatcggggaggagtgcatccaggaggacgagctcaggcgcctgctcgagaacaagcccgtccccatctgctacgacggcttcgagccctccggacgcatgcacatcgcccagggcattgtgaagaccatcaacgtcaacaagatggtcagagccgggtgcaaggtgaaaatctggattgccgactggttcgcgcagctcaacaacaagatgggaggcgacctcaagaaaatccagacagtcgggcgctacatgatcgagatttggaaggcggccgggatgaacctcgacggggtggagttcctgtggtcctccgaggagatcaaccggcgcgcccacgagtactggccaatcgtgatggacattgcccggaaaaacaacgtcaaacggataatgagatgctgccaaattatgggcagaagtgaccaggacgacttgactgctgctcagattttctacccttgcatgcaatgtgctgatatatttttcttgaaggctgacatatgccagttggggatggaccaaaggaaggtcaatgtgctagctagggagtactgtgatgacatcaaaagaaagaacaaaccaattattctttcacatcatatgctccctggttttaaagaaggccaggagaaaatgtcaaagagtgacccatcctcggctatctttatggaagatgacgaagcccaagttaacgtgaagataaagcaagcattttgccctcccaaaattgttgaggggaatccttgtttggagtacattaaatacatcgttttcccttggtttggaaggtttgaggtggcccggaaggaaagcaatggcggtaacaagacatttacaagcatggatgaactaatttctgattatgagactggtgctttgcatcctgctgatgtcaaacctgcactggcaaaagcaataaatgaaattttgcagcctgttcgtgatcacttcaacaacaacaacgaagccaaagttctactaaacactgtcaagaagtacagagtaaccagttgaggagcggaaggtgttcatctttagggtgaatgtcgctgattgaaattcttatatgcttattctgttactaatgccaccactcattttagatcaagcattgagccattggttatcagtgtataatctctatgaaggcattttggtggcagtggccttgtctgtcattggctacaacgttctagataaaaaaacatttaaattttgtggaagttgaattatcttctcatgtgtgtatgactgaatgtgagactggttgaaagtgcaagcgacaaggcatatatggccgagaagtttaaaagaaaaaatacaaaaaaaaaaaaaaacaaacacactctacctacacacaaacaacaaaaaataaaaaaaaaaacccctaaaaaaataaaaataaggggcc

SEQ ID NO: 2921 - DNA, 219 bp, Zea mays
  Clone ID: PAT_MRT4577_92522C.1
gtctttatgaggaatcccatatacgaaatggaggttctgttgatcaacaaggtattcgatgttttccagctactgatcaacctgcggctgcggctcaagctgcaagtgcggcaagaagtaccctgacctggtggagacgagcaccgccgcgcagcccaccagctttctcggggtggtcccggtgaacaacgccgatcccttattactatgattcctcta

SEQ ID NO: 2922 - DNA, 1095 bp, Zea mays
  Clone ID: PAT_MRT4577_9275C.1
ccccgcgtccgcacggatcgtcttcccagcttcccatcggccgtccgtgccactatcgatcgggccgtccatcgcgtttgcacacggatcgacggggccaccaccccacccttttcgcggggttttaaaagcacccaacctcgcatcccctctggcatcacacactcgactctcctctctcgcatccgcagcctctcgagctctactccatcccctcgatctcgaagcgcagcagcagcagtcaggcggccatggacgccagcgcagcaggagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctcctggccatccgcaacgacgaggagctcggcaagctgctgtccggcgtcaccatcgcccacggcggcgtcctccccaacatcaacccggtgctcctgcccaagaagaccgctgagaaggcggcggccaaggaggccaagtcgcccaagaaggccgctaagtcccccaagaaggcatagaggggcgcctttaccgctgtgatgttgaatgctcgtgttcagtagatctttacttctgtagtgtcgtcgttgttattggaactggttagtagatctgtgcattgtggttgaaacgtgattccctgatttcagaaatctaatttgcaatttgggtgcacaaaaaaaaaaaaaaaaaagcagacagtactaaaaaaaaaaaaaaaaaaaaggttttgcgggcccctttccccctgtgatgttgaatgctcgtgttcagtagatcctttacgtctgaagggtcgtcgttgttattggaactggttagtagatctgtgcattgtggttgaaacgtgattcccctttttccagaaatctaatttgcaatttgggggcc

SEQ ID NO: 2923 - DNA, 1082 bp, Zea mays
  Clone ID: PAT_MRT4577_92814C.1
aattcggcacgaggaacgagttaacgaaagccttttatccaagctcagggaagggaagctcacagtttcgttggatccaatcttttatccaagctcagcgatggcttctcgtcagcagcatcctactagctaccacgccggcgagaccaaggcccgtgccgaggagaagacgggtcaagtgatgggggcgacgcaggagaaagggagggaggccaagcacaaggcgtccgacgcctccgaccgcgccatgggaatgggccacgacgccatggaggcgaccagggagaaggcgcgcgccgccgcggaccgaaccatggggatgggccacgacgccggggaggcggccaaggacagggcgtaccgggccaaggacgcggcctccggtgccgctggccgcgccagggacactgcgtccgacgcggccggcgctgccggggaccgcgcccgcgacggcgcgcagcagaccgggagctacgtcgcgcagacggccgaggccgccaggcagaaggcggccggcgccgcgctgtacgccaaggacaccgtggtggccggcaaggacaagaccggcgccctcctgcagcaggcaggggagaaggtgatgagcacggccgtgggggccaaggacacggttgtcagcacggccgtgggggccaaggacacggttgtcagcaccgccgtgggagccaaggacgcgatgatgaactcgctcggcatggccggcgaggacaaggacggcaccaccaccaccgacgccggcaaggacaccagcacccgcaagcctggcagggactattagaggacacggcagccaaacttctcagtgtttctgttccagaagtttctgatcccatcatttaggttcaaaagtttctcatttcatttcaaactttcagtgtttggtgcatgctgtaaactctcttcaggacgggtcgtttgacatttgtgtcgactgaagcctccgcgctttcgactcaacgatgtatatgtaataataaagtcgcaaagctgttgttttattttcatctaaaaaaaaaaaaaaaaaaaaaaaaaaaaaaaaaaaaaaaaaaaaactcgaggagggg

SEQ ID NO: 2924 - DNA, 3405 bp, Zea mays
  Clone ID: PAT_MRT4577_92835C.1
cacagagtcacagacagaccagcgctctgcatggccatcattctggtgaccacgcaaaaaggaccagccattcccgggcaaagatggtttcagaagccagcgagcttggcattggcacacactatacacactggtcgctgatattttgattccccacgtgcgacacggcatctacccgtcgaggaactccacatctatctctccatgaagctcgctatatatgcatgtgagcttggcattggcacaccacagagcagccacttggatccggtgctcagcggaacagctagctatagcctgtagctagcagctagcttcagtcacaggccggacggtcggctcacacacagctagccgccgccgctgctagcttagccaccagtagtccgatctgatctacaggcagggggccagcaggggcagctagctagctagccgcgcgccggcgccatgatgaacctgaacctgaagcagccgctcgtgctgcccgcgcaccacagcaatgtcgtcggctcgcgcctgtcgtcgtcgtcgccctcggcagccgccgccagcaggaggaccggcggcggcgtgtcctcccggtccggctcccggcggcacgtgcggctgccgaggatcagctgcagcgccaccgaggaggtcagcggcgccgtgtcgtccgtcaccgtggagaggatgctcacggtgacggcgtcggtggaggcgtcgccggccatcgggcagatgtacttccagcgcgccgtcgacgacatcggcgacctcctcggcaagacgctgctgctcgagctcgtcagctccgagctcgacgcaaagtcgggcgtggagaagacgcgggtgacggcgtacgcgcacaagacgctgcgggagggccactacgaggcggagttcaaggtgccggcgtcgttcgggccggtgggcgcggtgctggtggagaacgagcaccacaaggaggtcttcatcaaggagatcaagctcgtcaccggcggcgacagcagcaccgccgtcaccttcgactgcaactcctgggtgcactccaagttcgacaacccggagaagcgcatcttcttcaccctcaagtcatacctgccgtccgacacgcccaaggggctggaggacctgaggaagaaggacctgcaggcgctgcgcggcgacgggcacggcgagcgcaaggtgttcgagcgcgtctacgactacgacgtgtacaacgacctgggcgacccggacaagaacccggcccaccagcggcccgtgctgggcggcaacaagcagtacccatacccgcgccgctgccgcaccggccgccccaggaccaagaaggaccccgagacggagatgcgcgagggccacaactacgtgccccgcgacgagcagttctcggaggtgaagcagctcacgttcggggccaccacgctgcgctccggcctgcacgcgctgctgccggcgctccgcccgctgctcatcaacaagaaggatctgcgcttcccgcacttccccgccatcgacgaactctacagcgacggcatcccgctgccgccgcagaccgggttcgacgccatccgcaccgtcgtcccgcgcatggtcaagctggtggaggacaccaccgaccacgtcctccgcttcgaggtgccggagatgatagagagggaccggttctcgtggttcaaggacgaggagttcgcgaggcagacgatcgcggggctcaacccgctgtgcatccagctgctgaccgagttccccatcaagagcaagctggacccggaggtgtacgggccagcggagtccgccatcaccaaggagatcctggagaagcagatgaacggcgcgctgaccgtggagcaggcgctggcggcgaagcggctgttcatcctggactaccacgacgtgttcctgccctacgtgcacaaggtgcgggagctgcaggacgcgacgctctacgcctcgcgcaccatcttcttcctgacggacctgggcacgctgatgccgctggccatcgagctgacgcggcccaagtcgccgacgcggccgcagtggaagcgggcgttcacgcacgggcccgacgccaccgacgcctggctgtggaagctggccaaggcgcacgtgctgacccacgacacggggtaccaccagctggtgagccactggctgcgcacgcactgctgcgtggagccctacatcatcgccgccaaccggcagctgagccggctgcacccggtgtaccgcctgctgcacccgcacttccgctacaccatggagatcaacgcgctggccagggaggcgctcatcaacgccgacggcatcatcgaggagtccttctggccgggcaagtacgccgtcgagctcagctccgtggcgtacggcgcgacgtggcagttcgacacggaggcgctgcccaacgacctcatcaagcgcgggctggccgtgcgcggggaggacggggagctggagctcaccatcaaggactacccctacgcccacgacgggctcctggtctgggactccatcaagcagtgggcgtccgagtacgtcaacgtctactacaagtccgacgaggccgtggccgccgaccccgagctgagggcgttctgggacgaggtgcgcaacgtggggcacggcgacaagaaggacgagccgtggtggcccgtgctggacacccgcgacagcctggtggagacgctgaccaccatcatgtgggtcacctccggccaccactcggccgtcaacttcgggcagtaccacttcgccggctacttccccaaccggccgaccaccatccggaagaacatgccggtggaggagggcgggccgggcgaggagatggagaagttcctcaagcagccggagacgacgctgctggacatgctgcccacgcagatgcaggccatcaaggtcatgacgacgctggacatcctctcgtcgcactcgcccgacgaggagtacatgggggagttcgcggagccgtcgtggctggcggagcccatggtgaaggcggcgttcgagaagttcggcggcaggatgaaggagatcgaggggttcatcgacgagtgcaacaacaacctggacctcaagaaccgctgcggcgccgggatcgtgccgtacgagctgctcaagcccttctccaagccgggagtcaccgggaggggcatccccagcagcatctccatctgatccatcctcagcatgcattagtccaattaattaaatcgggggttgtactattattgcatgcagaggctgcttgtcgaataaaacgtactatatgtacgattgtattgtacatgtgtgtcaatgcaacaagaggcacgtttgagactttgagttaataccaattaaaaaaaaaaaaaaaaaaaaaaaaaaaaaaaaaaaaaaaaaaaaaaaaaaaactcgaggggggaccccgggtac

SEQ ID NO: 2925 - DNA, 1591 bp, Zea mays
  Clone ID: PAT_MRT4577_92931C.1
gccgttgaagccaaaatttattgcgataaaattttgatccatacatttgtaggacattggatcaactgcttctgttatacatagaaaggagttcatagagattgagcacctatatcaagtggtggcttcaggatggaaggagtcatattctggaggaaatcggtcgacagggatagtagctgtgaatagtgagacgttagtgttaagcatgtgggatcagaaggtagaggcatacattattcatgtacaggtggaggttgcaatgttctgccccatgatatgtcaggaaattgtgaaaaatggcacagggtcgtccaaaaatcatgctattgcgctcccggaaagagttaatccagccagtttgagtttgattcttgactactgccggtttcatcaggttactgggcgctcaaacaaggagcggaagtcctttgatgaaaaatttgttaggatagaaacagaaagactctgcgaattgacttctgcagctgacagtctacagctaaagccacttgttgatcttactagtcgagctcttgctcgaatcattgaaggaaagacacctgaggaaattcgtgacattttccacttaccagatgacttaacagaggaagagaagttggagcccctaaaaaatgtaaatgatgatcctaggattcgcctattgaaccggttgtacgcgaagaagcggaaagagctccaggagcgccagaagctgaaggatgtacaagtacaaaaggaggaaaaagatgagagatctttggatgagttactttgttttattaatggggatggaggttcaggaggtggggaaagtagtaccaagagtaagaaaaagaataaaagaaggaaggatcatgctaagaaccccgcaaaagctgactctgagtctgtaaatgtggagggagctgcttgtgtggttccgtgcaaagtggatagcagtaatgtttctagacttccatgccaaagtcggcacgatgcaagatgatgccgagtacccctttgaagatgctgacctcgatgatggacttgatcctgcaatgaaagaagagcttgatagagaagttgaggactttgcaaggaggttgaattcagtttggagcgagtcacatattggtggtaatggttctgtgcagagatttcctgggtttaatcacaggtgagtgttaagctggcaagatctgaaggcagaagcagaggagatttgtgggcatacagcttggaagggattaaaggccaaacaggccaccttggctcctgtgtgttgtaaaaccttgataactcaggaaccaagcatgcagaaatgcgcaagttcccttggccattttcctgggaaggaggccacctagttgggatgacccttttttttttctttgggaagggagggttagaggtctgtcttgactcaattttttgttccttaactgctgtgttgccagttttcctgaataggggaagagaggagtgttgcctgttagctctgttacagatgtccatggaattctgttgtaacactgtattgtggtgcacatagaaatgtgattccctgtattgtggtgcgcataaaaacatgccgatgtttggctggttt

SEQ ID NO: 2926 - DNA, 542 bp, Zea mays
  Clone ID: PAT_MRT4577_93131C.1
aaaagaggagagaagacccaagcccaagtcagttctaagccttgtagctgctcgacctagagaggagagaggaagtcaggtaggaggctctgctgcgaagggagatggccgggaagggaggcaaggggctgcttgcggcgaagacgacggcggccaagggcgccgccgacaaggacaaggacaagaagaaggcgcctgtgtcccgctcctcccgcgccgggattcagttcccggtgggccgtatacacaggcagctcaagcagagggtctcggctaatggccgtgtgggtgccactgccgctgtgtactctgcagcaatccttgagtaccttactgctgaggtccttgagctggccggcaacgccagcaaggatctcaaggtgaagcgtatcacccctcgccacctgcagcttgcgatccgtggagatgaggagctggacaccctcatcaagggcaccatcgctggtggtggtgtcatccctcacatccacaagtccctcatcaacaagacctccaaggagtgaatgaaatgcaataacggg

SEQ ID NO: 2927 - DNA, 1297 bp, Zea mays
  UNSURE (1)..(1297): unsure at all n locations
  Clone ID: PAT_MRT4577_93177C.1
  unsure (1)..(1297): unsure at all n locations
ggtaccctncgagggacacgcgtcatatcttcctccctcgcctattccccttccccgcgtgccgcgtcaaacaaatctaggcttccaagcgagcgaaagccttcctccgccagccgatctaccaacatcctctccgccgattggaggcacctgcgaagatgccgcagcggcactcaaagaacaacaacgacctcgccttcttcacgtacgaggagaagcggaagctcgggtacggcacgcagcgggagcgcctggggaaggactccatcaagcccttcgacgcctgctgcctctgcctcaagccgctcatcgacccgctctgctgccccaagggccataccttctgcaaggagtgcatccttgagtgcctcctcgcccagaagaaggacatcaagcgtaagctagcagctcacgaggcccagaagaagcaagagaaggaagaggaggaggaaaagctaattctgcagaaggctaaggagttggatgcctttgatcagcagaatcatggggctgttccccagtaccatgatcgcagtggttcccaaggcaagaatgggtttcatggagcgaacagtgtgaaggtcacttcttttgaagaggaagccctccgtaacatgaaggcattctggcttccttcagctactcctgaagctacggtcaaggtagatgcaccctccgccgacactgtctgccctgaggggcaggagaagctcaagttgaaatcgctcttccctatctcatttatggaggaaactgctgatccgaagaggaagaaggcaatggaaaagagctatatgtgccctagttgcaaatccactctcacaaatacaatgtccctcgtggcggtcagcgcctgtggccacgtcttctgcaagaagtgctctgacaagtttctagtaaaggataaagtttgcttagagtgcagcaaatcattcaaggagaggaatctggttccattagagaaaggaggaactgggtttgcggcacatgatgaacgcttggaggcaagggatttcaagcatttgggcagcggttctgggttaggactagtgaagcctgcaccaaaagcttactagccttgaatacttgtagccgcttttatatatcgtttatcatggtgtcatgaaattatgtataacctggaaattttgttttgtggcatcaaaatcgctctattcaggacagttctccagtctttaacgatttatctgatatgcatgtttcttttcatctcgtgcatttgttaagctggagctgttgtactatgaccgcttgctcttggtgttggcataatctt

SEQ ID NO: 2928 - DNA, 534 bp, Zea mays
  Clone ID: PAT_MRT4577_93262C.1
ggcattcaacagcaatgccggctggcatgttacctttatgacccttggtcctccaacaatcatcaggcctattcaacagttacctttggtgcatttattggcacaaaacatgagggcacaacaactgcagcaacttgtgctagcaaaccttgctgcctactctgaccatcagcagtggcttccattcaacccactaagtgcattgaactctggttggtattggcaacagcagcaactgccattcacccagctacctgctgcctacccacagcaatttcttccattcaaccaacttgcagcattgaactcatgtgcttatttacagtagcgccatctactaccattcatccagttggctggtgtgagccctgctaccttcgtgtacgcaaccacagttgttaccgtgctaccagcacgttgcgcctaacgctggcaccctcttacaactgtcacaattgctgccattcaaccaacttgctttgtcaaacccagtatcgttctaccaacaaccgatcattggtggtgccctctttt

SEQ ID NO: 2929 - DNA, 299 bp, Zea mays
  Clone ID: PAT_MRT4577_93337C.1
atctcgcccacacgaactcgagaccttgcccgcccaaatacgaacgcctcagatctcagtgaccatcgccgctgcttccttcgcgtccaggcgagatcaggaaatggcggctagcgagggcgcgctcctggggatgggcacccccctcctcgacattttcgccgttgatgatgacgccttcctaggagagcgggacatccagctgagcagtgcccttcttgctgaggacaatcacttgcctatgtatgatgagctggctagcatctgtcctgttgacatatattggtcgaggagccacc

SEQ ID NO: 2930 - DNA, 258 bp, Zea mays
  Clone ID: PAT_MRT4577_93415C.1
attgagaccaactagcaacatagaaagcacattagtttaccaacaatggcagccaaaatattgtgctgccttatgctccttggtctttctgcaagtgttgctaccgaaaccattttcccacaatcctaacaacctcctataccttcctttcttcccccatacctttaaccaccggtgtcttcaatgcttgaaaccccatttgttcaaccttacaggatccaacagccattcgcaccaggcatctaaccataataaccc

SEQ ID NO: 2931 - DNA, 644 bp, Zea mays
  Clone ID: PAT_MRT4577_93511C.1
cttcttatttctgggaagccacaaacatcagacacaaaactttattattgaactataactcatatgaaatctaaaacagggcaccaccaaagatggctcgatggtagaatgctgaacatgattgccaaagcaagttgattgaatggcaacaattgaatgcagatgaaagagggtgccagcgataagcgcagcgtgctggtagaacggcaacaattgtggttgtgtcaagaaggtagcacgtctcacaccagctagctgactgaaaggtagtagttgatgctgctgaatataagcaggagagatcaaagctgtcaaggtggcctgaatggaagaaattgctgggggtaggcagcaaatagctggctgaatggtagttgttgttgttgcaaataagaagcagagctcaatgcaactagctggttgaatggaagaaactgttgatgctgagagtaagcagaaaggtttgctagcacaagttgttgtcaacagttgtgccctgatgttgtgtgccaataaatgcaccaaaggtaactgctagaataggctgatgattgttggaggaacaagggtgataatagtaagatgccagctgtaattgcctgttcggatcctatagggccgaagaattgggttatcacataccg

SEQ ID NO: 2932 - DNA, 463 bp, Zea mays
  Clone ID: PAT_MRT4577_93522C.1
gggagccccaaaaagccccattttttccttaaaattaacttaaaaaaaagcccggcgggggtaacagcatccattgatccccaatccatgctgtttgatgcatgggtctgctggggcccgggattaacacagcactaacaactggcccagagggaccttgcaatcaaaaacacagatgggcaacaaccaacccgagacgaacgaagataaaccctttggactagggtaaacatcacgggagcgaacaggataacttggccgggcgggccccaccgttcaattcctccagttcccgtgggagttgccgtaacccccgccacggttgccaccgccgtagccgccgccaccaccaccgtattcgtcgccgccaccgtatccgccgccaccgccgtaaccgccgccgtcattacggggcccgccaccgccgtagccgccgtcttcacgggcaccaacgtacccaccg

SEQ ID NO: 2933 - DNA, 643 bp, Zea mays
  Clone ID: PAT_MRT4577_93624C.1
gcggccggcccgacgggctcgcttatcacagattattgacacccactagacacataacttgctcattgaagtaccaccaatggcagatataatatagggcctcctctatgctgcttgtgctttctgaaagcgctggtactgggaccattttgccacaatgctgacgagctccgatagctttccttcatgccgccaacctctcacccacggtgctttcggaatgggaacacccgagtcttcgaccctacaggatccaacaggccactcgatatgtgattgtacctttatcacccttgctgctgcaacaatcctcagccgtattacggcagctacctttggagcgtatattgtcgcagaacatcagggcacaacagctgcatcaacgtgagctagcgaaccttgctgcctactctcagcatcaggagtttcttccattcaaccaactagctggatggaactctgcttcttatttgcggcaacatcaactaccatgcagccagctatctgctgtctacccccagcaatttcttgcattcaaccaactgacagcattgaactctcctgcttatttacagcagcggcaactactaccattcagccagctagctagtgtgagccctgctaccttcttgacacaccacag

SEQ ID NO: 2934 - DNA, 249 bp, Zea mays
  Clone ID: PAT_MRT4577_9367C.1
ccgacggcatccgtcagatcgtctccgtgtacggcgacaagaccataaagctatggaacactctctgcgagtgcaagtacaccatcggctgcgacctcagcggacgggagggccacaacgggtgggtcttctgagctaggttctccccaaacaccttacagaccaccattgcctgcggatgctgagaccgcaccgtcaaggtgtggtaccttaccaactgcaagctgagctgcactctggatgggcaca

SEQ ID NO: 2935 - DNA, 313 bp, Zea mays
  Clone ID: PAT_MRT4577_93858C.1
ccgtttcttgatgtttctccggggctcggattcgacgggtgagcggatcgagatggcggcgtcagacgttgactaccgttgcttcgacggcggcctcacctgggccacagacgaccactccctgcacaacgccttcagcacctacggagaggtcctcgagtgcaggatcatactctatcgggagacgcataggcaccgcggcataggctacgccaccttctccacggaggaagcgatgcgaaacgccatcgatggcatgaacggcacggagctggacggacgtaacatcaccgtcaacgaggcccaatccctc

SEQ ID NO: 2936 - DNA, 1171 bp, Zea mays
  Clone ID: PAT_MRT4577_9400C.1
acgtgaacgccgcagcagctacctcgcctctgacgggcagggcccaccagaagtgggggagggagaggaagatatcccgtgccctcgccgccggcccgccaccacacccgtttccgggaggagagagagggcgggggcgaaggggatggcaaagcgccggcgccacgagttggcgccggtcgtggaggagctgatttcgccgatgaacagcctggacgacggctgcctcatgcacatcttcagcttcctgagcccaatcccagataggtataacaccgccctcgtttgccacagatggcgcttccttgcatgccaccctcggctatggctgcgtgttgagaggccaatcagagatgcgatggagcctggagtttatcctgatctcgaggctgctgtttctgctgctaggccgggtgacaccattcttattgcggctggtggttcccatgttgcatgtaacatccaaataaagaagcctatttgcataattggcgggggcgatcttcctgatgacactgtattgacctgctcacgtggcttcgacaacgcactggagtttctatcaacatgcaagattgcaaatctgactattagagcagaactcggatgctgcttgctgcatcgaggcggtagattgaccatccaggagtgtctgctgcagtgcgagcaaaaccctttggaccacctgtccttcccaataatcagcacagcgatagagtacgatccattctcatccctcaaggagcaagggcacggagtaacggtcgtccgcaccaggatcgaaggaggcgcgagggccgtcaggacgaacggcacactcgcgctgcgccatgtgcgggccatctattcccgcagctctgttttcttctggttcgaagtaggagagaaagtagaagcgcctgtacactagcaaaaaaacccgtgttcgttcttgtatgtcagtgttggtatcaccctagcgtgcgtttggtgaactcggacggctgcctcgtgtctgttgtgatctctttataattataataccccactgatgtttgaaccaaccaacatttattccgttcttgcctcctctgaatgcagctaatctaaaagtctactatgccacatgtttcaggggcgtaccttttataatatccaattttacgtacccttgcatccaaacctataactt

SEQ ID NO: 2937 - DNA, 1322 bp, Zea mays
  Clone ID: PAT_MRT4577_94022C.1
cccgtcactatatgaatccctcgatcgcggccgggccggggctttgccttccccgcgtcaaacaaatctagggttccaagcgagcgaataccttcctccgcctgccgatctccccgcatctctcgggctaagacgattcgaggcacgagcgaagatgccgcagcggcattcgaaaaacaacaacgacctcgccttcttcacgtacgaggagaagcggaagctcgggtacggcacgcagcgggagcgcctgggaaaggactccatcaagcccttcgacgcctgctgcctctgcctcaagccgctcatcggcccgctctgctgccccaagggccacacattctgtaaggagtgcatcctcgagtgcctcctctcccagaagaaggacatcaagcgcaagctagcagcacatgaggcccagaaaaagcaggagaaagaagaggaggaagagaagctaattctgcagaaggctaaggagttggatgcctttgatcagcagaatcatggagctgttccccagtaccatgatcgcagtggttcccaatacaagaatgggtttcatggagcaaatagtgtgaaggtcacttcttttgaagaggaagcccttcgcaatatgaaggcattctggctcccttcagctactcctgaagctacggtcaaggtagacttgccctccaccgacactgtttgcccggaggggcaggagaagcttaagttgaaatcgctcttccctatctcgttcacagaggaaactgctgatcagaagagcagcaaggcaggaaactcctgtagctacatgtgccctagttgcaagtccactctcacaaataccatgtcccttgtggcggtgagcacctgtggccatgtcttctgcaagaaatgttccgacaagtttctagtgaaggataaagcttgcttggagtgcagcaaaccattcagggagaggaatctggttccattggagaaaggaggaactgggtttgctgcacatgatgaacgcctggaggcaagagatttcaagtatttgggtagtggctctgggttagggctagtgaagcctgcaccaaaaacttactaaccttgaataattatagctgatgttgtgtattgtttaccatggtgtcatgaaattatgtaacctggagaattttgttttatggcatcaaaatcgttgtattcagaacaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaaaaaaaaaaagggcctttgggttgttaccactgtttaagggga

SEQ ID NO: 2938 - DNA, 2584 bp, Zea mays
  UNSURE (1)..(2584): unsure at all n locations
  Clone ID: PAT_MRT4577_94028C.1
  unsure (1)..(2584): unsure at all n locations
ctcgaggccggccgggactctcgtctccctcctccccgttccttattcgccagaccggagggaggggtacgagcttcaccgctttcatcccgcccgcgctcctccccagatctcgtctccattaaagccgaccttgcccagattcgcgccctcctcgctcatatctgaaagcggctctgattttccaagccgaccgcaggagcggtgcaccgggccgcgtgattccggcggcttgatttggaatttgtgatctttcggggcattcgtcggtttgtctgtcggtgacggtggtgctgcgcttcgagggcagcgaagatgggtgtcggcggagagaagttccagctggggacggtgggggcgctgagcctatccgtggtctcctccgtctccattgtcatctgcaacaaggccctcatgagctccctcggctttaacttcggtgtgagatctgactgtttcctgcctcagtttcttgatttgttatgtgtatgctcgtgctggatgttcggtgattcgcgtagatttgcgtgctccattcgggttgtagttctggtgcatgagatgtgtacgcaagactcagcacttcagacggtgtttgcagggctttagcttcagtgataactaggagtgccaaatggtatctgtccaaacttcaacggtcgttgattggtgccagtttgattgtgaatggtgaaacatgtgtgaccctggatctaacctgatttcggtgaaagcttcagaaaagctaaaaaaagcttggttatttctctagccctcagcactcgagtttgacaccatccgacccacacgccggcagctctgtcccatccgataatgtgtcccgctccnnnnnnnnnnnnnnnnnnnnnnnnnnnnnnnntagctgttaatgtgggactgcttttacctgctgggtctctcgaagcgtctccactgtccggccattttatattctgcgtcgttgccgatgctaccgagccactaccttgacaagctggcatctgctggttacattctgctcccttcatgtggcattatggatgaaattctttgagcataagccttttgattcaagaactgtcatgggatttggagtacttaatggaatctccattgggctcctcaacttgagtcttggcttcaactctgttgggttttaccagatgactaagctggcgatcatcccgtgcactgtcatcttagagacacttttcttcaggaagaagttcagtcggagtatccagatgtccctttctgtgctccttcttggtgttggtgttgcaactgtcactgatctgcaactcaatgctgtgggatccatactctccttgctggcaattatcacgacttgcattgctcaaattatgacaaacactatccagaagaagttcaaggtctcatcgacccaactgctctaccagtcttgcccttatcaatcactgaccctgtttctcattggccccttccttgatggctttttgactaaccaaaacgtctttgcttttaattatacatctcaagttgtgtttttcattgtgttgtcatgcctgatatcggtctcagtgaacttcagcacttttcttgtgattggaaagacgtctcctgttacttaccaagtcctgggccatcttaaaacatgccttgttcttacctttggttatgttttgcttcatgatccatttagctggagaaacatacttgggatcctaattgcagtagttggaatggtcttatattcatacttctgcacagtggagacccagcataagaacactgaagtctccccacagcaggtgaaagaaagtgaggcagcccctttgatctcagactctttgagcaaagttgaaaatgggggcggtgttgttgatgacgagcctttgaaggtacccatgtggagctcaaagtattcgcgggagtgaaattttctaccgcttgacggtggcatcatacaggattcagtttagtaggcagatagtagggttggaagccaacccagagtgtaatgaacatttgagttacattttttggccttttttagcgtcacgatctactactggtaaaagggtctgtttcttgggaggatcttaccttcaagattgccagatatacattgaaactagacggcagatattgtatgattgtatctggacatgttccacatcgtctaactgtaacttccaactggtacatggcatgcctatatccaaagatagatttctttttttttgtatcagaaagatccggataagaagacttgtgcaagaaaaaaaacgataaataaaaaaaaaaaaaaaaaagcggccctggagtccaaatgttgagcccctcggaaatcccacaaagggactggttcccctctgacttcaccttcggtgccgccacttcagcggaccatattgtaggtgcttggaatgaagatggaaagggggaaaggaactgggatcacttctgccacaatcatccggaaaggatactggacgggagcaattccgacattggagcgaattcgcaccatatgtacaaaaccgacggcagattgctcaaggaaatgggactgcacgaatatagcggtctctatctcttg

SEQ ID NO: 2939 - DNA, 1444 bp, Zea mays
  Clone ID: PAT_MRT4577_94125C.1
tctgagtccgcacttactgccgggctgctgctgcccctctctttccccccatctgcaggctgcaggcgctgctcctttcgtcctccgctagcgagcgaatcgctggctcgaccccgcggcgggaggtatcccgccttcgatctggttcacgggccaattcgttgcttcgtggggctttggagtttcgagccaatcttgccccttaaagtgtcggtggcagcgtcttgtgatcatcatgagctttgtgttccgagggagcaggaccgacatcgaggccggtggcttcccagggttcgctcccgagcgccgcgccatgcgaattcatgcagggagcaggccggtgaatagcaattccttggcttttcttctaactgttcttgttttgttcatggtactgaactcgcaccagatctctcccaatcttttgctttggcttgtcttgggagtcttcctaatggccacgagcctcagaatgtatgccacgtgccagcagcttgctcatgctgcagctgccaacagttttctcggtcacactgagctgcgtgtgcatgtaccgccgtccattacccttgctacgagaggccggttacagagccttagacttcaactggctcttcttgatcgtgaatttgacgatttagattatgacactctgagagcattggatgctgacaatagcccacatgctccatctatgagtgaagaagaaataaattctcttcctgtcttcaaatataaagttcaggcacaacagaggcatccccctgcccgaaaaagtgatgggccatctcagctatcagtttcttcaactgggtccggcaatgaggaaaagcaggatggtttaaaagcagatggaaccagcaaaacttcagaggatgaactaacatgtagtgtatgcttagaaccactcagggtgggagatttattgagcagcctaccatactgacattagtttcacgtcagatggaacggccaaaagctacggcatcaaggtacatgtactatctgcaagcaccaagtcagcgatgggtggcagtctacaggcaaagcaggacaggatgcgtcatatatggtgagagcaaccgactacgagtcggccacagttaactaccagtaacccataactgaatcagtggagcatagttttcaaggggaagggttggactggtctagggatgcatgctaaacccttcctatcataacaaaaccgtgtgtagaaacaagtggctagtaaggttgctgttctggagatgctcatttcaatcattaactgagaggtgaggcataacaaggtcgataatctctttcaccgtcctttgttattatggtcggtttcttttcttttttcgtaccactcatgggtatttctcgcattctccgtgatgttgatgcataaaaaggttgctgataatcttcttaccaaaaaaaaaaaaaaaaaaaaaaa

SEQ ID NO: 2940 - DNA, 2058 bp, Zea mays
  Clone ID: PAT_MRT4577_94132C.1
ttggggaccctcgggcctgccggatcctgctgctgcccctctttcccccatctgcaggctgcaggcgctgctcctttcgccctccgctagcgagcgaatcgctggctcgaccccgcggcgggaggtatcccgccttcgatctggtgcgcgccctcctcgaactccccctcgccctcctcatctggcttccgcttgggtccggtcagcgccaagctgtgcgctgggcgaaacttccggaagcttcagggtttatccggcattccgcttcccgcgacggcggcgcgaccggttcactggccaattcgttgcttcgtggggctttggagtttggagccaatcttgccccttaaagtgtcggtggcagcgttttgtgatcatcatgagctttgtgttccgagggagcaggaccgacatcgaggccggtggcttcccagggttcgctcccgagcgccgcgccatgcgaattcatgcagggagcaggccggtgaatagcaattccttggcttttcttctaactgttcttgttttgttcatggtactgaactcgcaccagatctctcccaatcttctgctttggcttgtcttgggagtcttcctaatggccacgagcctcagaatgtatgccacgtgccagcagcttgctcatgctgcagctgccaacagttttctcggccacactgagctgcgtgtgcatgtaccgccgtccattacccttgctacgagaggccggttacagagccttagacttcaactggctcttcttgatcgtgaatttgacgatttagattatgacactctgagagcattggatgctgacaatagcccacatgctccatctatgagtgaagaagaaataaattctcttcctgtcttcaaatataaagttcaggcacaacagaggcatccccctgcccgaaaaagtgatgggccatctcagctatcggtttcttcaactgggtccggcaatgaggaaaagcaggatggtttaaaagcagatggaaccagcaaaccttcagaggatgaactaacatgtagtgtttgcttagagcaagtcacggtgggtgatctgttgagaagcctaccatgcttgcatcagtttcacgtaaactgcatcgacccatggctgcgccaacagggtacatgcccaatctgcaagcaccaggtgagcgatgggtggcatgctacaggcaacggtgaagaggatgcttcttacatggtgtgagtagctgactaggagtaggccatagctaactaccagtagctgctaactgaatccgtggaacatagttttcgaggtgacgggttggactgatctagggatgtgatctaatccctttctatcctaacaaaaccgcgtgtggaaacagttgtccagtacggttcttttacaggtaacgctcatttcaatcattctctgtaacggggcgtttggatcccttcattttagaggaattggaattcactcaataaagtaacttatttagtttggaatttgacattccaccactttctaaagttcagatacaaggctatctcaaattcatggggtggaggatgagaaattattttgtgcattagtagaatttgtttctactttgtaacttacatggcacacttcatctcactcctctattgtaaaaatgtagcacataaatatctcgcacgcgtgggcggacgcgtgggcggacgcgtgggcggacgcgtgggcggacgcgtgggacctcggtcgcgcagccctcacccagcatggtgctccagctccactgcgccacaccgaccatcaccatctctccgcctcccgcccgccctcgtcactacccccaccacctctacggcgccagcggagcgctcccggccccagctcgcggcctcgggcaacttccccgcctcctcctcgtcggcgtcagagacccgcgcgcggacggagcggtctgccacgtgaggaggcaggtgcggtacgacgaggaagacgaggaggaggaggacggcgaggagtggggccacaacgaggacgtcgcgaggattgaacggtacagcgaggacccccgcgaccaggcg

SEQ ID NO: 2941 - DNA, 299 bp, Zea mays
  Clone ID: PAT_MRT4577_94320C.1
aatagacacatacatcaacttattctgtgctgtctttatagagtagaaaagttagccaattagaactctcattcaaggagatactcaacaatggcaaaaaagaagcacaatgcagaccaaaagtttttttaaacatctatattggaagtacgaatcataatgagggtattaatctcacaccatgttgatatcattactttttacaatgaggtcttcgttccagcagccaaacctttgctggagccattaatatcatctgatactaggccaaaagacaagaagaatgctagtggccaagt

SEQ ID NO: 2942 - DNA, 1560 bp, Zea mays
  Clone ID: PAT_MRT4577_94673C.1
tgggtccctcgggccggccgggaaccacctttcacgtaccaccgggtttctgtccgcgccccgcccttaaaacattgtctgcctcgcggccggccgggacgagacgacaccaccacgccgggacgggaggcacaggtgcggtctgcgtcgagagttggtccactggcaggccggaatgaagaagtgcgcgtcggagctggagctggaggcgttcatccgggagagcggcgaggacgcccgcgccgccgccggaggtagcagtccggggtgcggtggatcaagcgatcccggagggagcggcgtcttctcacccggcttcggtttcgccgactcggatcttctcgcgcccgagcaggacaccatggatggaggcagttggtggtacgggaacgtccgcacgccgaacccagtcatgtcgcaggcggcgtccatatccgctagccccgggctaaccacctcagccaatcatgctcttgaaagcgagtcagactccgacagcgaatcactgtatgaggtagagggagttccatacgagcgaggtaacagatccattgagacgaagcgaataagaaggatggtgtccaatagggagtctgcgcggcggtctaggaggaggaaacaggcacagttgtctgaccttgagtcacaggttgaacgactcaaaggtgaaaacgcaacactgttccagcaactttcagatgccaaccaacagttcagtactgcagtcacagacaacagaatcctcaaatccgatgtagaagcgttaagaattaaggtaaagatggcagaggatatggtagcgagaagtgctgtatcgtgtggcctaggcgaccttggcctggcaccatacgtgaactcaaggaagatgtgccaagctttgaatgtgctcacagggttggatttactagggagtgatgcgttcaggggtccaaccgcaggtacacgagtacagaactcaccagtacagagcactgcaagcctagagagtctggataaccgaaagtccaacgaggtgaccagttgcgcggcggacatttggccttgagcttcaagccattgatctgattcaaagcttgctccaccctcaaaaaaaggaccagagtttgtcaactcaaatagctggtggcttgagcagagcttctggcacgagttctcttgaaccatatttccacataagctttataggatgcatcactcttttgatgtcacttagtttcaagtataaaatgaagctgtctttgtacaaagctgcaaatgagaagtaaatgaaacgtcctggacaaacttgtgaagtaggaatgatacataggctctatttccaggtcagatgagacagttatgtttacaacaaaaagcaatacatgttgtttagaaaccgctattaattcacaggaatgttcaatccagtacaagtcatctagtagatttgcacccctaccttctagtagattcaaccatgttttcactactacttgctgggactacaactgtacatcatgatggtaaaatgcataactagtgaggttcttaaaaaaaaaaaaaaaaaaggcccctagggcc

SEQ ID NO: 2943 - DNA, 2058 bp, Zea mays
  UNSURE (1)..(2058): unsure at all n locations
  Clone ID: PAT_MRT4577_94704C.1
  unsure (1)..(2058): unsure at all n locations
ttcactcactaacggccgtgcttgcactcgcagcgcatcacttgctactttggtagtggagagcagaaagaacagagctagattattcccaacaagctacagcaaattagttgctcttcatggccgtgtcacacaacgttgggagcaagcacggtgtcgcgccgctggaggtgtcggtggaggccgggaacggcggagccgccgagtggctggacgacgatggccggcctcgccgcacgggcacgttctggacggccagcgcgcacatcgtcaccgccgtcatcggctccggggtgctctcgctcgcctgggcgatcgcgcagctgggctgggtggccggccccgccgccatgctgctcttcgccttcgtcacctactacaccgccacgctgctcgccgagtgctaccgcacgggggacccggacacgggcaagcgcaactacacgtacatggacgccgtgcgctccaacctcggcggcgccaaggtcgccttctgcggcgccatccagtacgccaacctcgtcggcgtcgccatcggctacaccatcgcctcctccatcagcatgcaggccgtcagcagggccgggtgcttccacaagcgtgggcacgccgtcccctgcaagagctccagcaacccctacatgatcctcttcggcgccgtccagatcctcttctcccagataccggacttcgaccagatttggtggctctccatcgtcgccgcagtcatgtccttcacctactccgccatcggcttgtccctcggcatcgcacagactgttgcaaacggtgggttcaagggaagcctcaccggcatcagcatcggcgccgacgtcacctccacgcagaaagtgtggcacagcctgcaggccttcggcgacatcgcgttcgcctactccttctccaacatcctcatcgagatccaagacacgatcaaggcgccgccgccgtcggagtcgaaggtgatgcagaaggcgacgcggctgagcgtggcgacgacgaccatcttctacatgctgtgcgggtgcatggggtacgcggcgttcggcgacaaggcgccggacaacctgctgacggggttcggcttcttcgagccattctggctgatcgacgtggccaacgtggccatcgtggtgcacctggtgggcgcgtaccaggtgttctgccagcccatcttcgccttcgtggagcgccgcgccgccgcggcctggcccgacagcgccttcgtctcgcgggagctccgcgtggggcccctcgccctcagcgtgttccgcctcacgtggcggtcggcgttcgtgtgcgtcaccaccgtcgtggccatgctgctccccttcttcggcaacgtggtggggttcctcggcgccgtctccttctggcccctcaccgtctacttccccgtcgagatgtacatcaagcagcgccgcgtgccccgcggcagcaccaagtgggtctgcctccagacgctcagcgtcgcgtgcctggtcgtctccatcgccgccgccgccggctccatcgccgacgtcatcgaggcgctcaaggtttaccacccgttcagcagttaattcttgctgctgtggatgtgctgggtggggcctggcctggcctgggtttggacgtatgtgcatgatgcattcattgcgttgcgttcaactgtggtcaacaagggagggagacagatgcagatgcagtgtgagatgtttgcatggaggcccctatagaaacaagtgaaatgtttaggcgcccttgtgcacatgctggtcgcattccttgcaagaataccaggggtggggccagaatggcatgagctgggtgttcctttctaactcttcttcttcttcttctcctcttcttctttatttacatttttcttttatgtgttttcgtctaattaaggttctggttttgtagttctaccgtgcaactcattgtaccggaaaagaatatatgaacaggaaatcccatatgatctttgccatctttaaaaaaaaaaaaggagggcggccgccgncaagacagctcgtcaacccggtaattaatgtccggggcggcaccagcagg

SEQ ID NO: 2944 - DNA, 2072 bp, Zea mays
  Clone ID: PAT_MRT4577_94705C.1
gggtcccacacagccacacaggcacagtctctcgcgtcacctagcaagcaagaagcactcgggagcacttgcttcctgcgctcttccgctccgacggtccgacgaggaagaagaaattcgattcgagggagggagggagggagctcgttggctcagttggccatggcacccgcgccgcacaacggagtgaacaacaaccacccggtcgtgcccatggaggtgtcggtggaggccgggaacgccggagccgcagagtggctagacgacgacggccggccgcgccgcagcggcacgttctggacggccagcgcgcacatcatcacggccgtcatcggctcgggagtcctctccctggcgtgggccatcgcgcagctgggctgggtggccggccccgccgccatgctcctcttcgccttcgtcacctactacacggcggcgctgctcgccgagtgctaccgcacgggccacccggagacgggcaagcgcaactacacctacatggacgccgtgcgctccaacctcggcggcgtcaaggtcgtcttctgcggcgtcatacagtacgccaacctcgtcggcgtcgccatcggctacaccatcgcctcctccatcagcatgcaggccgtcagcagggccgggtgcttccacaagcgtgggcacgccgtcccctgcaagagctccagcaacccctacatgatcctcttcggcgccgtccagatcctcttctcccagataccggacttcgaccagatttggtggctctccatcgtcgccgcagtcatgtccttcacctactccgccatcggcttgtccctcggcatcgcgcagactgttgcaaacggtgggttcaagggaagcctcaccggcatcagcatcggcgccgacgtcacctccacgcagaaagtgtggcacagcctgcaggccttcggcgacatcgcgttcgcctactccttctccaacatcctcatcgagatccaagacacgatcaaggcgccgccgccgtcggagtcgaaggtgatgcagaaggcgacgcggctgagcgtggcgacgacgaccatcttctacatgctgtgcgggtgcatggggtacgcggcgttcggcgacaaggcgccggacaacctgctgacggggttcggcttcttcgagccattctggctgatcgacgtggccaacgtggccatcgtggtgcacctggtgggcgcgtaccaggtgttctgccagcccatcttcgccttcgtggagcggcgcgccgccgcggcctggcccgacagcgccttcgtcgcgcgggagctccgcgtggggcccctcgccctcagcgtgttccgcctcacgtggcggtcggcgttcgtgtgcgccaccaccgtggtggccatgctgctccccttcttcggcaacgtggtggggttcctcggcgccgtctccttctggcccctcaccgtctacttccccgtcgagatgtacatcaagcagcgccgcgtgccccgcggcagcaccaagtgggtctgcctccagacgctcagcgtcgcgtgcctggtcgtctccatcgccgccgccgccggctccatcgccgacgtcatcgaggcgctcaaggtttaccacccgttcagcagttaattcttgctgctgtggctgtgctggggcctggactggcctgggtttggacgtatgtgcatgcagcattcattgcggtgcgttcaactgtggtcaacaagggagggagacggatgcagatgtttgcatggaggcccctatagaacaagtgaaaggtttaggcgcccttgtgcacatgctggtcgcattccttgcaagaataccaggggtggggccagaatggcatgagctgggtgtttgttgtgatgacgagtctactgtaggtgtatgaagcagcaacaaaaaacatgttcctttctaactcttcttcttcttcttctattcttcttctttatttacaattttcttttatgtgttttcgtctaattaaggttctggttttgtagttctaccgtgcaactcattgtaccggaaaagaatatatgaacaggaaatcccgtatgaaaaaaaaaaaaaaagcggcc

SEQ ID NO: 2945 - DNA, 162 bp, Zea mays
  Clone ID: PAT_MRT4577_94884C.1
cggactcgtgggccgaggccgtggcctacgcttaggcgcatcacggcatcggcaagaaagacgccatcaacatcatcctgttcgtgctcggcttcaactccttcggctgctttttcgtggtcctgcccttcctggtttccaaggtctttttgtgcccctgct

SEQ ID NO: 2946 - DNA, 238 bp, Zea mays
  Clone ID: PAT_MRT4577_94991C.1
cccccaggcgggctccaatatctcgaggaaaccgctggggcagagggggcaacttatctacacctcggcctccccccagctaacggccgcggagcacatgtggcaccagtaccttccggcgcccgcctgctccgccatagctgctgagcatctagcgctttaaattccccgccaatgcagctactctagtaattgtttggcggggggcgggggaacaacgaccaacgcggggcggaga

SEQ ID NO: 2947 - DNA, 215 bp, Zea mays
  Clone ID: PAT_MRT4577_95056C.1
tcttcctctggcttctcctccccctcttatcaagtcctcctcgggctagggttccttatggttttgtggaggtgctatgtctgcttctgatgtggagtaccgttgcttcgtcggctgacttgccttttccaccagcaacgattcgcttgagaatgccttctcctcctactgcgatatcctcgactccaatgtcatcacctaccggtagacgggga

SEQ ID NO: 2948 - DNA, 361 bp, Zea mays
  Clone ID: PAT_MRT4577_95065C.1
agcaacataaaatgcacattcgtgtaccaacaatggcacccaaaatattccgcttccttatgctcctgggtctttctgcaagctgttgctaccgtaaccattttcccacaatgctcacaagctcctatagctgttcttattaccccatacctgtcaccaacggtgtcttcaatgtgtgaaaacccaattgttcaaccctacatggatccaacatgcaatcgcaacaggcatcttaccattatgaccattgttcctccaacaaccgtgtgccctattacagtaattacctttggtccatttggtggctatccaatacatcagggcacaacaactacaacaacttgtgctagcaaacattgct

SEQ ID NO: 2949 - DNA, 261 bp, Zea mays
  Clone ID: PAT_MRT4577_95066C.1
ttcttcttctcgtccacagaatggggggtttcgtggggactcataagaccaaggcggagttcaaacgtttccaagttaaattcaatagaaggctgtctgtcaagacagactacagggccagtataaggctgattaaccaagacaaaaacaagtacaacacacccaaatacatatttgtttcgcgatttaccaacaaggacatcacttcccaaattatatttgctagtatagcttttgatatggatcttgcttctgtctact

SEQ ID NO: 2950 - DNA, 333 bp, Zea mays
  Clone ID: PAT_MRT4577_95234C.1
gcgctgtgttttcttttgtttgtttttggagagttttattgttctttttagtggcccctttagttaaatctaactttttttctgtttcgcatatacgtagcacattattagaactgggagcgcacccctaaaaaaaagcatatctgttttattccacccaccgcacatagctagctactcacaaaaaagctgagagattcatgacacagataggcgcgcggcaagacacccctcggtgcgccgagatagaacaccaagaacaccgacacaacagagcgcctttcagacaaggagacggcgccaggccttatatagtgtcacctaaatcccgcg

SEQ ID NO: 2951 - DNA, 1425 bp, Zea mays
  Clone ID: PAT_MRT4577_95273C.1
cgatcgatcgagatatcgtgtcaacgtgccggccggggcgtgggaagatgatgaacctatcggctgccgccaacggccgcgacgagttccccccctacgtcgtgccgtccaacgcggccgctccgcccccttccctgctcccaaccatggagcagcagcaggagagcagcatccacagggagcatcatcagctgctgggctacaacctcgaggccaactcgctggccctcctgcccccgtccaacgccgccgccgcccaccaccacaccaccttcgccggcggccacagcccccacgacatcctccacttctacacacctcctccttccgccgcctcgcactacctcgccgccgccgccggcaacccctacagccacttagtctccgcgcccgggaccaccttccaccagacctcgtcgtcctactacccgcccgcggcggcggcgcaggccgcgcccgagtactacttccccaccctcgtcagctccgccgaggagaacatggccagcttcgccgccacgcagctcggcctcaacctcggctaccgcacctacttcccgcccagaggaggctacacgtacggccaccacccgccgcgctgccaggccgagggctgcaaggccgacctctccagcgccaagcgataccaccgtcgccacaaggtgtgcgagcaccactccaaggcgcccgtcgtcgtcaccgccggtggactgcatcagaggttctgccagcagtgcagcagattccatctgctggatgagttcgacgatgctaagaagagctgcaggaaacgcctagcggaccacaaccgccgccgccggaagtcaaagccatcggatgctgatgccggagacaagacaagggcacatgcgaacaaagcagctgctgctaaagacaaagcagagagtagcagcaagaacatggatatcggagatgggttgggcgcacagatactgggaagtgcactcttgtccaaggaacaagatcaagccatggatcttggagaggtggtgaaagaagcagtggatcccaaggggaaggcatcaatgcaacagcattacggcttccccttccattcgtcgtcagcaggatcttgcttcccccagacccaagccgtctccagtgataccacatccaatataggtcaagtgcaagagccaagcttagggttccaccatcagcaccaccaacacagcaacatcttgcagctcggccaggctatgtttgatctcgacttcgatcactagtcaatatgtgatgcacatgcaccctctctttctcaccccacccctccttccctccctctatcttgtttgtgcgcgtaatccgaatatttttcctttttaaattatctgtgttaattactgtaacgtggacataataatgatagtctatgcttgccatgcaatcatctatattatagtt

SEQ ID NO: 2952 - DNA, 223 bp, Zea mays
  Clone ID: PAT_MRT4577_95443C.1
ttttaccacgaaaacaccctttatacatcgaatgctttaacggaagattggtccatccttgtatgctcattgtggtaaacgcatgtgaccacctacagctagctgcatacagattgcctcaacctgtggcaacgtttgaacacttgtttgtagacgacattcttataactaataccctgacttggctgttaaccaatcgacaaccacgatatctcatcgatat

SEQ ID NO: 2953 - DNA, 867 bp, Zea mays
  Clone ID: PAT_MRT4577_95672C.1
gccgaagtcatgggaatcaccatcaactccttccccaagccgcaacctcccacaaatctccgcctcccctccccttccgacccgcccaggccgcagcagagcgccatgtcgtcctcccctacccccgcgccagacgccggcgccgccgcgatggccgtcgacgactcgtcggagaccgaccagctcgactccatgtccacggaggacatcgtccgggccacccgcctcctcgacaacgaggtccgcgtcctcaaggacgagctgcagcggaacaacctggagctcgagaacgtcaaggacaagatcaaggagaatcaggagaagataaagctcaacaagcagctgccctacctcgtcggcaacatcgtcgagattttggaaatgaaccctgaagatgaggctgaagaggatggtgctaatatagatctggactcacagaggaaaggaaaatgtgttgttcttaagacatccacaagacagactatattccttcctgtgatcgggctagttgaccctgacaacctcaagcctggtgatttggttggagtcaacaaggacagctacttgatattagacacgctaccttcggagtatgactctcgagtaaaggcaatggaggtagatgaaaagcctacggaggattataatgacattggtggccttgagaaagagattcaggaactcgttgaagctatagtgttgccaatgacacacaaggagcaatttcagaagttgggaatccgtcccccgaaaggagttcttttatatggaccacctgggacgggaaagacgttgatggctcgtgcatgtgctgcacaaaccaatgcaacctttctgaaacttgctggtccgcagctagttcagatg

SEQ ID NO: 2954 - DNA, 375 bp, Zea mays
  Clone ID: PAT_MRT4577_9575C.1
gccagaaaacccagcccatgtacagggccattcatacaggaaccgatgttttggtagcataccattacccaaactgactttatgacaatgttagccggggatgaccacaatggaaacggtagtttaggaacaagccggcccctttggtggctgggaagggtgaccacacacaaacacaccagaccaggggcagaaccacccgcctggggcgccaacgaggggcgctatccggtatagcacgacaaaagtaaaaataaaacatcacgagggggagggaaactgaataattctagtacagggatataggctccttttttgtgagcgccaaggggccttggggagccgctccattgttggatgaagcacggcacattg

SEQ ID NO: 2955 - DNA, 2386 bp, Zea mays
  UNSURE (1)..(2386): unsure at all n locations
  Clone ID: PAT_MRT4577_95838C.1
  unsure (1)..(2386): unsure at all n locations
ccggccgggccggggtgtggttgctttgcttagcactggcacagcgcagcacatgaggagaagaagagggaggagtaattatttattaattaacaaagaagaagacttcttccttcctcgtcgtctccagcccattccaattcttgattccatcgccccaccatccacaactcccctaatccttccaacctcctcgtcgtccagtccaccacctccacgcgcaatggccagcggctaggcggcaccaaccagatcacaaggattcgtttcatccggcagcgcagctctagagcctccatgggcagctacgcgtacaagtactgtatgtgcttcacgcgcaagttccgatccccggacgcccagccgccgccggacgtccgcgccgcccacctctccttcgcctctgacgcccatgccctccgccgcttcgtcgccggcgtccagggcgagtcccccgccgacgtcgaccgcatcctcgccatgctctccgggggccacagccatggaatcgcccgcctcgtcacaaggtcgccggcggcatccacgcccacgctcgaagacttcttcgccttcctcttctcccccgacctcaacccacccatcgcgcaccaggttcaccaggacatgtcagcgccgttctctcactatttcgtgttcaccgggcataattcctacctcactgggaaccagctcaatagtgactccagtgacgtcccaattgtaaaggcgttgcagagaggtgttagagtcattgaactcgatatgtggcccaatccttcaaaggacaatgtcgatattcttcatggagggacattgactgccccagtggaaatgatcaaatgtttgaagtccatcaaagaatacgccttctgtgcctcaaattatcctcttgttattactcttgaggatcacctcacatcagatctccaagctaaagttgctacgatgctcactgaaacatttggagatcttcttttcgtccctaatccagacccgatgaaagagtttccttctccagcatctctaatgaagagaataatcatatcaaccaaacctccacaagaatataaggagtttctcaaagccgagaataatcgcagtggcagcggaaacatagctgagttgccagaccaaggaagcctgagaagaatagattcaaatgccgatgaatctgatgggaaggatgaactggatgagcaagacgaggaagactccgacgaggacgatcccaaatttcagcaggatacagcctgtgagtataggaaactcatcaccatccaagctggcaaaccaaaaggccatttgcgggatgcgctaaaagtggatccagacaaagtcaggcggctttctttgagcgagacacagttagctaaagcgacaatctctcatggtgctgaagtcataaggttcacacagaagaatatactccgtgtgtatccaaagggcacgagggttaattcttcaaactacgatccaatgaacgcctggacccatggtgcgcagatggttgcgttcaacatgcagggccatgataaagcgctccggttgatgcaagggtttttcagagccaatgggggctgtggttatgttaaaaagcctgacttcttgctaagaacaggtccaaatggggaagtatttgaccccaaggctagtttgccagtgaagaaacccctccaaggtgaaagtttatatgggagacgggtggcgcatggacttcagtaaaactcatttcgatgccttttcgcctccagatttctatactagggtagggatcgcaggtgtgaaggcacacagtgtgatgaagaagacaagggtgattgaggcccagtgggtgcccatgtgggatgaggagttcacgttccttctgacggttccggagctggccctcctgagggtagaggtccaggagtacgacatgtcggagaagcccgacttcggggggcagacagtcttgccggtatgggagctgaagcagggcatccgtgctgtgcccctgcacgatcgcaagggtgtcaggtacaagtccgtcaggctcctcatgcgatttgattttgtgtagccgagccgagccgccattcagattcagcttctgtttttttccttcttgtgtgaattgaatgtattactcccttccttccatcttcaacgtatatgtgtatgtatgtacttatttttgtcggaataaaagttgtatggaatggaatggaaggaaggagtagaactgtcttcaaactccagcttctagatctgtacgggtgattcagttttacttgctggcacattgtttgtttgtttactttactggagatagatttgtacatgagcttgattattcttcatttagctactggctaagagatagattaananaaaaaaaaaaaaaaaa

SEQ ID NO: 2956 - DNA, 420 bp, Zea mays
  Clone ID: PAT_MRT4577_95881C.1
ccgaagagttccattccctagccgccgtcgactatcgtcttcctcacaggttccggggccggggaactggccgagctctaagtagagaatccgttttcattgtctcagcacaggctctgctgcctctggtggtaatgaaggggacaaattcgagacatctcttccggatcaagcgttccaactcgataatcactgatttcacacatagcttcgacaatttgaatatgatgtactaatggagtctaaagctggcaccaagtctagcaggaaacgttccatgatgtatgaagcttcccatggctacagcattgacgacactcgacactgccggaggcgtgaagaactcccagtcatgctgcttactccaactgcgcgaagaagccatcctgatatccctttcggcttcctcattctagtagt

SEQ ID NO: 2957 - DNA, 389 bp, Zea mays
  UNSURE (1)..(389): unsure at all n locations
  Clone ID: PAT_MRT4577_96002C.1
  unsure (1)..(389): unsure at all n locations
cggacgcgtgggttctggagcagctagggttccgtcctcgatccgatccgccnagtgcggaccaggtttccccacgcggatcgaatcgatggccgccgagggcgagaagaagatgataaccctcaaaagctccgatggcgaggagttcgaggtggaagaggcggtggcgatggactcacaaaccatccgccacatgatcgaggatgactgcgccgacaacggaatacgtcttcctaacggccactccaacatcctatgcaaggtaatcgagtgctgcaacaagcacgtacatgccgacgccgacgccggcgacgcctcgaaggccggttaccacaacgtaggtgacgccttcgacaacagcaacgacaactccggtgaggaccgtcaga

SEQ ID NO: 2958 - DNA, 2019 bp, Zea mays
  Clone ID: PAT_MRT4577_96005C.1
gaaacagtcagcgcagggcagggcagcctgacagacagccgcggcggcaccaggccaacggtcagcgcagggcagggcagcctgaaagaaagcggcggcggcagcaggtcactggctcactgctctgtcctctcgtctccagagttcagaccaccgcatcgccatggcgccgccgcagacgatcccccggcgcggcctcttcattggcggggcctggagggagccgtgcctcgggcgccgcctgcccgtcgtcaacccggccaccgaggccaccatcggcgacatcccggcgggcacggcggaggacgtggagatcgcggtcgccgcggcgcgggacgcgttctcccgcgacggcgggaggcactggtcgcgcgcccctggggccgtgcgcgccaacttcctccgggcgatcgccgccaagattaaagacaggaaatctgagctggctttgctggagacacttgattctggaaagcctctggatgaagcaagtggagacatggacgatgtcgctgcatgctttgagtactatgctgatctggcagaagctttagatgggaagcaacagtcaccgatctctctgcctatggaaaactttaagtcgtatgtacttaaagaacccattggggttgttggactgatcactccttggaattatcctctgttgatggcaacttggaaggtcgcacctgccttggctgctgggtgtacaactatattaaaaccttcagagttggcttctgtgagctgcttagagcttggtgcaatatgtatggaaataggcctaccaccaggtgtcttgaacataattactggtctgggccctgaagctggtgctccattatcctcacattcccatgtggataaggttgcttttactggaagtacagagactggtaagaggataatgatttcagctgcccaaatggttaagcctgtttcattagagcttggtgggaaaagtcctcttattgtctttgatgacattggtgacattgacaaagctgttgaatggaccatgtttgggatcttcgcgaatgctggtcaagtctgcagtgctacttctcgtttactgctgcatgagaaaattgcaaagaaattcttggatagattggttgcatgggcaaagaatataaaagtctcagatccactggaggaaggctgcagactgggttcagttatcagtgaaggacagtacgagaagataaagaaattcatctcgactgcaagaagtgaaggtgccacaattctgtatggaggtggccgaccacagcatctcagaagagggttctttcttgaacctacaattataacagatgttagtacgtcaatgcaaatttggcaagaggaagtctttggaccagttatctgtgttaaggagtttaggacagagagtgaagctgtggaacttgcaaatgatactcactatggtttagctggtgccgtgatctccaatgatcaagagaggtgtgagcgcatttcaaaggctcttcactctggtattatttggataaattgctcgcaaccatgcttcgtccaagctccttggggagggaacaagcggagcggttttggtcgggagctcggagaatggggtcttgataactacctgacagttaagcaagtcaccaagtattgctcggatgaaccgtggggatggtaccagcctccatctaagctgtgaaggggcattcactccagggaatgtaatgcatcattaactgacagcatcagtcctgttaatggacaggagctcgtgtacagtacagtgctcgtaaaaaaagctctttgatggtaaagttgcttgctgctatcactactccagaccagaattcaggactggagagtacgatgtcatgagttgtactacttgttagtctgcactctttatcattcgaagtttggcagtggtgtgtagttgcacttggaagattgcaataataataaagataattggataattgatccattttaatcaaaaaaaaaaaaaaactcgaaaatagtaaaaaattggggggc

SEQ ID NO: 2959 - DNA, 1633 bp, Zea mays
  Clone ID: PAT_MRT4577_96019C.1
ttttttttttttttttttgcaattgcaaccacgcatatatttttttccttcattctctttgacaaaacatccatttcgtatttcctcgtttcaatgcttctcgctacaaacaaaaaaaaaacaatttggataagtctggacataacgcaggagaaaacggaatctcgcctgtgggccccgtccccaactcccgtgtcgacaactcgccaccaccttctcttccgttccagaagggacagcgtccgtgtcttccttgctcactctcctcaccactaccctgacctgacctgctcccaagctccctctgcctgcctttataaatcaccggggcagagcgcctcagtgacacacgccgctgctccaagaaaccaccgccgagcccaaccgcacaagcgcgcgaggcaggagagagagagaggcggggagcaaaacaatggaggggaaagaggaggacgtgcgcctgggcgccaacaagttctcggagcgccagcccatcgggacggcggcgcagggcgccgctgacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggagggatgatcttcgcgctcgtctactgcaccgccggcatctccggaggacacatcaacccagctgtgaccttcgggctgttcttggccaggaagctgtccctgactagggccatcttctacattatcatgcaatgcctgggtgccatctgtggagctggagtggtgaagggcttccagcaggggctttacatgggcaacggcggtggcgccaatgttgtcgcccctggatacaccaagggggacggccttggcgcagagatcgttggcaccttcatcctagtctacaccgtcttctcggccaccgatgccaagaggaacgccagggactcccatgtccccatccttgccccactgccaattgggttcgcggtgttcctggtccaccttgccaccatccccatcaccggcaccggcatcaacccggctaggagccttggcgccgccatcatctacaaccgggatcatgcgtggagcgaccattggatcttctgggtcggccccttcatcggcgccgccctggctgccatctaccaccaggtgatcatcagggccatcccgttcaagagcaggtcttaagctgccgcgggtgtgctgagacatgtggggaatgtattgtctgcccacgcctagtttctctgctgaatcttccatctctcttcccttcagggctgctcactgctgcgccgttctgttaaccgaaacaagaacttcgtgtattcctgtaccgagctgtgtgtatgtttttttttcttccatcgtgtttgctgcaaggtttgccgtctcattttatgcgttgggatgttggcaagaaagggcagatgtcatgtggaaacgtgggtttataactatcagctggatttttcatccaagtggaatcgattcagaattttctttaaaaaaaaaaaa

SEQ ID NO: 2960 - DNA, 2307 bp, Zea mays
  Clone ID: PAT_MRT4577_96073C.1
gtccttctccccaggccccagaactccaaccaccactctgactccagattccttctccctccccgaagactagccggtgccggcgcgggtgccgtgcccttcactttttccggggactttggaccctacgtatccagatctacaagtttccctccctccatatattcggcttccgagcagagtatcccagccccaacccgccgttctctcccgcgcgccgatcggaccggaggctcgccgttccaccatggcagaggccggcgaccccaccctggagcaggggctcctcgctaacccggaggaatcgaaccaacttacatacagtggagatggatctgtcgacttttcgggaaaccctgtcgtgaaggagaaaactggcagatggaaggcatgcccattcatcttaggtaatgaatgctgtgagcggttggcctattatggcatctcgacaaaccttgttacttacttgacaaaaaaactacatgatggtaactcctctgctgctagaaatgtgactacatggcagggaacttgctatttgactccccttattggagctatcctggctgatgcatactgggggaggtattggacgatcgcaacgttctccacaatatacttcattgggatgtcagtactgactctttcagcatcagttcctatgctcatgcctccatcttgtgaaggagccttttgcccagaagccagtcctttgcagtataccgtcttttttcttggtctttatctgattgcgctcggtactggtggaattaagccgtgtgtctcatcttttggagcggatcaatttgatgacacagatccagctgagcgaatccagaagggttctttcttcaattggttctatttttcaataaacattggtgctctcatatcaagcagctttctggtttgggtgcaagacaatgtaggatggggactggggtttggcattccgactgtattcatggggctggcaatcataagcttcttctctggtacatcactttataggttccaaaaaccaggaggtagtccaattacacgagtatgtcaggtgattgttgcctctttgcgcaagtggaatgtgcctgtcccagaggatagctctctcttgtatgagctacctaatggggtatcaacaattgaggggagtcggcaaatagagcacacagatgaactcagatgtttagataaggctgctacagttaccgaagttgatgtgaaaacggctgacttcaacaacccatggcggatatgcactgtcacccaggtggaagaactgaagatactagtaaggatgttccctgtctgggcaacaacaatagtgttttctgctgtatatgctcagatgtcaacaatgtttgtggaacaagggatggtgcttgacccatccttgggctctttcaagatccctccagcttcactatctactttcgacaccctaagtgtcatcatatgtgtcccgatgtatgattacatcgtggttccgatagccaggagattcactggcaacgagaggggctttacagagttgcagaggatgggtattggcctggtaatttccatcatagctatgtcagtcgccgcagtcctcgaaatcaagcggctagcagttgccagggaagcacacctggtggatcagaatgtcccggtcccactgagcatattctggcaaatccctcagtatttcctgattggtctagcggagattttcacattcattggggcgctcgagttcttctatgaccagtcaccagacgccatgaggagcctctgcagcgcgcttaatcttctcactactgcgtttgggaactatctcagcacgttcattttgacaatggttgcgtactttactacgaggggaggtaaccctgggtggattcctgacaacttgaacgaaggccatcttgattacttcttcttgctcatcgctggcatcagttttctgaacctgattgtttatgtcctctgtgctggcaaatacaagagcaagaaggcagcttgagttgtgaaggccaggggctggatggcgtgctgcgcgccatgttatggtggacacttcagttcaaaatctgtatatatgtttcccgcattaaccaccctagctgaagcaaccatctgcaattgttgcaaagtttatattcttcattgtgctggactaagttgattatacattcgtgcttctactttgtgtatgtatatatctgacctaaagttgctgaacatagacaatttcacttgcctctggtatccaggattaagacggcccaatttcacttgcctctggtatccacggttttgattaag

SEQ ID NO: 2961 - DNA, 266 bp, Zea mays
  Clone ID: PAT_MRT4577_96215C.1
acatgaccccttcgaggtcctggaccagaggggagtgggcgagctggtgaagtttgctacagagagggtgcgcaaagctaggtctaacttgaaggtgggcatttgtggagaacacggtggagagccttcctctgtagcttcttcgcgaagctgggctggattacgtttcttgctcccctttcagggttccgattgctaggctagctgcagctcaggtgcttgtcctgagctgcctcctcattggcaaccggatttctgctgctggt

SEQ ID NO: 2962 - DNA, 364 bp, Zea mays
  Clone ID: PAT_MRT4577_96289C.1
attcggctcgagctcactatagttgcttttctccatataccagatccaattcgcgagttctcccttgtgtgcggccatggcgctctctgtggtgaagacctcgtacggactggagtacaaggtcaaggatctctcgcaggcggacttcggacgtctcgagactgagctgaccccggtcagaatgcccggccttatagcgtgccgcaccaagctcagcccgtgcaagccgttcatccgcgctaggatctcggggtctatgcacatgaccatccagaccgccgtcctcatggagacgataaccgcgctcggctccgaggtccgctagtgctgctgcaacatcttctgcactcatgaccacgccgac

SEQ ID NO: 2963 - DNA, 2094 bp, Zea mays
  Clone ID: PAT_MRT4577_96538C.1
cctcgggcattgggaccctcgaggccggccgggagaagccgcagccacgcccccacaccaagccgtatcgtcttctccctcttgtccggttcgggtggtccgcggtcggggtgagtgagtgagcagctttgcttctccatctccccgttcccttccctccccagccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggagacggcggcggcggcggcagcggccaacggaaaagcgtgctgccacgccgccaaggggcccgggtacgccacgccgctggaggccatggagaagggccccagggagaagctcgtctacgtcacctgcgtctacaacggcactggaattaacaagccggattaccttgcgacggtggatttggatcccagctctcctacatactcccaggtgatccacaggctcccggtcacccacatcggcgacgagctgcatcactctggctggaactcctgcagctcctgccacggtgacccatcggccaagcgccgcttcctgatcctgccttccttgctgtcaggccgtgtgtatgtcgtcgacacagcgacagacccaagggcgccatccttgcataaggtggttgagtctgaggacattgctgagaatactgggcttgggttccctcacacgtctcattgccttgcgtctggcgacattatgatttcttgccttggggacaaggaggggaatgcagctggcaatggcttcctgctgttggattcagagtttaatgtcaaaggacgttgggaaaagccaggtcacagtcccttgtttggatatgacttctggtaccagcctcgccacaagacgatgatcagttcgtcatggggagcccctgcagcgttcaggacaggtttcgatcttcaacatgtccaggatggcctgtatggaaggcacctgcatgtgtacgactggcctggcggtgagctcaagcagacacttgatctaggtgacactggactccttccccttgaggtgaggtttttacatgatccatcaaaggacactggctatgttggctgtgctttaacaagcaacatggtgagatttttcaagaccgcggatggatcgtggagccatgaggttgctatctctgtgaaaccactgaaggtccgcaactggattctgccggaaatgccaggattgataactgatttcgtcatctctcttgatgaccgttatctctactttgtaaattggcttcatggcgatattaggcagtacaacattgaggatcccgcaaagcctttcttggctggacaagtatgggttggtggtcttcttcagaagggcagtgatgtcgtctatgttactgatgatggtcaggaacagcagtacaatgtgcctcaagtcaagggtcatcgacttagaggtgggccacagatgattcagctgagcttggatggcaagaggatatacgtgacaaactcacttttcagccgatgggatgagcagtttttcggtgatgatcttgtcaagaagggctcccacatgttgcagatcgatgtcgacaccgagaaaggaggcctggctgtcaaccccaacttcttcgtcgattttggcaccgagcctgatggtcctgccctggcccacgagatgagatatcctggtggggactgcacctctgatatatggatctgaggtcaaggattcggcgtaattaacaggctgctggagaatccctgttgttgtatgcactgtaattaacatggtatccgtgcggtgttctgtcttgtactgcgactgttgccagtggaataaggcatggtttcatgagaactctagattaataaaagaagtcctgattctaaaaaaaaaaaaaaaaaaaaaaaaaaaaaaaaaaaaaaaaaaaaactcgagactagttctctctctctcctcgtgcggggggggggggggggggggggggggggggggggggggggggggggggggggggggggggctcgcggggggg

SEQ ID NO: 2964 - DNA, 261 bp, Zea mays
  Clone ID: PAT_MRT4577_96581C.1
gtcacactgcacgttttggacactgaactgtgagatggcatcagcaaagcgttcccgtgaggaaaatgtgtacatggcgaagctcgcccagcaagcagagaggtacaaagaaatggttgagttcatggacaaggtagcgaaaactgttgactcggatgagctcactgtggaggagcgcagcctcctgtctgttacatacaagaacgtcattggagcccgccgtgcctcatggcgcatcatctcctccatcgagcagaagga

SEQ ID NO: 2965 - DNA, 615 bp, Zea mays
  UNSURE (1)..(615): unsure at all n locations
  Clone ID: PAT_MRT4577_96713C.1
  unsure (1)..(615): unsure at all n locations
tcgcccttnnaggcgtggtcgcgtgcgcgagggtctnnttggtgcactttattgggcaccaaaacatcaggnngcacaacaactacaacnnaacttgtgctnnagcaaaccttgctnngcctactctnncagcaacagcagnntttcttccatttcaacnccaactaggttcatnntgaactctgcnnttcttatttgcaacagacaacagagctaccattcaagccanngctaccnnngctgcctacnnccccagcaatnnttcttccattttcaaccaacnntagcagcattgaaccctctcctgctnntatttacagcagcaacccaactactacnncattcagccanngctagctggtggtgagggccctgctaccttnncttgacacaaccacnnagttgttgccgttctaaccagcacgttgncgcctaacgctggcacccntcttacaactgcaacaattgctgccattcaaccaacttgctttgacaaacccagcagtgttctaccaacaacccatcattggtggtgccctcttttagatttcttatgagttatagttcaataataaagttttttatctgatgtttgtggcttcccagaataagaaa

SEQ ID NO: 2966 - DNA, 304 bp, Zea mays
  Clone ID: PAT_MRT4577_9673C.1
ggcgaggcaaaagcgcaaacgcgaccacagacagagcgcgcttcaaggccttttttttttgagataacaaagaggagaagaggagatggcggtcacgatcaccttgggtaaggcgaggcagatcttccgcagccgcggcaaccccaccgtccaagttgacgtggggcccaaggacggcagctacgccaaggggggcgtacccaacggggcatccactgggatatatgagggcttggagttgaaggattgaagatctggataacctggcaaaggtggtcctaaagcctgcaacaacggtaaccac

SEQ ID NO: 2967 - DNA, 2646 bp, Zea mays
  UNSURE (1)..(2646): unsure at all n locations
  Clone ID: PAT_MRT4577_96895C.1
  unsure (1)..(2646): unsure at all n locations
ggaatggcctctctcgcatactctcttctttcttcttctatctcagccgccgatctctcccgccctaccccgctacccgacggcgtcgttgacaccatagccacacgacaccagctgggtcaaggggtccaagcctgcgctgcgcggccaagcttttgcccagaccatcattgctcctctcatctttagttggggaagtgggaaagcggcaattatccggccgggacccgcctactccgtcttcttatacgagacgccgtgcgcttcttcttggcctagcccttcgagcaggccggctggaggccggggtttcgtcctcctcttcgcattagcgcggccagagagagatgcgggtgggagttgggatacctcggaggcggcgacgacaggatcgcagtggtcagtagccgggtcggccggtggccgcagattctcaccagcagcgccatccctcgccgtcgcccggcgctccagcccagggcaggagaggaggccactctgactgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcttactatggcatgagcaccaacctggtgaactacatgaagacccgacttggccaggtgaactccgttgcctccaacaacgtcaccaactggcaagggacgtgctacatcacgccgctcatcggcgccttcttcgccgacgcgtacatggggaggttctggaccatcgccatcttcatgatcatctacattttcggcctggcgctgctgacgatggcttcgtcggtgaaggggctggtgcctacgtcgtgcggcgacaaggatgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacagtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccggcatcgaggggagccgcaagctggagcactcggagcagctggcgtgcctcgacagggctgccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggtaacacgctggaccagagcatggggccccggttcaagatcccctcggcgacgctgtccatggtggacaccatcagcgtcatcgtctgggtccccgtgtacgaccgcgccatcgtgcccctggtgcgctcctacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgaggacgacatcgtgcccatctccatcttctggcagataccgcagtacttcatcatcgggtgcgcggaggtgttcaccttcgtggggcagctggagttcttctacgaccaggcgcccgacgccatgaggagcatgtgctccgcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgccgtgctcagccttctcaacttccttgcctacctcgtcatcgccagctggtacaagtacaagaagacggccgatgattaccctggcgccaaaggggagcacggtacagagcactgatgggcgagaatggcggaaattgagtgatttctatgtgtggttagctgtctgtcgacttgttttgccacagtttgggtgcttaaacgttaacgtacgtactagttcaatatagtgtctcgggggcgaattggttgtttacatgtcatgtgtttatatatgcgcaatgttcgatcttagtggaataagtcaagtgctcttatgaatcaaaaggtgttgaggatttgatgcgtcaaaaaaaacgatgtctcggggggcgaattggttgtttacatgtcatgtgttgttatatatgcgcaatgttcgatcttagtggaataagtcaagcgctcttaaaaaaaaaaaaaaaaaagaaaaaccn

SEQ ID NO: 2968 - DNA, 940 bp, Zea mays
  Clone ID: PAT_MRT4577_96897C.1
aaaagtggcaatcattgggaccctcgaggccggccgggacggacccatcaaaagaggccccttcatctttggtggcctagctggattggatatttggacgagtgttcttcttggcttggccacccgcctactccgtcttcttcatacgagacaagccgtgcgcttcttcttggcctagcccttcgagcagggcaggagaggaggccactctgactgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcttactatggcatgagcaccaacctggtgaactacatgaagacccgacttggccaggtgaactccgttgcctccaacaacgtcaccaactggcaagggacgtgctacatcacgccgctcatcggcgccttcttcgccgacgcgtacatggggaggttctggaccatcgccatcttcatgatcatctacattttcggcctggcgctgctgacgatggcttcgtcggtgaaggggctggtgcctacgtcgtgcggcgacaaggatgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacagtgctggtgtacgtgcagacgcacgtggggctgggggctggggcttcggcatccccgccgtggtcatggccatcgccgtcg

SEQ ID NO: 2969 - DNA, 2207 bp, Zea mays
  Clone ID: PAT_MRT4577_96902C.1
tgggagttgggatacctcggaggcggcgacgacaggatcgcagtggtcagtagccgggtcggccggtggccgcagattctcaccagcagcgccatccctcgccgtcgcccggcgctccagcccagtctactactcatgcaagaagaatcgttcacaccctgaagaacaagaatcggtgtgtatttgcagggcaggagaggaagccactctgactctgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcctactatggcatgagcaccaacctggtgaactacatgaagacccggcttggccaggtgaactctgtcgcctccaacaacgtcaccaactggcaagggacgtgctacatcacgccgctcatcggcgccttcttcgccgacgcgtacatggggaggttttggaccatcgccatcttcatgatcatctacatttttggcctggcgctgctgacgatggcgtcatcggtgaaggggctggtgcctacgtcgtgcggcgacaaggacgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacggtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccggcatcgaggggagccgcaagctggagcactcggagcagctggcgtgcctcgacagggcggccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggcaacacgctggaccagagcatggggccccggttcaagatcccctcggcgacgctgtccatggtggacactatcagcgtcatcgtctgggtccccgtgtacgaccgcgcccatcgtgcccctggtgccctcttacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgagaacgacatcgtgcccatctccatcttctggcagataccgcagtacttcatcatcggatgcgcggaggtgttcaccttcgtggggcagctggagttcttctacgaccaggcgcccgacgccatgaggagcatgtgctccgcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgccgtgctcagcctcctcaacttccttgcctacctcgtcatcgccagctggtacaagtacaagaagacggccgatgattaccctggcgccaaaggggagcacggtacagagcactgatgggcgagagatggcggaaattgagtgatttctatgtgtggttagctgtctgtcgacttgttttgccacagtttgggtgcttaaacgttaacgtacgtactagttcaatatagtgtctcgggggcgaattggttgtttacatgtcatgtgtttatatatgcgcaatgttcgatctcagtggaataagtcaagtgctcttatgaaaa

SEQ ID NO: 2970 - DNA, 298 bp, Zea mays
  UNSURE (1)..(298): unsure at all n locations
  Clone ID: PAT_MRT4577_9696C.1
  unsure (1)..(298): unsure at all n locations
tccactcntccgcccacgcgtccgtggacgcgtgtgcgatcggaaccctctccatggccgacgaggcgaaggcgaanggttacgcggcgttctctgccggccgcttcgaggaggctgtgcnctgtacttcactgacgccatcgggcttgtccgagacaaccaggtggtctactccaaccggtcggtggcgctcgcactgctccaccggtactccgatgctctgagcgacgcgcagaatgacgctgcgacctcatgcccgactgggccaagggctactcccgcctcggcgcggcgcacc

SEQ ID NO: 2971 - DNA, 1856 bp, Zea mays
  Clone ID: PAT_MRT4577_97035C.1
cacaggcacactcatggtgaactctgccatcccagaaaaattcctcccaccgcgacggcgacgagcacggggaccctccaccgcctccgcctccgcctccgcctcgccgcgtgcggcctccgcaccgccccgacgtcgacccctccgccctccccctcggccaccgacgcggcgccgcccgccctccgccgccgccgccgccgcggcgggctcggtctcctctggaagctcccctacggccgcgcgccgtcccgcccgatggacgcgctgccgcctctgcagcgcgccacgtcgccgccgccccagccccggccccagccgcccgtgccgtccaggaggtacggcgtgcacttctcggcgtccagcttcatccaggcgccgctcaccacgctgctcgagtactccggcatcctccgccccgatccaggcggcggaacccagcaggatggggccggggctgggccgggcgaggtgtcgatccggattgtggcgcccggcgaggcggggacgtcgtctgagaggcccgaggaggtgatcgtggaggaggaggaagaggatggacacgcaacgagaacgcgcccggaggacccgtcacctgcggctggtggcggggagggcggcagggaatcctcctcatcgtaccagcggtacgacatacagcaggtggccaggtgggtggagcagatactgccattctcactgttgctgctcgtcgtcttcatccgacaacatttgcaaggtttctttgtgacaatttggattgctgcggtgatgttcaagtccaatgatatcctgcgtaagcagactgctctgaagagggagagaaaaattccagttcttgtcgggattacaatattatttgttgttcatgtatctgggttttattggtgttacaagaacggggatcttataagacctctcatgatgcttcctccaaaagaaataccaccattttggcacgcaatattcatcatcttggtgaacgatacaatggtgcgccaaactgctatggttgtcaaatgtttactgctgatgtactataagaacagcagagggcgtagctatcgtaggcagggtcaaatgttgacgattgtggaatattttctacttttgtatcgtgcattattgcctacacctgtgtggtaccgttttttcctgaacaaggagtatggaagcctattttcgtctctaaccactggcttgtatctcactttcaagttgacatcagtcgtggaaaaggttcaatcatttttgacggcattgagagcgttatctcataaagacttccattgtggctcatatgcaacaagcgagcaggtggctgctgctggagatttgtgcgcgatatgccaagagaagatgcacgttcccatccttttgcgctgcaaacatgtcttctgtgaagattgtgtgtccgaatggttcgagagggagcggacttgcccgctgtgcagggcactggtgaagccagcagacctccggtcgttcggtgacggttcaacaagcctcttcttccagctattctaatctgagagagccaaaagagctgggcaagctggggcgctccacccgatgtgcagatgttaggtgtgtgtgtgtgtgtgtgttgctgctggcaacgcgtgcgagcagtgcggccctgatgcggtgctgggagagtgtacaccgagctgaagctgaaggcgtacatggttgtgtattgtgattgtgcatattttcatcccatgtataggcactcgcgggatgcttgagcacctgaggatttttacctgaccttatacgcacaaactactacgtaaatagaaatggtgagtatatacaatggttccggatgcgtcgataaaaaaaaacgttaa

SEQ ID NO: 2972 - DNA, 1257 bp, Zea mays
  Clone ID: PAT_MRT4577_97181C.1
gccgggacacagcatccgcagttccccgacccaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcacgtgaaccttatcaaggaatatcgtggcaagatcgaggctgaactgggcaatatctgtgatggaatcttgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacgatgatggcctacaaggctgctcaggacattgcgctggctgagctggcacctacccatccgataaggcttgggcttgctcttaacttctcagtgttctattatgagattctgaactccccagacaaagcttgcaaccttgcaaagcaggcgtttgatgaagctatctcccagttagacacccttggggaggagtcatacaaagatagcactctgatcatgcagctccttagggacaacttgaccctttggacctctgacctcacggaggatggtgctgatgagggcaaagaagccccgaaaggtgaggctggtgacggacagtaatcttgggagagcgcatattgttcgagcccattgttttagatgctctatgctgtcgaagctgaagctgtgccgtgctattattgtagctgatttcctgttccctcacttctttttttatattagtaggctggtagtgttcgaattagttccccattgctttgtgttgccgctagttggcattaagtccgtgtggactggtattattcactggatttgagaagcatgtcagtggttgctctagcgttttattgagttttgaagtcatctccctcatttcggtttcaatcatttagcagattgtgcatatggttgtgtaaaacacagttttgcacaattgcacaatttacgtagtgtggtttgaaataagagtgagatttgggctggatgaaaaaaa

SEQ ID NO: 2973 - DNA, 1380 bp, Zea mays
  Clone ID: PAT_MRT4577_97182C.1
cattgggtacctcgaggccggccgggccgggaccacagcatccgcagttccccgaccacaccgttcctccgaggtccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaattcaggctcgagggagaacactatctgtgatggaatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggtgatgcaggcgagggacagtaatcttcggaggggggtgcaaagttgttcgagccccaatgttttagatgctctgtgctgtcgaagctgtgctgtgccattattgtagctgatttcgtctccattcacttcttttttcttgttagtaggctggtagtggtcgaattagtaccccattgctttgtgttgccgctagtccatgtggactggtattgttcccctggatttatttggcaagcgtgtccgtgctcgctctagcgttttattgagcttttaaagtcatcgcattcttatttgattgcaatcagttattggctggatatgcggtggctgtttggatcagaagtagcgcttgggctctgcagccggagtttcttcaccggagcgtgtaacaatgtggaaattggaaaccacgcaaacgtctcttatttgtacccctgagtatacagggcttgtttggttcggttttttttaacagcttttctg

SEQ ID NO: 2974 - DNA, 1630 bp, Zea mays
  Clone ID: PAT_MRT4577_97187C.1
ctcgaggccggccgggaaatttctgtccttcctgatctagttgcgtgtttgttctacgggagatgcggagtgctgcgacgccttatttatttattttcggttggtgttctgcgatgtggcgagatccgctttgtgctcggtgcctttgttcgagctagatccgccagatccgaggcttcgagcgaacgtgacgcctagatccgcctgatttgggaataatttggtgcgaggaccggctgttgatgagcttttgggtttacgttccccttttggggttaggaaccgtatctgttacgggcttggagcggggacacggatggttgaatgtggaatttgttgagtgaagtagtgtcggcatgaggtggatatttgatttgtatgtacaagtgccttcacggctagtatattaaagtaagtttgttcttttatcgatatggcgagggaggagaatgtctacatggccaagctggctgagcaggccgaaaggtatgaagagatggttgagtatatggagaaggtggctaagactgtagatgtggaagagctcactgttgaggagcgtaacctcttgtcggtcgcatacaagaatgtgattggggctcgccgtgcttcatggcgcattgtctcttctattgaacagaaggaggagtcccgtaagaacgaagagcatgtgaaccttatcaaggaataccgtgcgaagatcgaggctgaactgagcaatatctgtgatggcatcctgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacgatgatggcctacaaggctgctcaggacattgcgctggctgagctggcacctacccatccgataaggcttgggcttgctcttaacttctcagtgttctattatgagattctgaactccccagacaaagcttgcaaccttgcaaagcaggcgtttgatgaagctatctcccagttagacacccttggggaggagtcatacaaagatagcactctgatcatgcagctcctgagggacaacttgaccctttggacctctgacctcacggaggatggtgctgatgagggcaaagaagccccgaaaggtgaggctggtgacggacagtaagggacagtaatcttgggagagcgcatattgttcgagcccattgttttagatgctctatgctgtcgaagctgaagctgtgccgtgctattattgtagctgatttcctgttccctcactttttttttatattagtaggctggtagtgttcgaattagttccccattgctttgtgttgccgctagctgtcactaagtccgtgtggactggtattattcactggatttgagaagcatgtcagtggttgctctagcgttttattgagttttgaagtcatctccctcattttcgtttcaatcatttagcagattgtgcatatggttgtgtaaaacacagttttgcacaattgcacaatttacatagtgtgatttgaaataagagtgagatattgctttgggcaaaaaaaaaaaaaaaaaaaaaaaaaaaaaa

SEQ ID NO: 2975 - DNA, 1195 bp, Zea mays
  Clone ID: PAT_MRT4577_97190C.1
ggccggccgggaaaaaaaaaaaaaaaaaaaaaaaaaaaaaaaaggcccaccgctagcatccgcagttcccccgcgcccgagacgcaaccccgcgccaggagtaagtttgttcttttatcgatattatcgatatggcgagggaggagaatgtctacatggccaagctggctgagcaggccgaaaggtatgaagagatggttgagtatatggagaaggtggctaagactgtagatgtggaagagctcactgttgaggagcgtaacctcttgtcggtcgcatacaagaatgtgattggggctcgccgtgcttcatggcgcattgtctcttctattgaacagaaggaggagtcccgtaagaacgaagagcatgtgaaccttatcaaggaataccgtgcgaagatcgaggctgaactgagcaatatctgtgatggcatcctgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacgatgatggcctacaaggctgctcaggacattgcgctggctgagctggcacctacccatccgataaggcttgggcttgctcttaacttctcagtgttctattatgagattctgaactccccagacaaagcttgcaaccttgcaaagcaggcgtttgatgaagctatctcccagttagacacccttggggaggagtcatacaaagatagcactctgatcatgcagctccttagggacaacttgaccctttggacctctgacctcacggaggatggtgctgatgagggcaaagaagccccgaaaggtgaggctggtgacgtacagaaaggcacagtaatcttgggagagcgcatattgttcgagcccattgttttagatgctctatgctgtcgaagctgaagctgtgccgtgctattattgtagctgatttcctgttccctcacttctttttttatattagtaggctggtagtgttcgaattagttccccattgctttgtgttgccgctagttggcattaagtccgtgtggactggtattattcactggatttgagaagcatgtcagtggttgctctagcgttttattgagttttgaagtcatctccctcatttcggtttc

SEQ ID NO: 2976 - DNA, 269 bp, Zea mays
  Clone ID: PAT_MRT4577_97200C.1
gttgacttctcctccccctccggttcgggttcgggttcacgaggttctcctaatttgggctgggtgcataagcggatcgagatggccacttaccatgtttagtaccgctgcttcatccgcggcctctcctgggccacggacgaccactccctccacaacgccttcaacacctacggcgaggtcctcgagtccaatatcatccttgatcaggagacccatacttccctcgacttcagcttcgacaccttctacactgaggactcgatgcg

SEQ ID NO: 2977 - DNA, 328 bp, Zea mays
  Clone ID: PAT_MRT4577_97404C.1
aaaccaccaagatttcctgttccattaaaattagtttaggcaaacgacattaccacgagggcagaccaccccttgtcagaatttagagggggggaagaaaaaaaccgttcttttttggttttggggctcccaccacaaaaacacctgagtgggttttgggcaaacaccaccatacattttttgggaccggacaaacattgtaacaaaagggagaagggagctagtattgctccacaagaaaacatccccatccttttccttttttagtagggctccactggggccctgaactttgctccggggtaaaccgcgggataaccgagctttt

SEQ ID NO: 2978 - DNA, 1556 bp, Zea mays
  Clone ID: PAT_MRT4577_97516C.1
cggccgcgtggggcgaaaaaaaaaaaaaacgaagcgaaagcgaggctgctgtctcacggctgcggctgcggctgcggcggttcgggctcctcctccagactccagggatggccgccggtgcgggaggcggcgaactggaggcgctggagggcgtgcgctccatcgtgctcaagccgtcggagtcgctcgacgagtcgcggttcacgaggatcgccggcgccgacttcaacgacccggccgtcggactcgaggggctgctcgcctcgctcgcgtccaccgggttccaggcatccaacctcggcgacgccatcgacgtcgtcaaccagatgttagactggaggttgtcgcatgagaagcccagcgaggattgtgatgaagctgaacttgaccctaaatatagagcatctgtgaagtgcaagatatttctgggcttcacctcgaacctcgtgtcttctggcatccgggatataatccgttttctagctcagcatcacatggtggatgttattgttacaagtgctgggggtatagaggaggatctcattaaatgccttgcaccaacttacagaggcgatttttctttacctggagcactgctgcggtcaaaaggactgaaccggataggaaatctgttggtgcccaatgacaactattgcaagtttgagaactggatcatgccactcttcgaccagatgctacaggagcaatctactgagaatgtttggacaccgtcgaaggtgatagcgcgccttggcaaagaaataaatgatgaaagctcctatctttattgggcatacaagaataacatccctgtatactgcccagcattgactgatggatcacttggagacatgctgttctgtcatgcagttcgtaatcctggccttattattgacattgtacaagatatacggctgatgaatggggaagccatccatgcaacaccaaggaagacagggattatagttcttggtggaggccttccaaagcatcatatatgcaatgccaatatgttccgcaatggtgcagattatgctgtctatattaacacggctcaagagtttgatggtagcgattctggagcacaccccgatgaagcagtctcatggggcaagatcaagggttcagcaaaacctgtaaaggtgcattgcgatgcaagtatcgctttcccgcttcttgttgcagcaacatttgcacgtaaggttcataactccaaatgaacagactgaatgggattcagtggagtgaatgggcaacagaattttgttgaactctccaaatgacctttttggagcacgaggtctacttcacctgcacagggatcatgtgcaagttttttcggtgactcgcggcaaccacatgccatcattatttcgatgttcacttgatgctgtactagctggttgatagcatttttgttacaactgataatttattgaaatacagacatacgattgttcatccgagtcgtctgcttacgaattttttgtagaccgaaacatctgcttacgaaattgacaaatggcctgttttatgaacacattttttttcacctg

SEQ ID NO: 2979 - DNA, 362 bp, Zea mays
  Clone ID: PAT_MRT4577_97632C.1
ataataaagtcctgacggggtgtaacagcacccaacgatccgcattccaagctggttgatgcatgggtctgctggagccgaggctgaacacagccactaacaacctgagcacaggagtcgacgcttcaatgcaaaaacacaggggggcaacaacaaacacgagaccgaacgaagaaaacactctggactagggtaaacaacacggccccgaacaggataactaggccgcgcgggccccaccgcccagttccggcaaaaaccgcaggagctggcgtagccgccggcacggttgccaccgtcgtagccggcgccaccaacaccgtatccgtcgccggcagcaccggagccggcgccaccggcgt

SEQ ID NO: 2980 - DNA, 315 bp, Zea mays
  Clone ID: PAT_MRT4577_97676C.1
cttgggttttttttttagaaatggactttattatttctgggaagccacaaacatcagacaaaaaactttattattgaactataactcataagaaatctaaaagagggcaccaccaatgatgggttgttggtaaaaccctgctgggtttgttaaaacaagttggttgaatggcagcaattggtgcagttgtaagaaggtgccaacgttaagcccaccgtgcaagtaaaacggcaataaactgtgttgtgtcaaaaaagcaacagggctcacaccaacttactggctgaatggtaaaatatgttgcctgctgtaata

SEQ ID NO: 2981 - DNA, 473 bp, Zea mays
  Clone ID: PAT_MRT4577_97760C.1
atattattcgataccactagcaacatagaaagcacaatactgtacctacagtggcagctaaaaacttcgcctccttatgctccttggcctttctgcaagtgctgctacggcgaccattttcccacaatgctcacaagctcctatagcttcccttattcccccgtacctctcaccaacggtgctcttcggtatgtagaaaacccaattcttcaaccctacaggatccaacaggcaatcccagctggcatcttacctttatcacccttgtgactccaacaagtcatcagcgcctattacagcaggtacctttggtgcctttattggcacaaaacattaatgcacaacaactacaacaacctgtgctagaaaccttggtggctactcttagcaacaagaagttttttcatataaccaactaactggattcaactccgcttcttatttggaagaacaacaactaccattcagccagc

SEQ ID NO: 2982 - DNA, 1875 bp, Zea mays
  Clone ID: PAT_MRT4577_97786C.1
ccccttctttcttttttgttgcgatcgttatcgcggtaggtttattatttccatgtctttgacttgctctctccgtattattaggagtaactgcaatgctcaagctcaacaccagggacaccgtgtcaattgtgggacacgattgctggtaaatacattctctacagttgttacgcggtactgcactacactctgcgtcgcggccgggcgggtagcagcgaaattcatccaaaagaaactcctgataaatataaaaaggagggaaaaagaaaaacacttgcagcggcatccaccaccggagctcccatcatcggtctatccctccgtgtcaaccccctcctcagaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgatcacctcggcggcggcccgctgttgctgcgcggtcctagcacccgttcgagtgtgtgtgtttgtgttctttgagtttcaagattgggttttgttgcgttcttggggagacgaagggactaaggcgcagtgagcggacaagaatcagcatggatccgagcgcggtcagtttcgactctggcggcgcgcggcggggcggcggcgcgcagatgctgctcttcggcggcggaggcagcgccaacagcaacggcttcttccgaggtgttccgatggcggtcctgggcatggacgacgcgacgcgcgtgggcaagcggcccttcttcacgacacacgaggagctcctagaggaggagtactacgacgagcaggcgccggagaagaagcgccgactgacggcggagcaggtgcagctgctggagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgcctcaaggctgcttacgacgcactcgccgccgaccaccagggcctcctggccgacaacgataacctccgggcacaggtgatctccctgacggagaagctgcaaggcaaggagacatccccgtcggcaaccactgctgcccaagaggtcgaccagccagacgaacacaccgctgtgtcaggcacggaagaactgctggcgcagcagctcaaggacaacctccacagcagcggcgactgcactggccatggcaccctctcttcggaagaagacgacggtggcgtggtcagtgacgagggctgcagcttcgctctcccggatgccatgttcgctgccgggttcacccaccatggcgccgaggaggtgcagctggccaactggacatccatgttctggaactgatcagcggatggatgcatccaagtgcaaagatcggatcctctcctcgtctcgacccttttctgcagcatataattaccgtgttaattatgtgccgtccgatgtttttaagtgctcatgttttaagtttgtgtttttttgaagattttgtatgttcatatatataataatgtgcttcgaacatgacactcgaaaagttgaataattggacatgtcgacctgctgtgcactagcagctggcatgttttgtttaaaaaaaaaaaaaaaaaaaaaaaagggctggtttgggaagttcatttttcaaagaattcatatttttcaaagggaaatgaactaattttacttaggg

SEQ ID NO: 2983 - DNA, 1970 bp, Zea mays
  Clone ID: PAT_MRT4577_97787C.1
ggattgccgggtggtgtaaggggaagaaactaaagcacgaggagttttttttttttttttttccatgtctttgacttgctctctccgtattattaggagtaactgcaatgctcaagctcaacatcagggacaccgtgtcaattgtgggacacgattgttggtaaatacactctctacagttattacgcggtactgcactacactctgggtatccactcgtgcccctgtatgaagctggcgacgctgtacgcgtcgacgtggaccttgggaacctggctgctccacgccaccctctggcccgcggcccggccggggccggtagccacaaatttcacccaaaaccaaaaaaaatcccaaattaaagaaaacgaggagaagaaaaacaactttcatcgccgtccgccaccggagctcccttcgtcggccttccttcagtgtcaacccccttctcaaaacttgtatttgcacctcagtccctgccggtctgcccggtcgccgcctcgccggaggaagcccctcgtctccttgccctgcggcgggttcatggggttctcgctgtaccccatgaagacgtccacgcggatgctctggagcactagcttcttccgccataagctcagctcctcctcctgcttcctctgaggacgccccacccgcctcgatcgcttcggcggcgggccgctgctgctgcgctgtcctagcatccgttcaagtgtgggtttgcgttcttgggtttcaagattggcttttgttgcgttcttggcgagacgaagggactagggcgcggacaaagaatcagcatgcatccgagcgcggtcagtttcgactccggcgacgggcgggcggcgcggtggcgcgcagatgctgctcttcggcggcggaggcagcgccaacagcaacggcttcttccgaggtgttccgatggcagtcctggccatggacgacgcgacgcgcgtgggcaagcggcccttcttcacgacacacgacgagctcctggaggaggagtactacgacgagcaggcgccggagaagaagcgccgtctgacggcggagcaggtgcagctgctggagcggagcttcgaggaagagaacaagctggagcctgagcgcaagaccgagctggctcgccgcctggggatggcgccccgccaggtggccgtgtggttccagaaccgccgcgcgcgttggaagacaaagcagctcgagaccgactatgaccgcctcaaggctgcctacaacgcgctcgccgctgaccaccagggcctcctggccgacaacgatagcctccgggcacaggtgatctgcctaacagagaagctgcaaggcaaggagacatccctgtcggcaaccatcgctgcccaagaggtcgaccagccaaacgaacacaccacaggcactgagaaattgctggcgcagcagctcaaggacgacctgcacagcagctgcggttgcactggacatggtgccctgtcttcggaggaagaggatggtggcgtggtcagcgatgagggctgcaactttgatctccccgacgccatgtttgctgttggggtcaccaaccatggtgctgaggaggcgcagctggccaactggacatcttggttctggaactgatcggttgatggatggatgcatcaagtgcaaagagcaaatcctctcctggtttcgactcttttctgcaacatataattactgtgttgattatgtgccgtcagatgttttcaagtaatgaaacagaactgatgttgtaagtttatgtttctgaagatttgtatgttcatatatataataatatgctttgaacatgagactccaaaagttgaaataagtggatgtggagacctgttgtgcactagcagccagcatgcgtttttatgctgctttagacatgaaaatgtatatccaacacaggcctgtgaataagatgatgaaagtatatccaatcgctgcacttcatttggttgtgtgcc

SEQ ID NO: 2984 - DNA, 380 bp, Zea mays
  Clone ID: PAT_MRT4577_97851C.1
cggctcgagggtgggttggcttctcctcccgctagggttctagttcgggggtggtgaggatctcccgcgttcgggttcatgggtgagcagatcgagatggcggcgtctgatgttgagtaccgctgcttcatccgcgggctctcctgggccacagacgaccactccctccacaacgccttcagcacctacggcgaggtcctcgcagtccaagatcatcctcgatcgggagacgcagaggtcccgcggctttagctttcgcaccttgttcacggaggaagcgatgcccaacgccatcgagggcatgaacggcaaggagctggacggtcgcaacatcacctgtaacaaagcccaatcccgcggctgccgtagaagctgcggcg

SEQ ID NO: 2985 - DNA, 537 bp, Zea mays
  Clone ID: PAT_MRT4577_9787C.1
ctcggcccccccccccccccccccccccccccccccccccccccccccccccccccccccccccccaaaaaaaaaggaatttaattcccatggcaacaaaaaacctaccctggggacaacacaaaaccaaaacccagggccccagaacaacataaccttttttaactcaactaaaaaatgaacccagtacaacataacctttttaactcaactaaaaaataaccccatttgcaaagaaaaaggctctttttttggaaaggccaaaaaaacagttttaaacccctacttttttggaaatgcaggggggttggtttatcccatcctggaaccaaggcgctcgtttttaaactaactcattcagaaaatagtctaccttggcaatgttgacactgggcatcaccacaacgggagcaatattcctttaaaaagccagttgccaccttggaaaaaatttttaatcctttggcctttaaacacaaccgggctactgagctcgttaagcatcgttccaattcctgcttccttgaggcaattttt

SEQ ID NO: 2986 - DNA, 161 bp, Zea mays
  Clone ID: PAT_MRT4577_97913C.1
ctatagtgagtcgtattaaacagagcggcgtggggctcaggagggtccgccgtgagtacaaggcaaaaaagatgtcggaggaggactacgtcagtgccatcatggaggcggtcaacagggtcgtgaagctccaacaagagcgtgggattgaagtgcttgtc

SEQ ID NO: 2987 - DNA, 751 bp, Zea mays
  Clone ID: PAT_MRT4577_97919C.1
tggttcgccgcccgatccagcgatggattcagcctccagagttgccccgccgccggtcagcgctggtgtccgcgtccgcgcgccgctggtagagtccgtctcctgttactgcagattagatacaggccttaaaactgtcgtggatgctagaaaattgcttctggagcaaagatgtgcatgcaacctgatgtcaaacaaaccaagcgcaagtcaaggggctcgcggaaggagaggtgccgagctcaagcaccacttttgcctggccttcctgatgatcttgcaattgcctgtcttatacgggttccacgagtggaacaccccaatctccggacagtttgtaaaagatggaaccgccttttgtcaggaaattactattattccttgcgcaagaaactcagcatggcagaagaatgggtttatgtctttaaaagggatcgtgaggggaaaatatcctggcatgccttcgatccactgaaccagctctggaagtcccttccacctgttccaccagagtattcagaagcgttgggttttggctgtgctgttctgagtggttgctatctgtacttatttggcggtaaggatcctttgaggggctctatgagacgtgttgtattttacaatgcccggaccaacaaatggcatcgagctccagatatgttacgaaagcgacacttttttggttcctgtgttataaaaaaatggctatatgttgctggaggagagtgtggaagcatacaaaggactcctt

SEQ ID NO: 2988 - DNA, 219 bp, Zea mays
  Clone ID: PAT_MRT4577_97947C.1
cgtgcgctggctctgcatatcccgcgcccgactcccggtgctgcgtgcggaaggccgactagtcgcgccgtgctgtgcttggcttgattgaacccgccgggatgggggtgttggaagacctcctcgcgatagcgggttttttgcgcggacatagacagctgcttctccacacaactagaggcgctcggggccgacatcaacgacccgatctggagcgcc

SEQ ID NO: 2989 - DNA, 419 bp, Zea mays
  Clone ID: PAT_MRT4577_97997C.1
gtagtatgtccaacactctatagtgagtcgtattatgctaacgcgcatgcctggcatctcgtcgcggcaacaatcactcttctcctgtcccagctagccgggcgtttgttcgcattcactcttccactaccgcttaccgccaatctgctccacagtagccatccgcctctctccattcatcgacccacacttccaacccgccatggaggaccacgaattcgtcaattatctactggaggtggaacaccctatcagcggtcggaaaggtgtcccccacgttcttatttcaggggcgggcttgggaggcctcttcctggccatcctcctagaggaggccgggatctcctacactatcttcgagcggtccagggacatcaggcccataggggctataatggcgttgtcggccaacatcttac

SEQ ID NO: 2990 - DNA, 372 bp, Zea mays
  Clone ID: PAT_MRT4577_98095C.1
gggggggccacacataacaccggtgttacttattattgaacacaattatacacgcatgcagagaaaacgaagcgagtacaggaacacgccttttttgacgtagccggccccacgcccaccaccttttatccctcagtctcactcaccacaagcaacagcagctaccaaggtccggagagggactcattattgggaaccatcaaattacacacgcatgcagtacagaattaaacaggtgtgtggtttgtgtgcgccggagctagctctagctcggtcgcgcgccggccggtactacggtcagccgaagaggtggtggtgcttcttctcgccgctggcctccttggcgtacttggggtccttcttcttctcggg

SEQ ID NO: 2991 - DNA, 691 bp, Zea mays
  UNSURE (1)..(691): unsure at all n locations
  Clone ID: PAT_MRT4577_98097C.1
  unsure (1)..(691): unsure at all n locations
cagccaactggtagccaagtggagtgtagtatagcaaccagctgaccagagcagcatcagcagccatgtcggaggagaagcaccaccacttcttccaccaccacaagaaggacggcgaggagcagcccaccggcgagtacgggtactccgagacggtggccgccgaggtggtgaccaccggcgaggacgagtacgagaagtacaagaaggaggagaaggagcacaagcacaagcagcacctcggcgaggccggcgccatcgccgccggcgccttcgcactttacgagaagcacgaggcgaagaaggaccccgagcacgcgcacaggcacaagatcacggaggaggtcgcggcggcggcggcggtgggcgccggcggctacgccttccacgagcaccacgagaagaagaaggaccacaaggacgccgacgaggccagcggcgagaagaagcaccaccacctcttcggctgaccgtaccgtaccgtaccgtaccggccggcgatgatggagctccggcctccggcgcaccacgtaccacctgttgaattctgtactgcatgcgtgttaatttgacggttcacagtaaataagtcccttttccggaccttgctaataagctgtgttgcttgtgtttgtgtgagtgagactgagaagaggtggtggggtggggccggtcctgtgcgtngnggtgt

SEQ ID NO: 2992 - DNA, 950 bp, Zea mays
  Clone ID: PAT_MRT4577_98100C.1
cattgggtacctcgaggccgggccggcatcctactgtcacacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggctagcggcgagaagaagcaccaccacctcttcggctgaccgtagtaccggccggcgcgcgaccgagctagctagctccggcgcacacaaccacacacctgtttaattctgtactgcatgcgtgtgtaatttgatggttcacaataatgagtccctctccggaccttggtagctgcttgcttgcttgtgagtgagagtgtgagactgagggagaagaggtggtgggcgtggggccggctacgtcgagagaggcgtgttcctgtactcgcttcgttttctctgcatgcgtgtataattgtgttcaataataagtgagagcggtgtgatgtgtggctccccttgtcaggctcatgtgtatccgtattgaatcctggcaccatgcatgactgaggatctggatgtctatgaagcaccgtgtatctatcatcacttttgtaaaaaaaaaaaaaaaaaaggccccta

SEQ ID NO: 2993 - DNA, 500 bp, Zea mays
  Clone ID: PAT_MRT4577_98174C.1
atgcaacatgccaaccggctttataattattacaaaaggggcaaacacctccaatcacacgtgaagggggggccgggggggagaaaaaaatcttattaaaagggagggggaaaatgaccaaattaaaaaataaggggacactttggcacggccactcattatatatccaacgacccgcgccggccggggggtttactcgctgcccggaccggagggagctttcgggaccccggggaaaaagaccctggggccgaacaattccttgccgaccttgggggggaatgggtcgtagcggaggaagagctccacgaggaggaccctgcccacgagcaccaaaaagttcttcccggggcactgtttgttggcaaccctggggttttcggtctcgggggcggtggaccaatacacgtactggagaagtttgctgccctcctcgccgaggaagcgggcgggcacaaaatccccgggggggtcgccgaacacccgggggtccttggggg

SEQ ID NO: 2994 - DNA, 683 bp, Zea mays
  UNSURE (1)..(683): unsure at all n locations
  Clone ID: PAT_MRT4577_98231C.1
  unsure (1)..(683): unsure at all n locations
tttttttnnnnnnnnnnnnnngaggggctggatcacgtttctagcccaacggcatgcgcgtcatcccaactggaacttgcgtgcgttgatctacatctcaggactttcatctggggttattggaagaaggaaacacacgtaaagagatacggatccgaggcaagaattcatcatcccaccaagtgtggcgattttttatggaggggaataataaccacaacaaactaaaacatgataaagagatgagcaaaaatccgacagacgcaatgagagcagccagtctgagcgagagaggacggaaggggttcaagcgccgaagccgtagagagtgcgaccttggcgtttgagggcgtaaaccacatccaaggaggtgacggtcttgcgcttggcgtgctcggtataagtgaccgagtctcgaataacgttttcgaggaagatcttaagaactccacgagtttcttcgtagatcaagccagagatacgcttgacgcctcctcgacgagcaagacgacggatggcaggcttggtgataccctggatgttgtctcgcaagatcttacgatgacgtttggcaccccctttaccaagacctttccctccgcttttccctcttccagacatggtggcgagatgttagggctgtgttaatagttgtttggtgaagctgtgtggctcgtgccgaa

SEQ ID NO: 2995 - DNA, 244 bp, Zea mays
  Clone ID: PAT_MRT4577_98283C.1
tctggtttctttgaggtcactcatgatgtctgtcaccttacatgtgctgattggctccgtgctcctggggtccagacacctgttattgtccgtttctctacagttgtgcatgagcgtggaagcccttggaccttgagggatccacgtggttttgctgtcaagttctacaccagagtgtggtactttgaccttcgtggtaacaacatgccctgggtttttcattactttatgggattaaatttcc

SEQ ID NO: 2996 - DNA, 1806 bp, Zea mays
  Clone ID: PAT_MRT4577_98362C.1
ttgtaccccgatgcttgaaacacccgccgcgggccgcgtcggcgtcggcatccgtcgccacaaaactctcctcgcaagcgtcgccgccccgcacagatcaaccgctcgaaatttgggggaagcaagcgagagcagcagtaagcctcatcgggaagtggagagatggaggcggcgggtcgcctcctcctcctcatcgtctcctccctcctcctgctcttctcgccggagcggccggcggaggccgcgccgccgcgaatccagccgctcgccaccgccgcgctgagccgcctctacgacacctccaactacggcaggctgcagctcaacaacggcctcgcgctcactccgcagatggggtggaacagctggaatttcttcgcctgcaacatcaacgagacggtcatccgcgagacagctgatgcgctggtgtccacgggactggctgcgctgggctacaacttcgtaaatatcgatgattgctggtcatacgtgaaacgaggaaagcaggatcaattgctgcctgatccaaagactttcccttcaggcgtcaaagcacttgcagattatgtgcatggaaaaggtctgaaacttggtatatactctgatgctgggaaatttacttgccaagttcgacctggatcactcggtcatgaaaatgacgatgctgcgatctttgcttcatggggtattgattacctgaagtatgataactgctacaatttgggaataaagcctcagaaaagatatcctcctatgcgagatgctcttaattcaactgggcgccaaatattctactctttgtgtgaatggggccagtatgatccagccttatgggctggcaaagtgggcaatagttggcgtacaactgacgacataacggatacatggaaaagcatgacagacattgctgacaagaacaacaagtgggcatcatatgctggacctggtggttggaatgacccagatatgctggaagtaggcaatggtggcatgaccttagcagagtatcgctcacattttagcatatgggctctcatgaaggcccctctattaattggctgtgatgtcagaaacatgacttctgaaacaatggaaatactgagcaacaaagaagtaattcaagtaaaccaagatcctcttggagttcaaggaagaaaaattttaggacaaggaaaatatggatgccgtgaggtgtgggctggtcccttgtctgggaatcggcttgttgttgctctgtggaaccgttgttcagatactgctaacgttacaatgaaactgccagcagtaggccttgatgggtatgctgcctattctgttagggatctgtggaagcatgaaactctatcggaaaatgtcgtaggaacttttggcgctcaagttgacgtgcatgacaccaagatgtacatcttttctcctgcaaccattgtcgcttcggtttgatcaggaccggtggatccaagatgacagcaccgctattattcaaggatatgtcacgacaacaagggccttcgtttttcctgctgcattctgttccacccgagtgcagaagtccacttcgtgcagaactgtctcagtgatgtttgtatttctcacggaatagctctatttatctcaagattgagcaagctcgaggcttactcggtgtaccggcgttgtatccttggggcatccaagatcttgtacgatttgaaacagtctgaaccaatgatgtaaaacaagatagtgaaaatacaacttcacaaattgcagccgtacaagcagcacttgtacaaggactccgtaccgaggaaaaaacttacgacgcgt

SEQ ID NO: 2997 - DNA, 2108 bp, Zea mays
  Clone ID: PAT_MRT4577_98428C.1
tgggtacctcgaggccggccgggacgcccactccgaaatttcccccacggagctcaactgccggtgccggcgcgcgacaggcggcacacacgcccctcggctcctcgcgtatggcgaccacgttgacgcccacgcagcgctatgcggcggggacgctcctggcgctggcgctccgccaggcgcagatccaccagtccgagcccctcggctccggccccgacgacgaggagcgcgccagcagcgccagcgggagctcctcctccaccatatccagcagcggctccgacactacctcgggcgccggactctggacgcacgattcccgcggcctcctccgccccgccttcaggttcctggagatcgagcccaaggtatgggcggtgatggaggacacggccgtgcgccggctcactcccccgacgctcgcgtcgcgcgaagacgaccaacgtgccgaaacaatcaaccagcaacactcttctcgtataacataatacagcgaaggtaactcacatggcaacttccatgggttgtctcgtcttgctctgccttgtttcttctctccttcccagtgccgtccttggccacccatggggtggcttgttcccacagttctatgaccattcgtgccccaaggcgaaggagattgtgcagtccattgtggcacaggctgtgcgccccgggccggccgggatccacaagaggagaagaaacaatcaaccagcaacactcttctcttataacatagtacagcgaaggtaactcacatggcaacttccatgggttgtctcgtcttgctctgccttgtttcttctctccttcccagtgccgtccttggccacccatggggtggcttgttcccacagttctatgaccattcgtgccccaaggcgaaggagattgtgcagtccattgtggcacaggctgtggccaaggagaccaggatggcggcatctttagtcagactgcatttccatgactgctttgtcaagggctgcgatgcttcggtgctgttggacaacagcagcagcatagttagtgagaaagggtccaacccgaacaggaactccctcagggggtttgaggtgatcgaccagattaaggctgctcttgaggctgcctgcccaggcacagtctcctgtgccgacattgttgcccttgcggctcgtgattccaccgccctggttggtggaccatactgggacgtgccacttggccggagagactcgctcggtgcaagcatccagggctccaacaatgacatcccagcccccaacaacacactccccactatcatcaccaagttcaagcgccagggcctcaatgttgttgatgttgtcgccctctcaggtggtcacaccattggtatgtctcggtgcactagtttccggcagaggctatacaaccagacaggcaatggcatggctgacagcacactggatgtatcctacgccgcaaagctgaggcagggatgcccccgctctggtggtgacaacaacctcttccccttggacttcatcacccctgccaagtttgacaatttttactacaagaacctcctggccggcaagggccttctaagctctgatgagattctgttaaccaagagcgctgagacagcggccctcgtgaaggcatatgctgctgatgtcaatctcttcttccagcactttgcacagtctatggtgaatatgggaaacatctcgccactgacagggtcacaaggtgagatcaggaagaactgcaggaggctcaacaatgaccactgagggcactgaagtcgcttgatgtgctgaattgtttgtgatgttggtggcgtattttgtttaaataagtaagcatggctgtgattttatcatatgatcgatctttggggttttatttaacacattgtaaaatgtgtatctattaataactcaatgtataagatgtgttcattcttcggttgccaaaaaaaaaaaaaaaaaaacggccaaaaaataaaaaaaaacgaaaaatagcggctgatgggaaatatcttgtggcttttagccgaaaccatcaagatttgattgtataccgtccaatctggttcacatattcatgcaatgaagaatgtgaaactcatgagc

SEQ ID NO: 2998 - DNA, 2149 bp, Zea mays
  Clone ID: PAT_MRT4577_98430C.1
cattgggtacctcgaggccggccgggaatccaagaggagaagaaacaatcaaccagcaacactcttctcttataacatagtacagcgaaggtaactcacatggcaacttccatgggttgtctcgtcttgctctgccttgtttcttctctccttcccagtgccgtccttggccacccatggggtggcttgttcccacagttctatgaccattcgtgccccaaggcgaaggagattgtgcagtccattgtggcacaggctgtggccaaggagaccaggatggcggcatctttagtcagactgcatttccatgactgctttgtcaaggttcaattctgcttcctctgttatgttctttatattacatgctctgacaaagctataaagcttgatactgcagtataatataacaagttagctacacaagttttgtacttcaagtcttttaactatatgttggtgcaataagattatgagtaatccatatgaaggtgttgcaagagaacatgaaaggcaaagataaacggatgaacccattactagctttggctgtatcagaccaataacttgaaatgcacttgtgctagcatgcctaagtattagaaaaggtagcatgggagaatctatattattttggctaacttctttagttactattgattgatgagaaagcctaccattgcccatgccagccctaatgtcccggtgacatgattgagccagtactatgattaatttactctattgttctccttttttgagtgctgtataagatgtcctttttttgagccactcgagaagatgtttacttaactctagtgcgcaatgattggagctctcagtgcaacgcatgtgctctgtaatctactgtcaccactactctgtagtgtgtgcttaaactctaaactattccacgtggctagtaattaccaatcatttacaacactgttacatgtgtagggctgcgatgcttcggtgctgttggacaacagcagcagcatagttagtgagaaagggtccaacccgaacaggaactccctcagggggtttgaggtgatcgaccagattaaggctgctcttgaggctgcctgcccaggcacagtctcctgtgccgacattgttgcccttgcggctcgtgattccaccgccctggtatgttccactatcgacaatcctttccaacctcaaggaacagacatgatatttgtgtgtgtgtgtgtgtgtatatatatatatagtgatagctttggcaaacttagatattttctgagctctaaaccgtaggttggtggaccatactgggacgtgccacttggccggagagactcgctcggtgcaagcatccagggctccaacaatgacatcccagcccccaacaacacactccccactatcatcaccaagttcaagcgccagggcctcaatgggggtgatgttgccgccctctcaggggatttttcttgtatttattaggaacatctggccttcgttattcaccaacttagcgcacactcatattacgcatggatacaatatcatgtgtgaataccggtggccacaccattggtatgtctcggtgcactagtttccggcagaggctatacaaccagacagcaatggcatggctgacagcacactggatgtatcctacgccgcgaagctgaggcagggctgcccccgctctggcgccgacagcaccctcttccccctggacgtcgtcgccccagccaagttcgacaacttctactacaagaacctcctggccggcaggggccttctcagctccgacgaggttctgttgaccaagagcgcccagacggcgtccctcgtcaaggcgtatgccgccgacgccggtctcttcttccgccactttgcgcagtccatggtcagtatgggcaacatctcgccgctcactgggtcacaaggtgagatcaggaagaactgcaggaggctcaacagcggccactgaggtcggtcgctttatgtgcgtggtgctgctggtggcgtgttttgtttgaataagaaagcatggctgtggttttatcagatgctctggttttttttttgtgtgtgtgtgtgtgttttatttaaacacattgtaaaatgtgtgtctattaattaataactcagtatatgagatgagttcattcgt

SEQ ID NO: 2999 - DNA, 3878 bp, Zea mays
  Clone ID: PAT_MRT4577_98473C.1
aaacctgctcgctgtgtcttctgtcttctccacttcgccctgcgtacgctccccagtctcactctctctccccctctacctcgttcgtggcgacgacagggcgaccgccgctgccaccgccgcctctccactgtgggcctggtgctttgcccggccgttcgccggcgacgggcactcaccaccaggtgacaaaggaaaaggaagaggggcagcaaatcggtgcgctgctgttcatcaaatgctggggaggaaatcaacagatcaggggcctggtgaaatgctgcgcagcgagggtgactgactggcaactccgcccgccgacgcccgtttcgtgcttactggcatgctcgcagcataaaggaatcttctcggaattagccccccttcctgtggtcgtgacggccccaagtttcaagacatggaccatgtgccggctctagttcttgccgggtgctgcttcctggccctgctgcctggctgggcctgtggccttggctccatgtcgtccattgcggtgtcctatggggaggatggtccggtgttctgtggcctcaactccgacggctcccacctcgtcgcctgcttcggtgctgatgcatctgtcctgtacggcgcaccacccaacatccctttccttggcctcacggcaggggatgggttcgtgtgtggcctcctgctcgacaccaggcagccatactgctggggtagcaactcctatgtcaagagcggggtgccacagccgatggttgagggcgcaaggtactctgagctcagtgcgggggacaaccacctctgcgcactgagagctgctcaagatgggggtcgtggttccagtgctgctacatcgctgattgactgctggggatacaatatgaccgccacacatgctgttgatgaagccgtgtcgactgtttcagctggttcggtgttcaattgtggcttgtttgctcggaacaggacggtgttctgctggggcgacgagacggtgagtggtgtcgttgggctggcaccgagggatctgcactttcagtctataggcgcgggcggttaccatgtctgtggggtgttggagaatgcacaggtgttctgctggggcaggagcttggagatgcagcaggtggtgccatccagtgctatcggtgatggtgatgtgaacatagtgccgatggatgcaatgagcactgtggttggcgggcggttccatgcttgtggcatcaggagccttgaccaccaagtggcttgctggggcttcactcttcataacagtacatcgccaccaaaagggctgaagatgtatgctcttgtggctggggattacttcacttgtggagtgcctgctgagacttcgctgatgccgaggtgctggggcaacagtgggccattggcattacccatggccgtacctcctgggatttgtgtacctactgcatgcagccatgggtactatgaatatgtgaaccatggtgaagttggcagcatcaaggtgtgtaagcctgcaaactctagactctgcttgccctgtagtacaggttgcccggaaggcttgtatgagtcatctccttgcaatgcaacagctgaccgtgtttgccagtttgattgcttgaagtgtgtcacagatgagtgcctgtcattctgcttatcacagaagcggaccaagagccgcaagttgatggcttttcagatgcgcatctttgttgcagagattgtctttgctgtcgtcttggtactcagcgtgtcagtaaccacttgcctgtatgtccggcacaagcttcgacattgccaatgctcaaatagagagctgagactggctaagagcacagcatactctttccggaaggataacatgaagatccagcctgatatggaggacttgaagatcaggagagctcaggaattctcctatgaagagttagagcaagcaaccggtggcttctcagaggattcacaagtcggcaaaggcagcttctcatgtgtattcaagggcatactgagagatgggacagtggttgctgtgaagcgtgcaataaaagcatcagatgtgaagaagagctcaaaggagtttcacaacgaacttgacctcctatccaggctcaaccatgcacatttgctgaatttgcttggttactgcgaggatggcagtgagaggctcttggtttatgagttcatggctcatggatccctgtaccagcatctgcatggcaaggatccaaacttgaaaaagcgactaaactgggcaaggcgggtcaccattgctgtacaggctgctaggggaattgagtacttgcatggctatgcttgccctcctgtaattcaccgggacatcaagtcgtcaaacatattgattgatgaggatcacaatgcccgtgttgctgactttggtctgtctatattgggtcctgcagatagcggtaccccactgtctgagctgccagcagggactcttggctaccttgaccctgagtactaccgtctccactacttgactacaaaatctgatgtctacagcttcggggttgttctcctggagatactaagcggcaggaaagcgatcgacatgcagttcgaggaggggaacattgttgaatgggcagtacctctgatcaaagcaggggacatttttgccatccttgatccagtcttatctcctccctcagaccttgaggccctcaagaagattgcttccgtggcatgtaagtgtgtcagaatgcgaggtaaagatcggccttccatggataaggtgacgacagctctagagcacgcccttgcactgctgatgggcagcccctgcatcgagcagcccattctaccgaccgaggttgttctcggaagcagccgcatgcacaaggtgtcacagatgtcctctaaccactcttgctcagagaacgagcttgctgacggggaggaccaggggatcgggtacagggcaccttcctggataacttttcctagcgtgacctcatcacagaggaggaaatcatctgcatccgaagctgacatcgttggtcgaagggccacagacggcaggaacgtcgggagcagcataggtgacggactgcggtcactggaggaagaaatcgctccggcttcaccacaagagaacctgtacttgcagcacaacttctgaagaaattcaggagatgcagaaacctgagcagcgactttctgccattgttgagcagtattttaagttcggcctttcatgccctgttgaagtgttcatacgttctatataatagcagcctaaaaacagggagctaattagtactggaagaattctttttagcgtccagaagcattcatctgtagattcgtatggtcccttttattttcctggtacaatttatcttctggtggctgcagttgatggattatcgtgtatccttagcttgcaaaactgggtagtttccttaatccttcagatcatctctctggctcccgatgctgtttctgcatcctaaatggcagtagctttgggaaccaactgcatgtctgggtcgggtcaccatgttcagcattctttcgcttgtatccttgtggaaggtttcttcagttgcttgatttgtgattcgcagcaacaggctgtctgcccattcttctcttcagagacaggtgagatgtggttctcagaggtctacctcagcaatggctgctgtcatgttccatgatcctgtttagggtgctgttttgaacacaatgaaaggcaggttgttgctaaccatttaatgtttcttggacctagctaacttgccattatgtctgatgcctgatgccaatgcttcttccagaagtcatcttagtttgtaaggccgtacgcactgaatgaattttattgcttctgggacagaaaagattcaataatgtctcaggctttcatcttt

SEQ ID NO: 3000 - DNA, 384 bp, Zea mays
  Clone ID: PAT_MRT4577_98547C.1
gcgcgcttgctcatccatcaacccttagctctatcacagcagttacctttgctccagcgggttgcacaaaacattagggcgcagcaactacaacaacttgtactaacaaaccttgctgcatactcttagcaacatcaattagttccattcaaccaactggctgcattgaactctgctgcttattcgcagcaccaattaccattcatacagatagttgatgcctaccaccagcaatttcttacattcaaccaactatcagcattcaactctgctgcttatttacagcagcaacaactactaccattcagtcagctagctaatgtgaaccctgatgccttcttgacacaacaacatttgttacagttctacctgcacgctatgcct

SEQ ID NO: 3001 - DNA, 356 bp, Zea mays
  Clone ID: PAT_MRT4577_98621C.1
aggggttgaaaaaattttttccttctatgggaggggacaagaatacaaatccaggacataaacgttattgctttaatgaattagggatccattacattgggaaatacataccaaaacaaactttgaaaagcttccaaaaccaaaaaaaaggatctccttttgggggaccgcattaaggattttgcaaacacaaatgctttaactatgcatgcctactgatcgtcaaaaaagtgaaagtatagttatatgcaaagtgagagagcgacagggaaccctttcaaggaggatgtgcccgcccccctatggatgcgagtatatacaaccactggaacgggggaattaaccaagttaagcaa

SEQ ID NO: 3002 - DNA, 146 bp, Zea mays
  Clone ID: PAT_MRT4577_98685C.1
caggataataaagatgtgaggcatgtcaagacttatgaactcgcactgaaggacaaagattttatcgaagggccttggtctcagaataatgtagacaatggtgctggtttgtcgatacctgtaccagctccacttggcggtgtgat

SEQ ID NO: 3003 - DNA, 247 bp, Zea mays
  Clone ID: PAT_MRT4577_98731C.1
ctagcaacatagaaagcacaatagtgtaccaacaatggcagccaaaatattttgccttcttatgctccttggtctttctgcaagtgctgctacggcgaccattttcccacaatgctcacaagcttctatagcttcccttcatcccgcgtacctatcaccagcggcgtgtgctgtctgtgaatactcaatactctaaccctatacgatccatcacgcactcgcaactggcatcatacctctatgatcc

SEQ ID NO: 3004 - DNA, 1787 bp, Zea mays
  Clone ID: PAT_MRT4577_98913C.1
tttgccgtactcaagccatgctgctccaatacccttggcagaggtgaagtgagactgcggatgggccctctcggcccaaacgccgacacggcattggcgcgttgaccgcacgacctgccgattccttcgagcgatatagggcgcccccgtccacaccacccctcgtctccgccctagcgccactgagccactcaacgtcgagatcgagacgacccgagtccgccgcgcccgtgcaccaccgaccgtcgaactcccgaaagtaactctatttcttgatcaacatcaacatgtcgcgggaggataatgtttacatggccaagctggctgagcaagcagaacggtacgaggaaatggttgagtacatggagaaggtggctaagaccgtagatgtggaagagctcaccgttgaggagcggaacctcttatctgttgcctacaagaacgtaattggggcccgccgtgcctcatggcgcattatctcctccatcgagcataaggaggagtcccgtaagaatgaggaacatgttattcagatcaaggagtaccgtggcaagattgaggctgaattgagcaacatttgtgatggtatcctgaagttgatcgactctcaccttgtgccttcctccactgctgcagagtcgaaggtgttttacctcaagatgaagggagattatcacaggtaccttgctgagtttaagactggtgctgagaggaaggaagctgcagagagtacaatgatagcttataaggcagctcaggatattgcgttggcggaactggcatctactcatcccataagacttggacttgcacttaacttctcagttttctattacgagattctgaactctccagacaaagcttgcaaccttgccaggcaggcgtttgatgaggctatttctcagttggatacgcttggcgaggattcatacaaagatagcaccttgatcatgcagctcctgagggacaacctaaccctatggaccgctgacagcacaacggaggacggcatcgaggagggcaatgaggcctcgaagggtgatgctggtgagggtcagtagtctggtaaaacctcgattgatggttcggcatgtttttgaagtctactgtgttggaaaccatgttctaatagaaggcgtctcccgctccatgcattccaagattctgtcctccccctccctccccccatgttgtaggctggtagtggtcaaattagttggccctgggtccatttggactgatgtattgtttactgctattgaagtcattcgttctcgttttgctcttgcagtggatcgctatagccttgtgttttcaatcttttagggcctgtttgggaatgcagtttcaaaatactgtaattttgagataccatagtttataattgtacatgacataaatactacggtattgctttaccacaataaaactatagtattgctcaaaaaaaaaaaaaaaaaagcggccagcaacgtcgaaccggagcctagttgaccaaccaatcatatcctcgacgtgttgcaagttatcagctttggggaaacaatgccctgaataagtttgcttttttgagttggaagggtttcagtgtcctatattttctttgaaacttaatcttttagaaagatttattttcattattaaaaaaaaaaaaaaaaaaaaaaaaaaaaaaaaatccgaggggacgctgttgcggcaaaccacccctgtagatatctgtcacatgctgaagaaaactaccagcagccgtttagcctgaataattgttaaatgataggttaccgttg

SEQ ID NO: 3005 - DNA, 1504 bp, Zea mays
  Clone ID: PAT_MRT4577_98915C.1
ttgggtatcgcggggccggccggggactcctcgtccccgtgcacaccaccctcgtctccgcgcccgcgcccgcgccactcacatcgtgatcgagacgacccgcgtcctccgcggtccgcgcccgtgcaccatctcgcctcgcattcccgaaagtgttttttttttgttattgcagtatctgtattccttgatcaacatgtcgcgggaggagaatgtttatatggccaagctggctgagcaagcagaacggtacgaggaaatggttgaatacatggagaaggtggctaagaccacagatgtgcaagagctcactgttgaggagcgtaaccttctatctgttgccttcaagaatgtgattgcggccccccgtgcctcatggcgcattatctcctccatcgagcagaaagaggagtcccgtaagaatgaggaacatgttgcacagatcaaggaataccgtggcaagattgaggctgaattgagcaacatttgtgatggtatcctaaagctgcttgacacgcaccttgtgccttcctccactgccacagagtcgaaggtgttttacctcaagatgaagggtgattatcacaggtaccttgctgagtttaagactggtgctgagaggaaggaatctgcagagagcacaatggtagcttataaggcagctcaggatattgcattggctgaactgccacctattcatcccataaggcttggacttgcacttaacttctcagttttctattacgagattcagaactctccagacaaagcttgcaatcttgccaaggaggcgtttgatgaagctatttctcagttggacatgcttggtgaggattcctacaaagatagcaacttgattatgcagctcctgagggacaacttgaccctctggacggaggacggcattgaggagggcttagaatcctcgaagggcgatgctggtgagggtcagtagcctggtaaacttagattgatggttcgacgtgtttctcaagcacatcgtgttggacgcccagtgctgacagaaggcttttgctgctccatgcattccaagcttctgccctttcgttcgcaccctcttcatgttgttggctggtagtggtcagatttagtcccattggtttagttggccctgggtccatctgaactgatgtattgttactgctatggaagtcattcctttagttttgctctggcagtggattgctgttgggtcgtgttttcagtctttattggttccgatcggacgctgttgcggcaaaccacccctgtagatactcttcacatgctgaagaaaactaccagcagccgtttagcctgaataattgttaaatgataggttaccgttgaggctgattggtttttatttttttttaccctgtgacatcaagttcttgggtaactttttttaccgttgatgctcaaacaaattgttaagtgggagaattgtgaagtgggagtggtaatggatcatgatctaaatgattcttcacaattcattgaa

SEQ ID NO: 3006 - DNA, 536 bp, Zea mays
  Clone ID: PAT_MRT4577_99007C.1
ctacttgtttcattgattatagaaaagatcgatctttttttgcaccacaaggcctaggatggcttgcacctgctgatcaagttgttgctgctgctcaagctgcaagtgcggcaagaagcactccttacctgcaggagacgagtaccggcgtgcaagccaccgctgggctacaacctgccccggagaagaaagccgctcccgatttacacgaggacggggatgaatcccatgaggatgtacaccgcctgaagcctgaagcgtcaactgcaattgccacctctgcaattgctcttaacatcgatacacgaccatggatatgattattatgtatctagctcatgagcgccgttgaacaataactagcgaggccgagctacctgccatacatatacctcgcctggtgtgtgtagatacagagagaaacacaactctgcacatggctatcactctctccatgcttctgcctgagattttcaacttatacacctacctgtgtctacccggatgtccggtgatccaattgtatacgctggaac

SEQ ID NO: 3007 - DNA, 1720 bp, Zea mays
  Clone ID: PAT_MRT4577_99082C.1
cgtaccgcgcccggccgcggggcaggcgcagcagcagcagcgtcagcgcccgaggcgcgcacgagagaaacagaggctgacgaggtggggcccgtgcgggccttgaccaatcggagttcgacaacagcctggccacccacaaaccacactccttcgcctcgcgccggccgtcgtcgcctccctccaccgaacgatccctcctcctcctcctcctcctcctcgcatcccaccccaccccaccttctccttaaagctacctgcctacccggcggttgccgccgccgcaatcgatcgaccggaagagaaagagcagctagctagctagcagatcggagcacggcaacaaggcgatggggcgcggcaaggtacagctgaagcggatagagaacaagataaaccggcaggtgaccttctccaagcgccggaacggcctgctcaagaaggcgcacgagatctccgtcctctgcgatgccgaggtcgccgtcatcgtcttctcccccaagggcaagctctacgagtacgccaccgactcccgcatggacaaaattcttgaacgctatgagcgatattcctatgctgaaaaggctcttatttcagctgaatctgaaagtgagggaaattggtgccacgaatacaggaaactgaaggccaaaattgagaccatacaaaaatgccacaagcacctgatgggagaggatctagagtctttgaatcccaaagagctccagcaactagagcagcagctggagagctcactgaagcacatcagatcaaggaagagccaccttatggccgagtctatttctgagctacagaagaaggagaggtcactgcaggaggagaacaaggctctgcagaaggaacttgcggagaggcagaaggccgtcgcgagccggcagcagcagcagcagcagtgcagtgggaccagcagacacatgcccaggcccagacaagctcatcatcgtcctccttcatgatgaggcaggatcagcagggactgccgcctccacacaacatctgcttcccgccgttgacaatgggagatagaggtgaagagctggctgcggcggcggcggcgcagcagcagcagccactgccggggcaggcgcaaccgcagctccgcatcgcaggtctgccaccatggatgctgagccacctcaatgcataaggagagggtcgatgaacacatcgacctcctctctctctctctctcgtcatggatcatgacgtacgcgtaccatatggttgctgtgcctgcccccatcgatcgcgagcaatggcacgctcatgcaagtgatcattgctccccgttggttaaaccctagcctatgttcatggcgtcagcaactaagctaaactattgttatgtttgcaagaaagggtaaacccgctagctgtgtaatcttgtccagctatcatgtatgcttgttactgcccagttacccttgaatctagcggcgcttttggtgagagggtgcagtttactttaaacatggttcgtgacttgctgtaaatagtagtattaatcgatttgggcatctagtaactaaattaagggtgtgtttggtttggcttttgatttctaaaagacaaaagccaaactaaagagctggatccataaaatagcattttctaaaagtcagactttgtggcggtacaaaaaaaaaaaaaataataatattaataattataaaaaaaattatattaaataatatatatt

SEQ ID NO: 3008 - DNA, 735 bp, Zea mays
  UNSURE (1)..(735): unsure at all n locations
  Clone ID: PAT_MRT4577_99248C.1
  unsure (1)..(735): unsure at all n locations
atcccatcctcacagctagcatgcggacagacgaataatctcttcttcaccttactagctaacaccagctagcagctcgatcgctctgcgctgcaataatggccgctcgctcctcctcccagcatgctggacgcggcggcggtcctggcagcggcgctgctgctgctggcggcgggggccgggacggcgtacgcggcggtgagctgcgaccaggtgacatcgtacgtggcgccgggcctcgggcacgcgatgcgcagcgcggagtcgccctccgcggtgcgctgcagcgtggtgcgctcggtcaacagtcgagcgtcgtccgcggcggaccggcaggccacctgcaactgcctcaagagcatgacggaccgctncgccggctggggtcagcatggacaacgccgacaacatccccggtaagtgcggagtgtccgtcggcgtgcccatcagccacaccgccgactgcaccaagatcaactgatcgatggaaccatagagcatgtagctcgctcgttggatggcagcggacgtggccatcagccgtatgcagtcggcgtcgtagcagagatgtcctatctacgagcgactcatgcatcatactggcacatgatacataagtagatcatgcacccactagtgatcacttagcatagtgtccatccgttcaatgtcgaacgtcgtcggcgtgtaccttacgcgacatgctgcatgacgtacgctagcagatcagcacct

SEQ ID NO: 3009 - DNA, 482 bp, Zea mays
  UNSURE (1)..(482): unsure at all n locations
  Clone ID: PAT_MRT4577_99251C.1
  unsure (1)..(482): unsure at all n locations
ctcgaggccggccgggatcnctccctccagctagctagcgttcctagtcaccgacgaataatctcctcttcacctcactaacaccgagctagcagctcgctctgtcctgcaacaatggccgctcgctcctcctcccagcagctggccgcggcggcggtcctggcagcggcgctgctggtgctggcggcggcggccgccacgccgccggcggcggcgagctgcggcgaggtgacgacgtcggaggcgccgggcctcgcgtacgcgatggacagcgcggcgccgccctccgcggcgtgctgcagcggcgtgcgctcgctcaacagccgcgcgtcgccggcggcggaccgtttggtcatctgcacctgcctccagagcatgacgggccggctcggaggcggcgtcagcaatgaccaaagacggcaactaccccggcaagtgcggaggcccccttgccgcgaccataaacccaaacggccactgcc

SEQ ID NO: 3010 - DNA, 965 bp, Zea mays
  Clone ID: PAT_MRT4577_99256C.1
gcccggcggattcgccgtatcccatccatcacagctagctagcgttccctcttcttcacctcactaacaccagcagctcgatcgctctgtcctgcaataatggccgctcgctcctcctcccagcagctggtcgcggcggcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgccaacatccccggcaagtgcggcgtctccgtcggcgtgcccatcagccccaccgttgactgcaccaagatcaactgatcgatggaccgtagtggaggtagctatgcctctgcatgctcgttggatggcagcgtggccatcagcagcatgcggtcgtcgtcgtcgtcctagcagatgtcctagctacgtgtgtgtcctcagactggcactgtggcacataataaagaagtagatcatgcacccactagtcatcacttcgtctagtccctccgttcgctgtcgtcgtcgtcgtcgtcatcgtcgtcgtcgtgtacctcgtacgtgacatgccgtagcacgtacgctagcagagcagcacctcaatgtccttgggtttgctttgctggctctctgttttcgtcttgtgttgcttttaatctggcacaggtttctaaattataataatgaatactttttgttcattatatataaaaaaaaggcccctggccacatatacaaaccgccccaatattattcttacaacaaaaaaaaaaaaaaaggcccccaagggccct

SEQ ID NO: 3011 - DNA, 1117 bp, Zea mays
  Clone ID: PAT_MRT4577_99257C.1
aacattttccccccattattttcttacatgtttgtgggtttcgttctccattcgttacgatgaaatggtctgatgctaaatttgggagatggttcttgtgcacttagcgtggcttgttgcggacgggacacttttggtggtgtggaaccttaatccaactgggtcttgcaagctgtccatgtaatttctgcatatccctgtgatgaggattttagtaatctgagagtgctcacggtcacttggtgctccctcctcatcgctcacgatgggagaggttgaaggaaccaatgtctctgcactacattgctgagatgtggcattctgagggatatcacccatccatcacagctacatagcgttccttatctccgacgaataatctcttcttcacctcactaacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgttggatggcagcgtggccatcagcagcatgcagtcgtcgtcgtcgtcgtcgtagcagatgtcctagctacgtgtgcatgtcatcagactggcacatatataataaagaagtagatcatgcacccactagtgatcacttcgtctagtgtcccctgtcgtcgtcgtcgtcgtgtacctcgtacgtgacatgccgtagcacgtacgctagcagagcagcacctcaatgtccttgggtttgctttgctggctctctgttttcgtctctcgtgttgcttttaatctggcacaggtttctaaattat

SEQ ID NO: 3012 - DNA, 859 bp, Zea mays
  UNSURE (1)..(859): unsure at all n locations
  Clone ID: PAT_MRT4577_99258C.1
  unsure (1)..(859): unsure at all n locations
cgctttcgcagctagctagcgttccctcttcttcacctcactaacaccagcagctcgatcgctctgtcctgcaataatggccgctcgctcctcctcccagcagctggtcgcggcggcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggntcggcggnggcgtcagcatggccaacgccgccaacatccccggcaagtgcggcgtctccgtcggcgtgcccatcatccccaccgttgactgcaccaagatcaactgatcgatgcaccgtagtggagggagctatgcctctgcatgctcgttggatggcagcggggccatcatcagcatgcggtcgtcgtcgtcgtactagcagatgtcctagctacgtgtgtgtcctcagactggcactgtggcacataataaagaactagatcatgcacccactagtcatcacttcgtctagtccctccgactcgctgtcgtcgtcgtcgccgtcatcgacgtctccgagtacctcctacgcgacatgccgcatcacgtacgctagcagagcagcacctcaatgtccttggccttgctttgctggctctctgttttctgcttgtagttgcttttaatctggcacaggtttctaaatcattgcaaaaaaaaaaaaaacatatggccccta

SEQ ID NO: 3013 - DNA, 939 bp, Zea mays
  Clone ID: PAT_MRT4577_99262C.1
ggaaaaaaaaaaagctccatatcccatccatcacagctagctagcgttcctaatcaccgacgaataatctcttcttcacctcactaacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcgactgatcgatggatccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaataattttaaaaaaaaaagtgttcattatatataccccgtacatatgtatgtatgattaagggggtgtttggtttgcccctgctaaaatttagcccct

SEQ ID NO: 3014 - DNA, 419 bp, Zea mays
  Clone ID: PAT_MRT4577_99318C.1
gggagcaccaaaaagcaccatttttttccttagggttaaacttaaaaaaaagccggggggggggaaaagcacccatcgatccgcagcccatgctgggtgatgcatgggtctgctggagccgggggtgaacacaggactaacaacgggcacagagggaccttaaatcaaaaacacagggggggaacaacaaacacgagacgaacgaagataaaccctcgggactaggggaaacaacacgggagcgaaaaggataacttgggcgggggggccccaccggtaaattcctccagttcccgggggagttgccgaaaccccccccacgggtgccaccgccgtagccggcgccaccaccaccggagccgccgccgccaccaccggagccgccgccaccggcgtagccgccgccgccataacggggc

SEQ ID NO: 3015 - DNA, 477 bp, Zea mays
  Clone ID: PAT_MRT4577_99484C.1
gccggggcagcatctcaagccccatcgaccttcaagcctgcgctacgaagcagagcaataaaaaaagcagccgcaatggcgagcatgaccatggccctctcctccacggccttcgccggcaaggccgcgaacgtgccgtcgtcgtccgccttcggggaggcccgcgcgacgatgcgcaagacggcggcgaaggccaagccagcggcggcctccgggagcccgtggtacgccccccaccgagtgctgtacctgggagcactggccggggagccaccgacctacctggcgtgcgagagcgcggagcgagtacgcagtaatcaccgcgggggttagagcgctattggtgccagaggcctcttttttctttctcggggcgatgcctattggctgcaccgcgacggtataggttggttgcatgcctgccacctgctgtaggctggcgcagggtgattggcagcccgtacatgcaggctgtga

SEQ ID NO: 3016 - DNA, 157 bp, Zea mays
  Clone ID: PAT_MRT4577_99523C.1
tacgcaagggtctccattttttattaaccgaccaacattctgggaactgggagggggaaactttatgttccaaaaggggctcgccatgagcatcaggtcttggcctggttgaaacgctttgtagccctgaacccatacctacctcagggaaggcata

SEQ ID NO: 3017 - DNA, 774 bp, Zea mays
  Clone ID: PAT_MRT4577_9957C.1
attgggaccctcgaggccggccggggcaaatatctgtcgccgtctcgccaacagcaccaaccgcgcctcctcgaattcgaccgtcatggcgagccaaggaaggggaagaaggattactctacggcgatcctggagaggaagaagtcgccgaaccggctggtggtcgacgaggccaccaatgatgacaactccgtcgtcgctctgcacccggacaccatggagaggctccagctcttccgcggtgacactgtcttgatcaagggtaagaagagaaaggacactgtctgcattgtgcttgcagatgagacatgtgaggagccaaaggtccggatgaacaagattgtcaggaagaacttgagggtacggcttggtgatgttgtatctgtccatcaatgcccagatgtcaaatacgggaagcgtgtgcacatacttccaattgatgacaccattgaaggcatcactggcaatttgtttgatgcctttctaaaaccatacttccttgaagcctatcgtcctttgaggaaaggagaccttttcctagtcaggggtggcatgagaagtgtagaattcaaagtcatagagactgatcctgcagagtattgtatcgttgcaccagatacagaaatattttgtgagggtgagcctattaagagggaggacgaggaaagactcgatgaggttggctatgacgatgttggtggagttagaaagcagatggcccaaatcagggaactggttgaacttccattgcgtcatcccagcttttcaagtcta

SEQ ID NO: 3018 - DNA, 600 bp, Zea mays
  UNSURE (1)..(600): unsure at all n locations
  Clone ID: PAT_MRT4577_99607C.1
  unsure (1)..(600): unsure at all n locations
gaatcccttaaaagagaaactgctccagnattccttacggagcatggagtgcggcgtccatctatacttggagttagagagcacatttttactggcagtgtatcctcccttgcatggttcatgtcaaatcaggagcacagttttgtgactattgggcagcgtctccttgcaaaccctctgaaggtccggttccactatgggcatcctgatgtatttgatagacttttccatctgacaacgggtggtgtcagtaaggcatcaaagagtatcaatttaagtgaagacatttttgcaggttataactcaactcttcgtggaggcaatgtaacacaccatgaatatgtacaagttggtaagggaagagacgtcggattaaatcagatctctaagtttgaggctaaaatagcaaatggaaatggtgaacagactcttagtcgtgatatctaccggcttggacaccgctttgattttttcaggatgctttcatgctacttcacaaccgtggggttttatttcagtacactgttgacggttgttacagtttatgtatttctgtatggacgcctttatcttgctctcagtggacttgaagaggggcta

SEQ ID NO: 3019 - DNA, 3129 bp, Zea mays
  Clone ID: PAT_MRT4577_9961C.1
cccactgacctcgaggccggccgggccgggatgacctcgagggcgggaaaaaaaaaaatgggactaggtttgctggccgggtcgaccctcgtcttcatcttcccacttcagcccccaaacccgaacactcgcaatcgcaagtcgcaaatatctgtcgccgtctcgccaacagcaccaaccgcctcctagaactcgaccgccatggcgagccaaggcgagccgtcttcctccgatccgaaggggaagaaggattactcgacggcgatcctggagaggaagaagtcgccgaaccggctggtggtcgacgaggccaccaatgatgacaactccgtcgtcgctctgcacccggacaccatggagaggctccagctcttccgcggtgacacggtcctgctcaagggtaagaagagaaaggacactatctgcattgtgctcgcagacgagacgtgtgaggagccaaaggtccggatgaacaaggtcgtcaggaagaacttgagggttcggcttagtgatgtggtatctgtccatcaatgcccagatgtcaaatacgggaagcgtgtgcacatacttccaattgatgacaccattgaaggcatcactggcaacttatttgatgcctttctgaaaccatactttcttgaagcctatcgtcctttgaggaaaggagaccttttcctagtcaggggtggcatgagaagtgtagaattcaaagtcatagagactgatcctgcagagtattgtattgttgcaccagatacagaaatattctgtgagggtgagcctattaagagggaggatgaggaaagactcgatgaagttggctatgatgatgttggtggagttagaaagcagatggcccaaatcagagaactggttgaacttcccctgcgtcatccccagcttttcaagtctattggtgtgaagccaccaaagggcatattgctgtatgggcctcctggctctggcaagacccttattgctagagctgtagctaatgagacaggtgctttcttctttttgatcaatggaccagaaatcatgtcaaagctagcaggagaaagtgaaagcaatctcagaaaggcatttgaagaagctgagaaaaatgcaccttcaatcatttttattgatgagatagattccatagcacctaagagagagaagacccatggagaagttgaaaggcgtattgtttcacagctcttgactcttatggatggcctcaagtctcgtgcacatgttattgttatgggtgccacaaaccgtccaaacagtatcgatcctgctcttagaaggtttggtcggtttgatcgtgagattgatatcggtgttccagatgaagttgggcgccttgaggttcttcggattcacacgaaaaacatgaagctggctgaagatgttgacttggagatcattgcgaaggatactcatggttatgttggtgctgatcttgctgccctttgtactgaagctgctcttcaatgcattcgtgagaagatggatattatagatcttgaggatgagacaatagatgctgagatactgaactctatggctgtctcaaatgatcatttcaagactgcacttgggacaagcaacccatctgctctgcgtgaaactgttgttgaagtgccaaatgtctcttgggaagatattggtggcctggaaaatgttaagagggagctacaggagactgttcaatatccagtggagcatccagagaaatttgaaaagtttggcatgtctccttcaaagggtgttttgttttatggccctcctggctgtggcaagactttgttggccaaggcaattgccaatgaatgccaagctaacttcattagtgtgaagggtcctgaactgcttaccatgtggtttggtgagagtgaggccaatgtccgtgagatttttgacaaggctaggcagtctgctccatgtgtcctcttttttgatgagctcgactccattgctactcagagaggaagcagtgttggtgacgccggtggtgctgctgatagggtgttgaaccagctgcttactgagatggatggcatgaatgccaagaagacggtttttattatcggtgcaactaacagaccggacatcattgacccagccttgctgaggcctgggcgtcttgatcagcttatctatattcctctgcccgatgagcagtccaggcttcagatcttcaaagcctgtctcaggaagtctcctgtggccaaggatgttgacttgaatgctctcgccaaatacacccagggtttcagcggtgcagatatcacagagatctgccagcgcgcgtgcaagtatgccatcagggagaacatcgagaaggatatcgagagggagaggcgcaggaaagacaaccccgaggctatggaggaagacgaggtagacgacatcgctgagatcaaggctgctcacttcgaggagtccatgaagtacgcccgtcgcagcgtgagtgacgccgacatccgcaagtaccaggccttcgcccagacactccagcagtcccgcgggtttggcagcgagttccggttccccgaccaaccgacggcagctgctgctgcggccgatcccttcgcatccgctgcagcagcagctgacgatgatgacttatacagttaaattagcagtcctgtgttgtgacgcatattgagtactttgcttcgttatatatgcttattatagtagactacgtgcaagacgcggagtcgctgtacctatatataatacttaagttaatattttggtacgatcctctgaatcgtgccatgagccatggtttgtgttcatttgagattatcaaagatggccagctctaccattgtgaatgataaattttcgttcaatgagaagtttaggttgcattcacattggatcatcgtatcgccgtgcagggcttcaccacgatgaagtctcctttgtttggttgcaatgtgcaatggcggatggttacaatgaaaaaaaaaaaaaaaaaaaaaaaaaaggaaaaaaaaaaaagaaaaaaaaaaaaaaaaaaaataattttggaggggttcctgcaggcgaacaaactttcactatagtgattcgtggcagaccttggcctgataatgggcatagtttattactttgcgaaaatgggggggg

SEQ ID NO: 3020 - DNA, 365 bp, Zea mays
  UNSURE (1)..(365): unsure at all n locations
  Clone ID: PAT_MRT4577_99757C.1
  unsure (1)..(365): unsure at all n locations
taccaacataaaaagcncanttttatactaacagtgccatgcannatatggtgctgacttatgctccttgtcctttatgcaagtgctgcttcctcaaccattatctcacaatgctcacaagctcctatagcttccttacttccaccatacactttcaccaacgctgtcttcaaaatgtgaaaacccaattctttaaccctacaggatccaacaggcattcgcaccaggcatcttaccttaatcacccttgtttctacaacaaccgacagccctattacagcatttacctttgtagcatttgtcggcacaaaacattcaagcacagcaactacaacaacttgtgctaggaaacctagctgactact

SEQ ID NO: 3021 - DNA, 292 bp, Zea mays
  Clone ID: PAT_MRT4577_99767C.1
ctcaaacccataattggtgatgtattgaaaaacagagttttgaaccatggagcagtttggaagttttacctgactggggaaaaaaaggacatgggattgttttttttatgagcgctgctactagtaatgttcacatagcatgggtttgtaaaaatactgtggagcaccacatcccccaccaacaggcattccggttgccaatgaggagggggtcttaaacaagcccctgagctgtaggtagcctatcacttggaaccctgaaaggggggcgagaaacttatctccccccccc

SEQ ID NO: 3022 - DNA, 283 bp, Zea mays
  Clone ID: PAT_MRT4577_99835C.1
tgtttcctatattctaaatgtggattgtgaccattacttcaatagtaataaagcttttagggaagcgatgagcttgatgatggatccagctataggatggaaaacttgtcatgcacaactaccacaacgatgtgatggcattgatttgcacgatcgatatgctaataggaacataatcttcttatgatatcaactgtgaaagtctatatggctttcagtgtacagatgatgggggaacaagatgcgttttcaataggcaggctttgtatgggtaggatcctgt

SEQ ID NO: 3023 - DNA, 384 bp, Zea mays
  Clone ID: PAT_MRT4577_99841C.1
tatttctttttttttttttggtattttttatttggttttttttgaagggttggcgttttctgcaaagccataaataattgccatattctacattgtagggggggctcctggtttactaatcaaagaacaatagcacttaggttacaacattgttacccttagagctacatccaaatgttggataggcgccagccagctaaggtacaagcacgcttgaccatgatagaattttaccaatccattgacctgccaatggcgctctttatatgcaagccttcaaggattgcaaaaacttccgcatgcccccagtgggccacgctttgaggagtttaaaagacatattcatgaagctcacggcttgcggagcttgaagccaaagacacc

SEQ ID NO: 3024 - DNA, 377 bp, Zea mays
  Clone ID: PAT_MRT4577_99927C.1
tcgcgagaacatgaacggcaaggagcggggcggccgtaacatcaccggtaaccaggcccagtcccgtggcggtggcggtggcggcggtcgctactgctgaggtcgcggacgccgcagctatggtggcgggccccatgacagcagctatggcgccggtggcggctactgcggtctgcccgcgggtggtggcggcacctactgaggcggtggcggctacagcagtcggcgcgagggtggtggtggcggctactgcggccgcagcggctgctggagggactgatgtgtgcgcccatcctggcttctgccgagttatcttatctatctatagtatcgtgttaccgctcgcttctgtcaccgtgttagtgtccgttctacct

SEQ ID NO: 3025 - DNA, 1252 bp, Zea mays
  Clone ID: PAT_MRT4577_99994C.1
acccgtaatcttcaatctccccagcaatccctagcagaagccttccatcctcactcgctcgatggcccgcacgaagcagacggcgaggaagtccaccggcggcaaggcgccgaggaagcagctggcgactaaggcggcccgcaagtctgcccctgcgaccggcggagtgaagaagccccaccgctcccgccccggcaccgtcgcgctccgggagatccgcaagtaccagaagagcacggagctgctgatccgcaagctgccgttccagcgcctggtgcgggagatcgcgcaggacttcaagaccgacctacgcttccagagctccgctgtctccgcgctgcaggaggcggctgaggcctaccttgtcgggctcttcgaggacaccaacctctgcgccatccacgccaagcgcgtcaccatcatgcccaaggacatccagcttgcccgccgcatccgtggggagagggcctaagcatcatatattctgtcatcagtgcccgatcagaagatgtagagatgtgctgggttctgtagtttgggttactgtcgaatcatcgagtagttggttgttcactgctgtaacttgttatcatgatgcatatgaaatggcaatgaactatgttatcagttctcgaaaaaaaaaaaaaaaaaagcggccgcttttttttttttttttttagacacaaaatggagcatgtttgagtccagagcaagccagcattgacaacatttcttcagacaaacacaccatgtgcacataccgcactgcagttctacagtatctagcatttttccgcccacacaaacaacttgcgaactgcagcaacaccagaaccgcagcgacggcgaatcgcggcgcggcaggcctagccgccgaagccgtagagggtgcggccctggcgcttaagcgcgtagacgacgtccatggcggtgacggtcttacggcgcgcgtgctcggtgtaggtgacggcgtcgcggatgacgttctccaggaagatcttgagcacgccgcgggtctcctcgtagatgagccccgagatgcgcttcacgccgccccgccgcgccagcctccgtatcgccggcttcgtgatcccctggatgttgtcgcgcagcaccttccggtgacgcttcgcgccgcccttgcccaggcccttgccgcccttgccgcgccccgacatcttcgccgcggagacgagaggattggggaatttttgcttgttggttggtgtggtgggtggatgattatcccggc

SEQ ID NO: 3026 - DNA, 3102 bp, Oryza sativa
  Clone ID: PAT_MRT4530_100020C.1
ataggttttttttttttttttttttttttttttttttttgctccaaaattaactttcatacattaatattctcaggtacctgaatttctcaatttagactatttattaatacagaaaataaatacccatgtaagcatacaggttaactaagcaatgataagtggagccaagcaagccaccataataattagatcttccagccaaggtaagacctcatacacaacaattatcacaggagagatggacatattacttatgtgtgacttgagtgtagggcttgattggatcgttatcccatagtcccccgccgcattaacaagattctagccaacatatccaaaatcgacaacactatatgatctgcgtaaaagtaacaattaaggcatcacaaagtacaaggcaagaacatttagaaggatcttgagaagtcccggcagcaactctcagtccatggcggacagtgcagagttatttgacatactaaccatatgccggaaaactcacagcacccagctggtttgttgaaccacatggcgacttttttcattttcccaatcgaatatgcagcacctcagggcatagaagtcagtctccggtgagtatccatctaccagtagaaaacccagcaagaccagtttctgtaaatcttctcgatgtgccttattatcccattccatgtaaatctcttgtttgagaagatcctcgaagtcgcttctttacatccttgaaagtcaggcttaaaaatgtgtccaagctgctccacaccatccatcacaagttgctgatgacccaatactttgcgactcttcataatacgcacaattgatgcatcaattgcgtatctgcgatccttatcaacatcttcaactactttcttcttctcatcaactggaggaagaggtatctttaatcttcgcagcttgtcagtaaactttgagttgaactcgaagacatcatttggtgaaatagatctattatttggttctttgctaagaatcttgtattttgcacaagatagagaatggagcaatcgaacaacatcatcatctgagagatttaactgtgtcacaatctcagaatagctgagtctatcaactccattaaacagcagcagcaatgcagcctgataagttgtaacaatgagctcaatagttttggcctcaaatttagcattaatattacaggttcccagtgaataaatccaggtaagtttcctgtgttttgttcttgtttggtaaaactccttgaaaacctctacacatttcaccatttctgcaggtagatttatatcaaaagatttgtaacttggccaaaatcctgttgtgaggacagtaacagctaaggctattccaggattcaactctgagtgtgtgcttatgaactcttcaaatttagcctggtgatctcttgccacagtgagatcagtaaccatgccctccattttggaagtgaactgccctccacattgttgctttagcttggtaaggatgcttctctcatgttcatcattagcactcttgtcaaaaagcaatctccttgcaagcttctttctatagaactcagcaaacaagtccttgtcactaatgtaggcaagtaaccttacaaccttctcaagggtatcttcaattgcttcatcactaagcttttcactaccgcctttctttaagatattgtcacagaaggtagctagtaattcagcacttgaactgccagaaacacctttgttgcaaaaaacttcaaaagcctccttaagtgccttatggaagagagtgtgcccctgaaaacaatccgtaacataagctacatacttgtcatgaagctcaatgattttccggacaaaaacctgttcctgtaaaccaactatctccttcttctctggcttcttattactagcagcatcttcggcttgcttcactaaggcagtgccctcattagtaacatgctgcttaaatatttgagaaacaggttctaaaccacgagttattctggaaaagagcctgtacattctagagagatcatcaaccttgtcatcacgaagcaatgcatggcatccagaatgctccttctccaggagctgacttgcgtattgagttagcaactcatgttgcactttctccaacaacttctgttcactactggagtgcaaataatgagcaactcgctctttctcccttttcagacactcctctgcctttaacatgtaatctggacaagagtcctcaagaatccaggtctgggcttttatagagtaatagtctgcagtatctttgagcaagaaatcttcaaaatcattttcgtagtagtccatgctagtcaagccaatctcaacaaatatatccagaacattctttaacagggccctatcaatttgttcaccctcacgttcttgatctatctgttcgagaaagtatgtcaaggatatcaccgcactttttacttttcctttgatctcttgatataccagatcccggaaacagctaagcccaacttcacttagttgtggtagggacctccttgaaataaagtaccgatcaagataatggaagaagcgtgatagccaccgaaccatcactttatggtttgaccaccgttttactagctccctcagcataaactcgtcatgtttctctcttaatgaaggtaagaccatggaggtgatgtactcctcgaaggactcgcggtacttgtcgtagagctgctgcgagtagtcgtgcggcggcttctgcgtgcacatgttgtaaatcgtcgtgtagagcatcatgtagtcctcggagctgaactggggctcgggcttcccctcgaggatgttcttcagcttggtgatgcccttctgcatgaacgcccatccctcctccagatcgatcgtcctccgctcgtgggccgccatcgggcagccgccgccgccgccgccggtgaacggaggccgcgcggaccaaaccctaggggagagacgccgccgcgtgagatggggagagacagaggaggaagaagagatggctgagaatgacatgtggggcccatgtgggtcttaccattttttttattaatttctatgtaaacctgacatgtgggtcctaggaggtttattattttttggaattg

SEQ ID NO: 3027 - DNA, 5037 bp, Oryza sativa
  Clone ID: PAT_MRT4530_100065C.1
atgccgtcgtggacgcccaagcgacggagcaagcaacaacagtcccgcatcctgttcaagccctcctcgtcgctcgagcggccatcggtatctgcgaatctggtttttccccaggaactggccatgggccaagaagatggtgatgttccccaacccggcgttcaccgtccaagaagcagaagcggttctataagacgtgatgctgtggcttttgaaataactagtcccgctgacaagcgggccccacatgccatacactcgtcgaaagaaaataaggggagagatggagatggcagcggcggcggcgtcatcggcctcggcggcggcggcggctcggcaaggaggacgcgcctcctccacggccggcgaacgaaggggcggcggcgccgggaggaggaggcgccggtcgggaaaggacgggagcggcgctggcgtcgggttggccggcgtcggttagggatgggcggggacggcgtcgggcggcgccggtcggggaagggcaagagtggcgccggcgtcgggttgggcggcggagtaggcctcggtggcgtcgtcggcctcgagcggcggcggggagcggcagtgcgcacggcgtcatcggcctcggtggcagcggtggtggcgccggaggggaggtgtccttggtcctcggacgcggagagacggcgtcaacaggagtggatgaaaaacgcaactgagtggtatggatccaatttctcaaaattacagtggcacccagccgatatgacgaatagtagtgattcatcaacaacactgttggccctcttgaacaggaacatgctgaaagaatcactgcatgacaccatcgctggtcatatcgagcgcaactgcaaggtcgacatcgacgccacccttcctcggaaagtgccggcggctgcggcgcccaagcgtccccagcatttggccgccagcaccagcgcttctgtcccaggtgacaaggagcatcctcagccggggggccgtggagtcctgtcctggacccctgggatggccgcgattgagcagcagatgaggaagcgtgcgctggtcacgtcggtgctgtccgggagaagggaggtctcgccggcgatggtggtcgcagctttggggcgtcgctgcagggttccctcggaagatgttcgcatcgaggtcaccaggccctcggacttcctcatctcctttcggcgtgaggaggactgcgcatccgtcctggggtggtccggcaggttcagcgtggagggggcgtcgatctccttccgtcattggcaccgctcagttcatgctcggaggtccaagctcctgtttgtcgtcaagctggccgtggaggggctcccagcgcatgcattggagtttgaagccatcaagcagttcctcaacaagattgactgccagttcatcgaactgttcttgccagtcgacgcatgcatgacggaggtgctggcctggtcggtggacccgtccaaaattcccaaggaattcaccctcgacattccggagccgatgcaagaatggtggatgccgccggtgatggaggaccctgacatacacgagccgctagtctcgcagacaccgccggcgcccccgatagagaagaggtgcctctcgtttgacctgctgatccatgtcctggaagtggttgacccagttcagcagctgctggacagcccccccgatgacccctacaacgacgatcgcgaggctctgcgcaggtgcgcctacggcaccttcctcggcaggatcgatggcaccggcccggtggttctttccccgccggagccaacgccagtcgagatggagccggcctccgccttgggctctccgcccgagcacacaccggaagcgatggcgtccttggcatctctgggatccccgccgggcacggccctcggcggtttggaggtggatgtcatctccgacgtggtctcgtcaccgatgctcgcaccggaagggcctgaaacggtcaccatcttgggagcaccggtcgagcacgcgtcaccaaacgaggtgctgatctccatcgagacggtcgtgatggggccgggctcattaactcgcccagcatcagcgccagcaaaactagtggtggacccacatgtaagggagtccctgggtgtggggcttgccaggcaaatatccttcgaagaacccgccagagatttgctgagttcagtggcatttacatcgtcgccacctcttccggctgtggcgccgctggcagttgtggagggcgcgaacctcacgttcaatccgcccggtgagcgggaatcggttcccctttctacaggggcgctggagatggttcttgggccgtggcccgaggtgcacgtcgccagcccacaaatagtctaccgcaaacgccacctcctcccaacctcaggccgcaagtggcctacccatcgggccgctttgggccttactcaggacggctcgccaggggtgccgctttccctggcccactcggagcggacctcgcaggtcattgatggctccctggcgcttcccagcgctgcgttcccagcggccgccgcgtctctctctccgggtgaggcagttccatcgctgggtgaccttgtggcaccccagccagcggcgatcatcggcacgcgtccgcaggcgacaccagctcgatccaaacggcggattgagccatactcccacactccaagacgcagcgaaaggctggccgccattaatggcgggcgacaccagcactcggtgtccaaagcccagcgtgtgctcatgaagaagctcagggtggttgaagacgagagcaaggtggaagacactgacatcctcaaatacttggagctcttcaagtcccctcttgtgccggcccatgtgcaagccttggcggcactgtgcaacgtcaggctgtcgtctcctcagagcgtcgagcttgttgttcaatcttgtggctcttttttagatggttttgagttcatccctgctgagggaactagaggggggttgttcactgcctggcgcagtgatcgtttcaatatgagttgtcttcataaaggggtatggtcgctctcgctgtgtgtgaccaatctggaagggggtgcgtcatggacgttgacaaatgtctatggaccccaggagaccgagcagaaaattcagttcctggaggagctaacctgggtggggcaacagtgcgtgcagggggcctggtgcattgtgggtgatttcaacctcctggcagcagagtcggacaagaacaatggcaatgtcaatagaggcttgattaatcggttcaggggtctgttgaacactttggagctccgtgagctctacttgttcggccgacgctacacatggagtagtgagcaagaacgaccaaccattaccaagatcaataaagtcttgatgaatgctgattgggaggacttcttccgtgacgcacatctgcaggcgctcagctcgtcggcctctgaccattgcccccttctgctggcttgtgaggcgatggtgcacagatcgcgacgcttcaagtttgaagctttctggcttcatctggaaggcttcgaggaggtggtccggtcggcgtgggatgtggtgccagctggttcaaacgccctaagttccctccacttcaagctacgagcgacggcgatggcgctgaagtcatggggtgagcgtcgtattagcgagttgcgtttgcaacttgcgatggcgcatgagataattctaagactagacggtgctatggacttgcgtctgctgtcccacgaggagcgttctttgcgtgcggcactcaaaggccggtgtttggcgctcgcggcgctggagcgcattcggctgcggcagcgggcacgcctgcgatatctcaagcacagtgggacagcctcccaattcttctacttgaagatcaacgcgagaagaagaaagaagacaattcctgtgctgcagcaaggcggagtttggggggtgacagaggaggacaaattggctatggctcatgactacttcctcgaaattatgggctcgccctcgccaccaatggtggcgctcgacctaggacgccttggtctccctacccttgatctctctgagctggaaattgagattttggaggatgaagccaagaaagtcatgctagaaatgctgagtgaccgcgcaccggggccggatgggttcggcgcagccttctacaagagatgttgggaaattgtgaaggaggatgtggtggcggcgctgaacctggtgttgaacgcgaactcgcaacaccttcaccttctcaacacggcgtccattatcttgctccccaagaaggaagacccaatgcagctggccgactataggccaattagtctaatccacagtttcatcaagctgttcactaaaggggtagtgcagaggcttcaccgtgcgaaatgccctgctatcctactcaagctcgacattgcaaaggcgttcgacacggtgtcctgggaattcctgcttgagctccttcgccatctcggttttggagttaaatggcacgactgtattgccgtgcttctcgtctcctcgtcgactactgtttatgagggatgcaactggtttggtctcgaacttcgcgaaagttccatcacgcccatacattgctcggacgaacaacttgcggctgtgactgaagtgctggggtgcccggtgcggttgctccccatcgtctatcttggacttcctctttcagtgcgcaagctgggaaaagcggacctgcagccaatgatggatcgtcttgctaagagtctggctagttggaagccgaagctcctcgctctagacgctcggctcgcaatcatcaagcatgtgttgatggtgttgccgttatacttcatgtctgtgctggagctaccagtttgggcaatcaaggaaattgagaagaaatgtcgcggcttcctatggaaaggggatgaaaacgcagcgggcagctgcagcctggtggcctgggataaactctgtctaccaatcgagaacgggggtctcggcattaaggacctgcgtctcatgggcgtcgccttgagaactcgctggccatggctctgccgtgtctag

SEQ ID NO: 3028 - DNA, 256 bp, Oryza sativa
  UNSURE (1)..(256): unsure at all n locations
  Clone ID: PAT_MRT4530_100215C.1
  unsure (1)..(256): unsure at all n locations
aggggctcgggaagggcggcgcgaagnggcacaggaaggtgctgcgcgacancatccaggggatcacgaagccggcgatccggaggctggcgaggaggggcggcgtgaagcgcatctccgggctgatctacgaggagacccgcggcgtnctcaagatcttcctcgagaacgtcatccgcgacgtcgtcacctacacggagcacnnccnncgcaagancgtcaccgncatngacgtcgtctacnagctcaagcgcca

SEQ ID NO: 3029 - DNA, 379 bp, Oryza sativa
  Clone ID: PAT_MRT4530_100251C.1
cccactcatccgcattcgaatgcaagaagctcgtatctgccaccaaggcaaggctgaagcttgatgagagtgcggactagaagaagcggcacgaggaactcacggcgaagttcgagggactgggcaaggtgatcaaggatgcgctcgctgactaggcaacaaaggttgctgtctctgacccagtggcggactctcgctgctggctagtcactggggagtatggatggactgctaacatggaaaggatcatgaaggtccatgctctagaggactccaacatgtcacggctacatttctagcaaagaagaccatcgatatcaacctggataatgccatcatggacgagctccgcaagcgtgccgacgcggacaagaatgac

SEQ ID NO: 3030 - DNA, 654 bp, Oryza sativa
  UNSURE (1)..(654): unsure at all n locations
  Clone ID: PAT_MRT4530_100287C.1
  unsure (1)..(654): unsure at all n locations
ccacgcgtccgggacgggctcgagacgacagaaacgactactacgccatcggcacctacgacggcgagaccgatacctggacgccggacaacgccgacatcgacgtcgggatcgggctccggcacgactacggcaagttctacgcgtccaagacgttctacgaccccgtcgggcggcgtcgcgtgctatgggggtggatcggcgagaccgacagcgagcgggctgacatactcaagggctgggcctcccttcagtcaattccgaggacagttatgctggacacgaagactggcagcaacctgctccagtggccggtggtggaggtggagaacctccgtatgcgcggcaagagcttcgacggcctcgacgtctctcccggctccgtcgtgccgttggacgtcggcaaagcaacacagctggacatcgaggccgtgttcgaggtggacacttcggcagccgacggtgtcgtcacggaggctggagcagcagcatacagctgcggcacgggcggcggtgcggttggccgtggcttgatgggccccgtcgggcttctcgtgctggccgatgatcagttgtcggagcggacggctggcttcttctacctggtcaagggagncgacggnaaccttacaaccttcttctgggaagacgagc

SEQ ID NO: 3031 - DNA, 428 bp, Oryza sativa
  Clone ID: PAT_MRT4530_100303C.1
cccacgcgtccgcccacgcgtccgcccacgcgtccgcccacgcgtccggagagagggagagagaacggaggagagaaaggacagaaagcttgatactgatcaactccaacaatgaggccattattctccaaggaacatttggacctgatgacaaccaggatgactcgagcaatacaagttctggtgtttcacttggtgactactttcttggtcctggattagatatcctcttgcagcatttggcggaaagtgatcttaatcgttctggtacaccacctgccaagaaggaagctgtagaagcattgccaactgtgaacatccaggaagtgttaggctgttctgtctgtcttgaggatttcgaaatggggacagaagcgaaggagatgccttgtcaacataagttccactcccagtgcatacttccatgg

SEQ ID NO: 3032 - DNA, 2407 bp, Oryza sativa
  Clone ID: PAT_MRT4530_100469C.1
aatcgcacgaggcaaccgcacacgaaagaacaagggccgccaagttgcagttagctagctgttgcgctcgctttcccccaaacgtgacccggccgggagggagaagtcgccatgaagcagcctcccgctgctgctttctctctctcgcctcgttaaaatctctcttccaccccgaaccccatccagttcagttccctctcgatcgcttcccgtgctctcgctctctcgcttgctagatcagagattcccctctgcggcggttgtgaggtttccgcttcggctcgctagctagctctgctgtttctgtgagagccgggagcaccaaccgcgcgtggggtgggtgcccggaggtttgatgcgcgtggccgccggtttctccccgtcgtttgatgggcaacgcatgcggcggttcccttagatccaagtacctgagcttcaagcagaccgcgtcgcagcgccacgacaccgacgacaacaacaacgccgccgcggccgactcgccgaagaagccctcccgccctccagcagccgccaagacggacgaccacccagtctccgcgtcggcgccggccgccgccatgaggcgcggccaggcgcccgccgacctcggctcggtgctcggccaccccacccccaacctccgcgacctctacgccatgggcaggaagctcgggcaggggcagttcggcaccacctacctctgcaccgagctgtccactggggtggactacgcctgcaagtccatttccaagcgcaagctcatcaccaaggaggacatcgaagacgttcgccgcgagatccagatcatgcaccatctctcgggccacaagaacgtcgtcgccatcaagggcgcctacgaggaccagctatacgtgcacatcgtcatggagctctgcgccggcggcgagctcttcgatcgcatcatacagcgcggccactacagcgagcggaaggccgccgagctcacgcggatcatcgttggggtcgtcgaggcctgccactcgctcggggtcatgcaccgggacctcaagccagaaaacttcctgcttgccaacaaggacgatgacctctcgctcaaggccatagattttggtctctcagtcttcttcaagcccggtcaaacttttaccgatgttgtcggaagcccatattacgtagctccagaagtgttgttgaaacactatggaccagaagctgatgtatggactgcaggtgtcattctctacattttactaagtggtgtacccccattctgggcagagacacaacaaggaatatttgatgctgtactaaaaggtttcattgattttgattctgatccttggcctgtgatctctgagagcgcaaaggatcttataacaaaaatgctcaatcctcgcccaaaggaacgcttaacagcacatgaagttctatgccatccatggattcgtgatcacggagttgctccagatcggcctcttgatccagctgtcctatctcgcatcaagcagttctctgcaatgaataagttgaagaagatggctttgcgggtaatagctgagagtctctcagaggaggaaatcgctgggttgaaggaaatgtttcagactatggatgctgataacagtgttgctatcacatatgatgagcgtaaagaaggctttagaaaatatggctcaacacttcaggacacctagaatcgtgatctaatggattgggcaaatatagacaaccttcggaacaatcgtatatatcgaaatcatttcctcgatattgtctctcaataaactggagcgagaggaacatcttgtggcagctttttcatattttgacaaagatggaagtggttacatcacagtggatgaactgcagcaagcttgcaaagagcataacatgcccgatgcttttcttgatgatgtcatcaatgaagctgatcaggacaatgatgggcgcattgactatggagaatttgttgccatgatgaccaagggcaatatgggagtcggacgaagaacaatgagaaacagcttgaatatcagcatgagggacgcacctggtgcactctagacttccacgatgtacagcttacggattttagcttcttcctgtcttcctgcccaacgaactcctgcgattttttagcgttgtcagatgtccgcggatgtgtttttctggtggttctgatttaacttgtcaattgattccatggaatgcataacaagatgtccatgccacgctcaaacgaagctgggttgtaaatctctcgtacgccattgctcaactctgaaggtgttcggtgaactagctcgtattctttgtgttgcaatggatgaacttatactggctgtgttgggtgtaattgcattgccaacatttacaggggcatgtgagatcccgctttatccaaaaaaaaaaaaaaaaaaaaaaa

SEQ ID NO: 3033 - DNA, 1178 bp, Oryza sativa
  Clone ID: PAT_MRT4530_100499C.1
ctaccttgccggcccagagcatccctccgttgcctattcatgttctcgcgacgacgggttcgtcttcattcgaaggcccactggttctccctcctcacctcctcttcttcctcgggggtgaagtcattcttgatgttgaaggtcttgcggatctcctctggtgtcttccccttgatcatgtcagccacggtctggcaggtcagatccagcagtcccttgatgttgaggtagtttgcagccaggatgagatcgaagagggtggactttttttttttttttttttcagcaaagcatttcactgcagattgatagtattaattaatgcagataacaggttcagcagttctgaccacatcagttctttttttcctggatagaacttaaccatttaaccaactaaacgtgcacatgaacccccatcggactccaaaatacttacaaccagcacgacatataaaagcagagcatacgtagatacggggtaaggatctaagcaccaagacatcagaggccttgatgccttctactcaaaagcccactggttctccctgcggatctcctcttcctcctcaggggtgaagtcgttcttgatgttgaaggtcttgcggatctcctcaggagtcttccccttgatcatgtcagcaacagtctggcaagtaaggtccagcaaccccttgatgttgaggtagttcgcggccaggatgaggtcgaagagggtggcctggtcgaccttgacgaagtcggcgtcccagttcttgaggtcctcgccggagggcggcggcacggctgcggcggcggacgcggcgtcgtcggcggccttggaggccgcggcggccgcggcgtgcacgtgcttgttgcagtactcgatgaccttggagaggatcttggagttgacgttggggagcgggatgccgttgtcggcgcagtcgtcctcgatcatgtggcggatcgtctgcgactccatcgccaccgcctcctccacctcgaactcctccccgtcggagctcttcagggtgatcatcttcttctctccctcagccgccatcgatcgagccctccgaaatcgctcgcggtctcggtcgtcgccgaggaggtgaatcgcacgaaaccctagctttcgcagcggcggcgatggggattgcggcgagattgggcgtcgggctccgcgcgggcggggg

SEQ ID NO: 3034 - DNA, 3822 bp, Oryza sativa
  Clone ID: PAT_MRT4530_101067C.1
tttttttttttttttttttttttttaaagtcaaaccatattttattcatgtagtagtaacttgaatgctctcagcatcaagatacagcatattacagattggtgttttcacttccaatcttaatgagttcaggcgagcaacagcacgcatttgcaacttagaagattacacatactgacattagcatggtgaagaagacgacagtacataaccaaatgtgccatacgaccatttatctgtaaagtcaaccatttatctgcagccagtgaatcttcagtctgcaagtacgtccaatcctaagcacaagccaccgtcgtggctatacgaacgaacatttcatgattattttgctggagcagaagcaagttcgacgctgaggatgaaggttgacatgccagcttccctcatatgtcggacatcgccattcatgagcctcagcaggtttctagaaaccgcaagactcatgccttcatccgactgctccttattgtcatcctcgtacatttgtgacagcagatctgctgggactcctttgccctggtgcttgatcctaagttctaggtctatgagatgaaggttttccccaatgctgttcttggtcaggctacaagagatctcaacagaacccccaacaggagagaacttcactgagacgaataggaagtcagagagaatctgctgtagtcgaacaccatccccgtagactgtttgcttcatatatctctccggtaggttgcaagagactctaatcccttttccctggcaagttatgagtacttgacttacagcagccacaaacacatcttgcaatacaaactcaaccatctccaaatccaagcaactagacttgttcatgacgctatcttgatccaagtcagaaagtattttattcagctggcggtgacaactatctgcaacattgacctccttcatctgctcttcattcagacctgtgttcttcagtgctttcctagagtaaagcatacctgagagagggttgttgattgcatgtctcatgtaggagtaagctttcaactttgttagtgcattctgctgtgaggcttgctgcacatgtagtgcatgttgcagctcatgactaggaacttgaatgaaacaaaatactccagtgatgacaccatctgcatttacttttctgttaacagaaagaaggcactcgatatacttcccgttccggtcgaagaagctgaatggagccttttctgtttcatcaccagctaatgcactgttgataagaatgcagagacttacaaatgcatctttattcttcacaagacaggaggcgttggtgctatcaaacacctcaccaagaagcatcttattgatcacctcatctctatgccacccggtcaatttcgtcatggcagcattccactcagagcaccatccaaattcgtcagcaccaaatatgggaggaataagcggggcttggattgtgaataattgctttgtagtctccctcaacccgagtaaatttgtccatgaccaacttatgaacagtcatatcttgtgcaacaaagcacacaccaacaacatggtcgtgaaggtcccggctggcacaggcattcacaaccaagataacagggccatcatctctcttggagccatgagttttcacctcaaatttcacttccttctcttctttgccttgcaaagctaaatacagcatcctctggacaactggtacagaagattcctctacaacggtaagtatgtgtcttccaatagcctcatctactctcaaccctgtcaactcagcaaccttctgattccatccattgaccaatccattgctatctacagccaagattgggacagttgctgtttccatgagacgaaccatttcacttgtaactgcctgcaattcagcaagcccatcaagcttgagatcaccaacctgattatctaaactagcggcccttgttggcttgatgtcatcattcagtgtccctctaagtataagttgtaatgagtgaatagcatccatctcatagtcattccaaggcaagctcttcatcttgacaacctcaaggaatgccttgaaggacagcctagggtgcattcttctgctgtcatccttgtctgatggatcatgttttgcacctccccatctgatttcagcagctgtatgtgacctgaaccagaacaggatatccttggaatttattttagctactgccattccacaaatcatatcaccaagagcagcagctcctggatatccagcatcatgtaggctatcagtactcaggccagtggaatccctgtggacatctgacagccagaaggcaatatcacgtatctgagactcagttggagcattctgtagccgccacacttttcccccatacaaaagagcagcaccatcacatttcacaaggtccatgatgttgggagtccctgatactatactcagaggagaggattccctgagaagcatgtcagagagcattgtttgcatcctcaatatgcttttctcgcgtacttgcctctctaattcaaactccttgttaacatggacagcaaacacttgtgctaagaactcacaggcataccgcaatgggaaaggaacatatctggggctctcatggtggcaaacaaggagtccccatagtttcttcctcttctgctgttgtgcaggttgatcagccccaacttcatcatcatcctcattctcattaaccacaacagccatgacaagggatgcaatcgagttcatgttctccatatactgaagatgacaactgtgtggtgccctcagtgttgaaccacataagctaatatccaagtggagcgactcatcttcgataatcttgatagatcttgcacggcaatcacaaatcatccggactttgttcttcatgaaaagaaacctggctgcctgagggatatcagtagctggataatgcaggccaagataaggttcaagaccaggctttgtgatctcagcaaagacttcaccatggtcatcttcatggaacttataagccataactctatcatatcctgtgaggtcaaagagttccttgaccaccgtattgcatagcacctccatgcttccacctggcagtgactggatcttagagattgccttggcagcaagtttgtaagattgcaaagccccagcggcagttgctggaaattctgtaggtttcacaggctcaaagtctaccaccaaacaaccagttgcccgatgaacaatggcatagaaaggcttgcctgaggtcttgcattgaactaggatagggttcagcaaggaaacatcagcaaatcccagtgccttctgcagtgctgtggcacctgggtcagtgaaaagagaccatacattggtgccaatgcgtagctttgggggatcatcaacacttggcactgcatggctgacagttgtaagcatctctggtgcattctcgctgagcgctataacattgaaggtcttctcatcaagggccaacaagcaaccaaatggttggattagctttgctctctgaatgtgatgcaagtaagctatgaccttctcagaacgagcttgctgctcaggtccagtagttctctgtgcttcaaccaatttggagtaatcaaaggagtcgccatattcttcatattcagcattgagttcagcatcaagagttgtttgtgctaatatccttgcccgggagctttggcgggtcctgctggatgaactggaacattgagtaggtcttgaagaagacatcatctgccttgattgcctgaatcactcaagagtcttatctgctgtataccactcctgctcggctcagctcagctctgctccagtagtggaaa

SEQ ID NO: 3035 - DNA, 5186 bp, Oryza sativa
  Clone ID: PAT_MRT4530_101087C.1
ctccactcctcgccttccactctccacacctcgcctcgcgtcgagcacctggcaatggcggctcacgcgccctcgatgcgccccacccacgccctctcctcgtgagatcgcctgctgcgctctctccccgcgcgcgcgcgcgcctccctccctgtttgttgaatccaagagcgagcccgaccgcatcttggaccctcccctccccgcggttcttggacgacgccggtgcgcgcggtggctctgctgtccccgcgccgcaccgcgccgaatccgagcagaacgcgcgcgcgtcggcggggggatctgcaatggcggccgtggcggtgcccccgctctccgcgtggctcgtcgccgcgcgctcctcgacgcaggcggaatgcggcggcgccgacgagcaccaccaccaccaccatcagcagcagcaccagtgctgcgtcggcggcgggtccagcacggtgatgttcggcccgcgccgccgccgcttcctcggcggcggcgcgcggcggcgcggcgcggcgcgctctggaatggccatggctgttgccctgcagcctgaaaggagaactgttgaaaagaaacctgatgttaaacaaagaagggtggttatcactggcatgggtgtagtaacaccgttgggccatgatcctgatgtgttttacaacaaccttctggatggtgttagtggaataagcgagatagaaaggttcgactgctccacgtttccgacgagaattgcaggagagataaaatccttttctactgatggttgggttgctcctaagctagctaggcgaatggacaagttcatgctatatttgataactgctggaaagaaggcgttggaacatggtggtctcactgaagaactcaggaatgaattggataaaaccagatgcggtgttctcattggttctgcaatgggtggcatgaaggtttttaatgatgcgattgaagcattgagggtctcctacaagaaaatgaacccattttgtgtcccttttgcaactacaaatatgggctctgcaatacttgcaatggatctgggctggatggggccgaactattctatttccaccgcgtgtgctaccagtaatttctgtatcctcaatgcagcaaaccatatcagaagaggggaagctgatgttatgctctgtggtggttctgatgcaccactcatcccaattggattaggaggttttgtggcttgcagagcactttcacagagaaacagtgacccaactaaagcttcccggccatgggatgtggaccgtgacggttttgttatgtccgcaggggcgtgggttcttgtgttggaagaacttgaacacgccaagcaaagaggtgcaaaaatatatgctgaatttctaggtggaagcttcacgtgtgatgcataccacatgactgagccacatcctgaaggaagagggattattctttgtatagaaaaggcactggctgattcaggagtagcaagggaagaaatcaactatgtcaatgctcacgcaacgtctacacagtcaggtgatttgaaggagtatgaagctattgtccgctgctttggccagaaccctcagctaagggtgaactcaacaaaatcaatgactggacatctaataggtgcagctggtggaatagaagctgttgctgctattcaagctataagaactggctgggtccatccgaatctgaatttggagaacccagagaaaatagtggatgtgggcgtgctggtcgggtcgcagaaggagagatgcaaagtgaatgtggcactgtcaaactcatttggatttggtgggcacaactcatcaattctgtttgcacccttcaagtgaacttcgcctacgattatcgcttgctccctcaaattttcaaccgcgccatgggacccggaaccgcgtttagaaaactagcaagcaagatgggtgggctcgaggagatcaagaatgaggccgttgatctggagaacataccgatcgaggaggtgttcgagcagctgaaatgtacgcgcgaggggctctcctccgaggaggggaaccggcgtatcgagatgttcggccccaacaagctcgaggagaagaaggagagcaagatactcaagttcttggggttcatgtggaacccgctgtcgtgggtcatggagatggccgccatcatggccatcgcgctggccaacggcggcggcaagccaccggactgggaggacttcgtcggtatcattgtcctgctggttatcaactccaccatctccttcatcgaagagaacaacgccggcaacgccgctgctgctctcatggccaaccttgcacccaagaccaaggtgctgagggatggccgatggggcgagcaggaggcagcaatcttggttcccggtgacattatcagcatcaagctcggtgacatcgtccctgctgatgctcgtctccttgagggtgatccccttaagattgaccagtctgcacttactggggagtcccttccagtgaccaagaaccctggtgatgaggtcttctctggctcgacctgcaagcagggtgagattgaggccgtggtcattgccactggagtgcacaccttcttcggcaaggcggcgcatcttgttgacagcaccaaccaagttggtcacttccagacggtgctcactgcgatcgggaacttctgtatctgctcgattgcggttggtatcgtgatcgagatcatcgttatgttcccgatccagcaccgtgcctaccgcagtggcattgagaacctgttggtcctcttgatcggtggtatcccaattgccatgcctaccgtgctctcggtcaccatggccattggttcccacaagttgtcccagcagggtgctatcaccaagaggatgactgccatcgaggagatggctggcatggatgttctgtgcagtgacaagaccggaaccctcacccttaacaagttgagcgtcgacaagaacctcgttgaagtgttcactaaaggtgttgacaaggaccatgttttgttgctggctgcaagggcatctaggacagaaaaccaagatgccatcgatgctgccatggttggtatgcttgctgatcccaaggaggcaagagccggtatcagggaagtgcacttcttggccttcaacccagttgacaagaggactgctctaacatacatcgatgccgatggtaactggcaccgtgccagcaagggtgctcctgagcagatcctgaccctgtgcaactgcagggaggatgtaaagaggaaggtgcatgctgtgattgacaagtatgctgagcgtgggcttcgttctcttgctgttgcaagacaggaagtacctgagaagtcgaaggagtctgctggtggaccatggcaattcgttggtctgctgcccctgtttgatcccccgaggcacgacagtgctgaaactatccggaaggctctccatcttggtgttaatgttaagatgatcactggtgaccagcttgctattggtaaggagactggtaggaggcttggaatgggtacaaacatgtatccttcatccgcattgctcggacaaaacaaggacgcttcacttgaggcacttcccgtggatgagctcattgagaaggctgatggttttgccggagtcttccctgagcacaaatatgagatcgtgaagaggttgcaagagaagaagcacatcgtcggtatgaccggagatggtgtcaatgatgcccctgctcttaagaaggccgacattggtattgctgttgctgatgctacagatgctgcaagaagtgcttccgacattgtgctcactgagccaggtcttagtgtcattatcagcgctgtcctcactagcagatgcatcttccagaggatgaagaactataccatttatgcagtttccatcaccatccgtatagtgcttggatttttgcttattgctctgatctggaaatacgacttctcacccttcatggtccttatcattgccatcctgaatgacggtactatcatgacgatctcgaaggacagagttaagccttctcccttgccagacagctggaagctgaaggaaatcttcgctaccggtattgtgcttggaagctaccttgctctgatgaccgttattttcttctgggccatgcacaagacagactttttcacggacaaattcggtgtcagatcaatcaggaacagtgaacatgagatgatgtctgcactgtacctccaagtcagtattgtgagtcaggccctcatcttcgtcacccgttctcgcagctggtccttcatcgaacgccctggtcttctcttggtcactgcattcatgcttgcacaactggttgcgacattcctcgctgtctatgccaactggggctttgccaggatcaagggcattggctggggctgggctggcgttatctggctttacagcattgtgttctacttccctcttgacatcttcaagttcttcatccgctttgtgctgagtggaagggcctgggacaacctccttgagaacaagattgcattcaccaccaagaaggattacggtagggaggagagggaggcacaatgggccaccgcacaaagaacacttcacggccttcagccaccggaggtcgcctccaacacgctcttcaacgacaagagcagctaccgcgagctctctgagatcgctgagcaagccaagagacgagctgagatcgcgaggctgagagagctgaacactctcaagggccacgtcgaatcggtggtgaagctgaaggggctggacatcgacacgatccagcagaactacacagtgtgaggaaccccctcggcattcaacgagagatcgtcatcagcgctggagcgggaattgcaaacggcgctctggttaaaggaaattttcgatgaatgattggaagaacaaaaaacaaaaaaacatggctgatctgaacagccctagttgtaaagtgctaccaaatatatggtccggtttccctcttctagagaggttttacgttctagtggagtaccgtacgtacgtgttggagtacgacgacgtgttgtgatcgtttttggtctttttttactcttttccccctaactagcggtcttcttgcggaatgcaagatggagaaataatggatgaaaaattttctgccacgttaaaaaaaaaaaaaaaaaatgggtctgcttcaattaattcaaaaataaaaaacaaaaaaaaaaaaaaa

SEQ ID NO: 3036 - DNA, 2011 bp, Oryza sativa
  Clone ID: PAT_MRT4530_101198C.1
cccacgcgtccgcggacgcgtgggcgcgccaccgccaccgccaccgccaccctcgccgcggcgccgcctccactccactccaccgccgccgcctatataacccacctccacctcgcttccccggcctcgactccactgctccaccaccatgcaggcgcacgcccacacgctcgggctccgcatctccccgccgccgcctgcgccgccgcggcgccgcgctcgcccgcgccggcgcgcagtccgtgtcgccgcggcggcgtcggcgccgcggcgggagacggacccgaggaagcgggtggtgatcacggggatggggctggtgtccgtgttcgggaacgaggtggacgccttctacgagcggctgctcgccggggagagcggggtcggcgccatcgaccgcttcgacgccggcggcttccccacgaggttcgccggccagatacgcgggttctcctcggaggggtacatcgacggcaagaacgaccggaggctcgacgactgcctccgctactgcatcgtcagcggcaagaaggcgctcgagaacgccggcctcggcaagggctccgatggccacaccaagcttgacaaagtccgggctggtgttcttgtgggaactggcatgggtggcctcactgtgttttccgatggtgttcaaaaccttattgagaagggatacaagaaaatttcgcctttctttatcccatacgctataactaacatgtactcggcattgctagcaatggatgctggttttatgggtccaaactactcaatttcaacagcttgtgcgacctccaactactgcttctatgctgctgccaaccatatacgtcggggtgaggctgatgttatcgttgctggtggtactgaagctgcaattattccaattggccttggaggttttgtggcctgtagagcactatcgcagaggaacgatgacccagaaactgcatctaggccatgggacaaagagcgagatggttttgttatgggcgaaggtgctggagtactggtcatggagagcctagagcatgcgatgaagcgggatgcaccaataattgcggaatatttgggaggtgccgtgaactgtgatgcttaccatatgactgacccgaggtcagatggactgggtgtatcgtcctgcattaatcaaagtcttgaagatgcaggtgttgcgccagaggaggtaaattacatcaatgcacatgcaacttcaactcttgctggtgacttggctgaagtaagagccattaagcaagtcttcaagaatccatctgatattaaaatcaattcaacgaagtctatgataggccattgcctaggtgccgctggtgggttagaagctattgccgctgtcaaagccataactactggatgggtgcatcctactattaaccaatttaaccccgagcctgaagttgattttgatacagtagccaacgagaagcagcagcacgaagtgaatgttgctatctctaattcatttggatttggaggtcacaattcagtggtagtatttgcgccattcaagccatgatttccaattttttgcttcagaaattctattatcctgcagcattttctggcagttggtaattagtgaggaattgctaaatgtagcatatttgattttaccggccttcttcgtcaagggactaatattgattttagtataactgtgtatagcgttgttttgcataatttgcaattgattcctacctacttctgtataatggaaaatgtgggaatttctagaattgtcatgtagaagcaaaagttagatctcctgttccatagaaatgcttgagccaaggaattgcttgtctgtaatttgtatctggtctagaaaaatgttctcttcatttttttttcttgtccagtatgccaatgtccgtctagtggaataaaatgtattcagttttgcttaacttgctcggctaatagcttggttcgatgagatgaaatattctagatttcgcctgaatgtgtacaaaaaaaaaaaaaaaaaaaa

SEQ ID NO: 3037 - DNA, 4024 bp, Oryza sativa
  Clone ID: PAT_MRT4530_101539C.1
ggagatattatcttgggctgccttgccgtgcagtgtggctcgctgtcccactcaggtgcggcgctattccaatccgtgcttatccccggcagaatccaatccccctcgcggcttttctccaaaagcgctccgccttctcgcctatttcgctcgctgccgcggccatgattccccgctgatacctccgcgcgcccatttggttcctcctcgccgaatcccccttcgcagccggtggttctagttgaggaggaggaggaggggatttggttgggggcgagggggaggagggggttgtggagatgtcgtcgtcgcggtcgaacaaccgggcgacgtgctcgcggagcagctcggcgcggtccaagcacagcgcgcgggtggtggcgcagacgccgatggacgcgcagctgcacgcggagttcgaggggtcgcagcgccacttcgactactcgtcgtcggtgggcgcggccaatcggtcgggcgccaccaccagcaacgtctccgcctacctccagaacatgcagcgcggccgcttcgtccagcccttcgggtgcctgctcgccgtccacccggagacgttcgcgctgctcgcctacagcgagaacgccgccgagatgctcgacctcacgccgcacgccgtgcccaccattgaccagcgcgaggcgctcgccgtcggcaccgacgtgcgcacgctcttccgctcgcacagcttcgtcgcgctgcagaaggccgccaccttcggggacgtcaacctgctcaaccccatcctcgtccacgccaggacctccgggaagcccttctacgccatcatgcaccgcatcgacgtcggcctcgtcatcgacctcgagccggtcaaccccgtcgacctgcccgtcaccgccacaggcgcgatcaagtcgtacaagctcgctgccagggccatcgccaggctgcagtccctgcccagtgggaacctctccctgctgtgcgacgtgctggtccgcgaggtgagcgagctcactggctatgacagggtgatggcgtacaagttccatgaggatgagcatggtgaggtgattgctgagtgcaagagatctgatttggagccgtatcttggcctgcactacccagccactgacattcctcaggcatccaggtttttgttcatgaagaacaaagtgcggatgatatgcgattgctccgcaacgcctgtgaagatcatccaagatgacagcctaacacaacctataagcatatgcggatctactctcagggcaccccatggttgccatgcacagtacatggcaagcatgggctccgttgcatcacttgtgatgtcggtcactataaatgaggatgaggatgatgatggagacactgggagtgaccagcagccgaaagggaggaagctgtgggggttgatggtctgccatcacacaagcccgaggtttgtccctttcccgcttaggtatgcttgcgagtttctcttgcaagtatttgggatacagatcaacaaggaggtggaactggctgctcaggcaaaggagaggcacatcctccgcacgcagactcttctctgtgatatgctccttcgagatgctcctgttgggatatttacccaatcacctaacgtaatggatctagtgaaatgtgatggtgcagcattgtattaccaaaaccagctttgggtgctaggatcaacgccctctgaagcagagataaaaaacattgttgcttggttgcaggagtaccatgacggttctactggattgagtaccgacagcttagttgaagcaggttatcctggcgctgctgcacttggtgatgttgtgtgtggcatggcagctataaagatctcttcaaaagatttcatcttctggttccgatcccacacggcaaaggagattaaatggggaggagctaagcatgaaccaattgatgcagatgacaatggtaggaagatgcatccacgatcttcattcaaagccttcttggaggtagttaaatggaggagtgttccttgggaggatgttgaaatggatgctatccattctctgcagctaatattacgtggctccttgcaagatgaagatgccaacaagaacaacaatgcaaagtccattgttacagctccatctgatgatatgaagaagattcaggggctccttgaactgagaaccgttacaaacgagatggtgcgcctaattgagacagcaactgcgcctatcttggctgttgacatcactgggagcataaacggatggaataataaggctgcagaactcactggattacctgtcatggaagccatagggaagcctctggtcgatctcgtcatcgatgattctgttgaagtggttaagcaaattttaaattcagctttacaaggaatagaagagcaaaatctgcaaattaagcttaaaacatttaatcaccaggaaaataatggacctgtaattttgatggttaacgcctgctgcagtcgtgacctttcagagaaagttgtgggggtttgctttgtagcacaagatatgacagggcagaacattatcatggataagtacactcggatacaaggggactatgttgctatagtaaagaacccttcggagctcatcccccctatatttatgatcaatgatcttggttcctgcttagagtggaatgaagctatgcaaaaaattactggtataaagagggaagatgcagtagataaattgctaatcggggaagttttcacccaccatgagtatggctgtagggtgaaagaccatggtactctgaccaaacttagcatattaatgaacacagtgatatctggtcaagatcctgagaagcttctttttggtttcttcaacaccgatggcaagtacatagagtcactgatgacagcaaccaagaggacagatgctgagggtaagatcactggcgccctttgctttcttcatgtggccagcccagagcttcaacatgctctgcaggtgcagaagatgtctgaacaagctgctatgaacagctttaaggaactgacatacatacgtcaagaattaaggaacccactcaatggcatgcaatttactcgaaatttgttggaaccttctgacttgactgaggagcagaggaaacttctagcatcaaatgtcctctgtcaagaacagctgaaaaagattttacatgacactgatctagaaagcattgaacagtgctacacggagatgagcaccgtagatttcaacctggaggaagccctgaatacagtcctaatgcaagccatgccccagagcaaggagaaacaaatttccattgaccgtgattggcctgcagaagtatcatgtatgcacctctgcggggacaatttaaggcttcaacaagtcctagcagacttcctggcatgcatgcttcaatttacacagccagctgaagggcctattgtgctccaagtcatccccaggatggaaaatattggatctggaatgcagattgctcatctagagttcaggcttgtccatccagctccgggcgttccagaggctctgatacaagagatgttccgccacagcccaggtgcatctcgagagggccttggcctttacataagccagaagctcgtgaagacgatgagcggcacggttcagtacctccgggaatcagagagctcgtcgttcatcgtcctggtagagttcccggtcgcccagctcagcaccaagaggtgcaaggcttccacgagtaaattctgaacttagggctatggccaaaattcttgtgggtgctgtattgttgttgttgctgctgctgctattagcagatcaggcagtctgaggagtacgttagctgaagatgtatcagatgtgtgtagcttgtgaaagtgaaggtagtggttggatagatgtatttgtcacgttgatgtctggagagctagtgagcgagctactaggtgttagtgtaatttaaccggcaaatgtatgaacgaattatgaataaaatcttcacttgtgttgtcatgaaaaaaaaaaaaaaaaaaaaaaaaaaaaaaagggggggctcgtgc

SEQ ID NO: 3038 - DNA, 1390 bp, Oryza sativa
  UNSURE (1)..(1390): unsure at all n locations
  Clone ID: PAT_MRT4530_101669C.1
  unsure (1)..(1390): unsure at all n locations
ttttttttattttttttttttttttntttttttttttttttttaaaaaaggtatcatcacttcatcaagaacttatgtacaacagactgccttctgctttcacttaaaaagcaaaagttttacaacacaatttccttctcggagctaaatccatttggtaaaatggtacatttcccgcacaagaacaggatatgaatagtaccttgatatccagagtaaaaaggaaagaaatgaaagaagaaaaatgccgggaacaaccacaacggcatgcatccacaaccacaaccagatggcaatatgaggacatcaaactatgttgctattcacaagctagcttggtaccaaagctgctgaggctgatagcaaaggcttgaaacgctgagagtggctgccggtaatccatcgtgaagatattgtcatcgaccttaccaaactgcaacagaactgtttcctcatccttcgagctagcaggatcattgggatcagcagcagcaactagttggaaattcttgacagatgcaactgtcacccgcccatggaagttcaagcaccagcactgcaagtgctcatgccagcggggagctttgtttcttagaactgtgttccctgtgggttttctgaacttcgtctttagacagttttcccatgtctcttgagttgaagggcactcaagtgcacaatacattctcctaggacctctggatttgagcaggttgtatttataggaaacctgtccaacttcatagtttcctgctgacacttggggacttatccttctacttccaaaacgccgactggatcgactacttgatgctttagcgccatcatatggtggcttgctatcatatattttgaagtttgtcccccaaaaatcagatctcagtttccccatgtatgcattgcttccttgtgaaaggtcatcagcatcaagggatacgatgtactcggtatggggaccacgtctaaaccttctagcagccatgaggaacttccctttatccacagttgcatttgtcaaaccaaggtagaggtagaacgtagagttcttcttattccgcttaatgaaacattgcattgggaactcccttggccctggctgcttgagcgaggacgggaaggtgatcttgccggactccgcgggcggccgcacgacggcgacggcagcgtcccgccaccgccggcacacgcaggcgcaggagaccacgtccttccgcgcgggccaacgctcgcccccggacgcctccacgcgccgcaccacctcggacatcagctccggcagcagccgcgcccacctctcctcctggtcctccgcctgcccgtcctccccctccaccacctcgtgcacctcgccgccctccggcggcggcggcggcggcgtctcccgaggcat

SEQ ID NO: 3039 - DNA, 1404 bp, Oryza sativa
  UNSURE (1)..(1404): unsure at all n locations
  Clone ID: PAT_MRT4530_101732C.1
  unsure (1)..(1404): unsure at all n locations
ctcgatcgatccatccatcgatcgatcggtcccccccaccgcgcgcgacgcattccgccgccgtctcgccgtgtccacgtgatgggggccggggctaggggataggcggatagccagcagccaccaccaccagtagttgccgtgtggggataggtgtggctatagggctagtggtcgtcgctgatagcgaggtgggtagggttaattttggttggaggtagagagagagagagagggagggagggaggaggaggaggaggaggaggaggaggaagaacaggaggaagatggggcggggcaaggtgcagctgaagcggatcgagaacaagatcaaccggcaggtgaccttctccaagcgcaggtcggggctgctcaagaaggcgaatgagatctccgtgctctgcgacgccgaggtcgcgctcatcatcttctccaccaagggcaagctctacgagtacgccaccgactcatgtatggacaaaatccttgaacgttatgagcgctactcctatgcagaaaaggtccttatttcagctgaatctgacactcagggcaactggtgccacgaatataggaaactgaaggctaaggttgagacaatacagaaatgtcaaaagcacctcatgggagaggatcttgaatctttgaatctcaaagagctgcagcagctggagcagcagctggaaaattcgttgaaacatatcagatccagaaagagccaactaatgctcgagtccattaacgagcttcaacggaaggaaaagtcactgcaggaggagaataaggtcctacagaaagaactggtggagaagcagaaagtccagaagcaacaagtgcaatgggaccagacacaacctcaaacaagttcctcatcatcctccttcatgatgagggaagcccttccaacaactaatatcagtaactaccctgcagcagctggcgaaaggatagaggatgtagcagcagggcagccacagcatgttcgcattgggctgccaccatggatgctgagccacatcaacggctaaggaggcttcagatccataccagtaatcacaagttgcaacctgacccggtccggtcgcctgctgctctggtttactactagtactattgtcatcttgcggttgcgagacgaggaaagcattttagccctaaattcagcattagtagcaagctgcaatgtgtatattttggcttcgtccagcaccgtcttcctcccaccagtaatttacccatgtaatatatgcgagtagcatgaacaaattttcccgtttccaaccatctccattggtgtcatgtgtgacttaaatagcgaaatttcagcattgtgcatagtgtgattactgtaagataaataaactttgtagacaataagtctccgttatnttgctgataaaaaaa

SEQ ID NO: 3040 - DNA, 2024 bp, Oryza sativa
  Clone ID: PAT_MRT4530_102034C.1
cggacgcgtgggccagacctccaccatcgccaccacctccgcctcgtttccatcgccaccacctcctcccgccgccgccgccgccaccgccgcgatgcagagcctcctcctccccaccttcgccgcggcctccgccgcccccccgcggagggggcgcgtgcctcccgccggtcgcgcctcggtctccgtgcgcgcgtccgcgtccgcggcggcggtggcgccgaggagggagacggatccgaggaagagggtggtgatcacggggatggggctggtgtccgtgttcgggaacgacgtcgacgcctactacgaccgcctcctcgccggggagagcgggattggccccatcgaccgcttcgacgcctccaacttccccacccgcttcgccggccagatccggggcttctcctccgagggctacatcgacggcaagaacgaccgccgcctcgacgactgcctccgctactgcatcgtcagcggcaagaaggccctcgagtccgccggcctcgccctcggctccaaatccatggacaagattgaaaagactcgggctggtgtacttgtgggcaccggtatgggtggtcttacagtgttctctgatggtgttcagaatcttattgagaaggggcacagaaagataactccattcttcattccaggcgaagccgatgtgatgattgctggtggcactgaagccgcaattattccgattggtgtcggtgggtttgtcgcgtgtagagcactttcacagaggaacgatgaccccaaaacagcatcaagaccttgggaccaagaccgtgatggttttgtcatgggtgaaggagctggagtactggtcatggagagcctagaacatgcaatgaagcgtgacgcaccaataattgcggagtatttaggaggtgccgtgaactgtgatgcttaccatatgactgacccgagatctgatggccttggtgtttcgtcttgcattaagcaaagtcttgcagatgctggcgttgcaccggaggaggtcaactacataaatgctcatgcaacgtccaccctagctggtgatctggcagaggtgaacgccattaggcaagtcttcaaggatccatcagagattaaaataaatgcaaccaagtccatgattggacattgccttggtgcggctggtggcttggaagccattgcaactgttaaagctataaccactggatgggtccatccaagcataaaccagtttaacccggagccagctgttgaatttgacacggtacctaatgtaaaaaagcaacatgaagtgaatgttggtatctcgaattcctttggatttggtggacacaattcagttgtagtatttgcaccatttaagccttgattggacattgccttggtgcggctggtggctttggagccattgcaactggtgaagctataaccactggatgggtccatccaagcataaaccagtttaacccggagccagctgttgaatttgacacgggtacctaatgtaaaaaagcaacatgaagtgaatgttggtatctcgaattcctttggatttggtggacacaattcagttgtagtatttgcaccatttaagccttaacttgctgcatgttacacaaatcttggccagaatagtaaatgtcttttcaggaagttctgagttattctgcatgtcttttctttgggtgaagcaactgttgatttgacagccggcaacgttacaatgaactggatctgagattaattccattttaggcactcccatcttccattgaaattgagagctctgtataacgttgttttgcataatttgcaattgattctacctacttctgtataatggaaaatgtgggaatttctagaattgtcatgtagaagcaaaagttagatctcctgttccatagaaatgcttgagccaaggaattgcttgtctgtaatttgtatctggtctagaaaaatgttctcttcatttttttttcttgtccagtatgccaatgtccgtctagtggaataaaatgtattcagttttgctt

SEQ ID NO: 3041 - DNA, 1979 bp, Oryza sativa
  Clone ID: PAT_MRT4530_102156C.1
ctcacactgttacttcaccacgtctcctcctccattgctgcgccgcgccggcgacgacgcgacgacggtcacgacgcgctgagaggtttgttggtggtggcggcgagatgttggagaagaaggcgacgaggagtactagggtggatggggtgagcggcgaggcggtgatcgaggagttcgagcgggtgacgcgcgacgcggccaatgtgcagcgggagacgctgcggcggatcctcgccgagaacggcggcgtcgagtacctccgggggctgggcctcgccggcgccaccgacccggccaccttccgcgcgcgcgtcccgctcgccacccacgccgacctcgagccctacattgaccgcatcgccgacggcgacgcctcccccgtcctcaccgccaagcccgccacctccatctccctcaggtcagtgtccccgcccgccgccgcttgctgctctttgacctcgatcgagaacgtcgctgaccatggcggggatcacctcaccgccggtgcatgcagctccggcacgacgcaggggaagcgcaagtacctgctattcaacgaggagctcgtcaagtccacgatgcagatataccggatctcctacgcgttccggaacagggagtttccggtggagaacgggaaggcgctgcagttcatctacagcagcagggagacgaggacgaagggggggcttacggcgacgacggcgacgacgaacgtgtaccggagcgaggagttcaaggcgacgatgagggacatccagtcgcagtgctgcagccccgacgaggtgatcttcggcccggacttcgcgcagtcgctctactgccacctcctcgccggcctcctcgccgccggcgacgtgcagatcgtgtccgccaccttcgcccacagcgtcgtcctcgcgttccagacgttcgagcgcgcctgggaggacctctgcgccgacatccgccgcggcgaggtgtcgccgtcgcgggtcacctcgccggccgtccgccgcgccatggcggcgctcctcgccgcgcccaacccgggcctcgccgacgaggtcgcccgcaagtgcgccgccctgagcaactggtacggcgtcatcccggcgctgtggcccaacgccaggtacgtgtacggcatcatgacggggtccatggagcactacgtcaagaagctccgccactacgccggcggcctgccgctcgtcgccgccgagtacggcgcctccgaggggtgggtcggcgccaacgtcgagcccgggacgccgccggagcgcgccaccttcaccgtgctccccgacatcgcctacttcgagttcatccccctcaagcccgtcgccggcgacggcggctacgccgaggcggagcccgtcggcctcacggaggtcgccgccggcgagctctacgaggtcgtcatgaccaccttcgcagggctttaccggtatcggctgggggacgtggtgaaggtggcagggttctacaacgcgacgcccaagctcaagttcgtgtgcaggaggaacctgatgctgtcgatcaacatcgacaagaacagcgagcaggacctgcagctggcggtggacgcggcggcgagggcggtgctcgccggcgagaagctggaggtggtggactacaccagccacgccgacgtgtcgtcggacccgggccactacgtcgtcttcctggagctcaacgccgccgaccccgccgccgtcgacggcgacgtgatgcaggcctgctgcgacgagctggacagggcgttcgccgacgccggctacgtcgggtcgaggaagtccggcgccatcgccccgctcgagctccgcgtgctgcagcgtggaaccttccagaaggttctccgccactacctctccctcggcgcccccgtcagccagttcaagtccccccgctgcgtctcccgctccaactccggcgtcctccagatcctcgccggctgcaccgtcaacgtcttcttcagctccgcctacgactga

SEQ ID NO: 3042 - DNA, 1855 bp, Oryza sativa
  Clone ID: PAT_MRT4530_102188C.1
ccggccggggataaaaaccacggaattcccgggtcgacccacgcgtccggcctcatctgtctcatcagatcagcgtgaagcagcggcaagaacacaaaaatggcggacgagaagctcgccaagctgcgtgaagccgtcgccggcctctcgcagatcagtgacaacgagaagtccgggttcatcagcctcgtcgcccgctacctcagtggcgaggaggagcatgtggaatgggcaaagatccacacgccgacggacgaggtggtggtgccgtacgacaccctggcggcgccgccggaggacttggaggagaccaagaagctgctcaacaagctcgccgtgctcaagctcaacggcggcctcggcaccaccatgggatgcaccggaccaaaatcggtcatcgaagtgcgcaacggattcacattcctcgacttgattgtgatccagatcgagtccctcaacaagaagtatggcagcaatgtcccactgcttctgatgaactcattcaacacccatgaagacaccttgaagattgttgagaaatacaccaattcgaacattgaagtccatactttcaatcagagccagtatcctcgtgtggtagccgatgagttcttgccatggccttccaaggggaagacctgcaaggatggctggtaccctcctggccatggtgatatcttcccatccctgatgaacagtggcaagcttgatttgttactttcacagggaaaggagtatgtgttcattgcaaactcagataacttgggtgctatagtggacatgaagatactgaaccatttgatccacaaacagaatgaatattgcatggaggttaccccgaaaactctggctgatgttaaaggtggcacactgatctcatatgaagacaaggttcagctcctggagattgcacaagttcctgatgcacatgtgaatgaattcaaatccatcgagaaattcaagatcttcaacacgaacaatctatgggtgaacttgaaggctatcaagcgccttgttgaggctgatgcactaaagatggagatcattccaaaccctaaggaagtggatggagttaaagttcttcagttggaaacagcagctggtgcagcaatcaggttctttgatcacgcaattggtatcaatgttccaaggtcccggttcctaccagtgaaggcaacatcagatttgcagctagtacagtctgatctatataccttggttgatggctttgttacacgcaacccggccagaacaaacccatcgaatccctcaattgaactgggtccagagttcaagaaggtcgggtgtttccttggtcgcttcaagtcaatccccagcattgttgagcttgacaccttgaaggtttccggtgatgtttggtttggctctagcatcacattgaagggcaaggtgaccatcacagcccaacctggtgtcaaactggaaatcccagatggagcagtgatcgagaacaaggatatcaatggccccgaggacctttgagcgaaaggatgcagagttcacaaagagagatcatatcaccattccatataatcaatcaagctccacgacattgtggagaatatttttgatccaatattgcttcggcataaggaataacaaaattagtacatgtcttttacctacttgactttgcttcttgttctattttctccttgtgagtgggcaaacaagtcatgtcccggcaaaatatcatatgaacatatttggttacatatctgttcaacaatcagcaagaaaacaaaatgttataattccattaacgtttgtcactaaaacctgtgaaaaatcctaaaaaaaaaaaaaaaagggcggccgctctagaggattccaa

SEQ ID NO: 3043 - DNA, 4469 bp, Oryza sativa
  UNSURE (1)..(4469): unsure at all n locations
  Clone ID: PAT_MRT4530_102208C.1
  unsure (1)..(4469): unsure at all n locations
ccggccgggtatattaaagttgttgtggttaaaaagctcgtagttgaacaattccacacaaggtcttcttctacatctccacccaaattccaaatctctcggtgatcggagcggttagctgcggcgatgtcggggcgcggcaagggaggcaaggggctgggcaagggcggcgcgaagcgccaccgcaaggtgctccgcgacaacatccaggggatcaccaagccggcgatccggaggctggcgaggaggggcggcgtcaagcgcatctccgggctcatctacgaggagacccgcggcgtgctcaagatcttcctcgagaacgtcatccgcgacgccgtcacctacaccgagcacgcccgccgcaagaccgtcaccgccatggacgctcgtctacgcgctcaagcgccagggccgcaccctctacggcttcggaggctacacgagtacagattcgatggtgttgggcgtaacagcgctagcattattatggcgcgtgctccgggtgaggcgttggggctgccactccttgtgatctactcgcaggccggagaaaaaaaaaaaaaaaagccaaaaaagaaatcccaaaaaaaaaaaaaaaaaaaaaaaaaaaaaaaaaaaaaaaaaaaaaaaaaaaaaaaaaatcctccgccgggtggcgacccgccggcccggccgggatcacagaaaccataaacacacaggcatctgattagagaaatctaatggcttcttcttccttttccttcctgcttgttgctgctctgcttggattggcctcatggaaagccattgcctcagaccctagccctctccaagacttttgtgtcgctgatctgaattcgccagtgcgagtaaatggatttgtttgcaagaacccaatgaacgcgagtgccgacgacttcttcaaggcagccatgctcgataagcctagagacacaaacaataaggttgggtccaatgtcactttggtcaatgtcttgcagcttcctggtctcaatacccttggcatctcgatagcacgtcttgactttgcacccttgggtttgaacccaccacacacgcaccctcgtgcaaccgagatcttcacggtgcttgaaggaacactctacgttggctttgttacgtccaacccagataacaggctattgtccaaggtgctcaacaagggtgatgtgtttgtgttccctgaggggctcatccacttccagttcaatcctaacccacacaagccggcagttgccattgctgcactgagtagccaaaatcccggggttattactattgccaatgcggtgtttggatcgaacccacctatctcagatgatattttgatgaaggcgtttcaggtggataagaagatcatagatttgctccaagctcagttctagaagaacaactactgattgtcctgttggttgcaccattaaggacagtatactacatgcacctgatgctatgtaactatcatatatgatacgtagaataagtggggttttatgtgctgaaattgttatcatgcatgatatgctaaagcagtatgttattggacatggaaaaaaaaaaacagtggcgttcttttccctcgtaattaaaatgaaaagcaaacctcttgaagtccaagaaaaaaaaaaaaaaaaaaacagcaaaaaatttgcggccagnanacatnaaaaaatccttatcctcctgccaaatggagcgtgccgctgctgatcggagtggcgcggaggagggggagagcgaatggagggaggagctgcggcagcagcagtcgcaggtcgacgcactgcgggagaggctcgtggaggtcaaggtcgggatgaagtgctccgaggaggactcgaggaaggagctggatcacctctgccgcagggtgaagaccatcgccacgctgctggcctacctcaaatccaaggccaggatcatggcgataccgcacctcgcgcacacgtcctgcgggattaggcaccaggatggcgtggggtacgtcgacaggaacggggtgccactggctgattggtccaagggcggcgagtccgcttcctgcgagggtttagatgatgaaacgtcggcggatagtagtcgtgttgccgaacatggcgatgccaatgagggggatgtagatgtcgaagacattctgaagtcgatacatgtggtgaccgatgtcatggagacccttgtgaagagagtgattgttgctgaatcggaagccgctaacgagaaagagaaggtgaggatgggtctggaagagattaggaggaagaccatacaggttgagtccatgtcggccaaagttgaggaaatggagaaatttgcagtgggtacgaatggtatgctgaatgagatgaggcagagggttgaagacatggtgttggagaccactcgacaaaggcaacgtgcggctgaaaatgagcaggagcttagtcgtgtgaagcatgacttcgagtctctcagaacctatgtcggcactctcgttaatgtcagagaaactcttctttcatcagagaagcagtttgaaacaatggagaaactcttcgacaggctagttgcaagaaccaaccaacttgagagtgagaaagcacaaaaagaagccgaagtccagaaggtggtggaggagaatgtgaggctgcgtgcgatgattgataagaaggaagcgcagcttcaggcgatgagtgagcagtgcaagttcatggcgctgagccaagaagagctccagatagatgtggcgaaacaacggatggtgccaactgctggcgacctacgcgggcacgcggcgcagcgccccacccaagtcgtggacctcgtggtggtgaagggtagtaggcgacggcttcactactacccggccgggacttgtactgcgagccacacgccgcgcccgggcaaaacccacgcgaccccttcctcctccgcctcgacccgatccgatctgagccagagccaaccatggcggcgactagggtttggctctccgccctcctcctcgccttcctcctcgccgccgcccccgtcgtccaagttgccagagctcagtccgaggaagaagctgctacagctgaagttgttgatggggctgatctaggaatcgtcagtgatgatacacaagtttccagcgatgggcctctaagtccggctcctggtgtggagacagtatgtgtttttcccaaaaacgctggcaaaattgtgctagcaggtgaagaaactgaactactggttggcctgcaaaacgagggtgaatcaactttgaatgttgttgctatccattcaactctccatcttccttttgaccataagatgtatggacaaaaccttactgttcagaacttcttcaatgcatcagttcctgtctctgtacaagcaacctttccgtatacattcgccgtgagcaagttcttgcagcctggagcatatgatctagttggttacatagtgtatgagattgatcagaacccataccagaatgtcttttacaatggcactgtagaggttgttgaggctggaggtttactcagcgttgagtctgtgttccttattacccttggagttgcccttcttggtctcttcggattgtgggcatatggtcaagtacaacagctctcaaagaaaacaaagaaggcccccaaggtggaactgggaactggaactactgatgccaacatggatgagtggctggagggcactgcatttgcacagggaagcaaatccaagaagaagaaatagattggaggcccttgaactctagttaatcattttcaggatctagaatgagacagttgagggtagcccttcacaagtaacttttgcagacgatagatgagaaaatggaggtgttttaaaccgtagtttcgtggctgctgcacatgtttgttgacaccaaatttcgaccttgttgtgtacttttacatgaaagttttttcttgaaaaacacagttttgttcaaggtatatgctatggatgtgatctctgatcttatttgatctgtgacatgccgaataacataagttcgatctgagagatgctgaatcacataaatttttattagttgcaaaaaaaaaaaaaaaaaaacgtcccaactagctggatacttcctccgtcccaaaaaaaaaggcaaaccctgggttttcgtgtccaactttaacgatggacggtcaaacgttggacacggaaaccagggtttgtctttttttggacggagggagtacatatgacaagctgttacgcttgttcaatgatgccacttacgaattaccgtcactgcattgttgcaacaagaagagcagctccagatagatgtggcgaaacaacggatggtgccaactgctggcgagtccgttccaggtactctgtgctctgcaaacaaattgtttaccttaatgtaggtgtgatgtgttgggactgtaaacctgacatctttgtattcttgtaacttggaatttgtgtaaaaaaaaaaaccagggcacatttgtccg

SEQ ID NO: 3044 - DNA, 1467 bp, Oryza sativa
  Clone ID: PAT_MRT4530_102369C.1
atgggggagaacgtggttggcacgtactactacccgccttcggcggccgccatggacggcgtggagctcggccacgccgccgccggctccaagctcttcgacgacgacggccgccccaggcgcaacgggacgatgtggacggcgagcgcgcacatcatcacggcggtgatcggctccggcgtgctgtcgctggggtgggccatcgcgcagctcggctgggtggccgggccggcggtcatggtgctcttctccctcgtcacctactacacctcatccctcctctccgattgctaccgctccggcgaccccgtcaccggcaagcggaactacacctacatggacgccgtgaacgccaacctgagcgggttcaaggtgaagatctgcgggttcttgcagtacgccaacatcgtcggcgtcgccatcggctacaccatcgcggcgtccatcagcatgctggcgatcgggagggccaactgcttccacaggaaggggcacggcgacccgtgcaacgtctccagcgtgccctacatgatcgtcttcggcgtcgccgaggtcttcttctcgcagatccccgacttcgatcagatctcctggctctccatgctcgccgccgtcatgtccttcacctactccgtcatcggcctcagcctcggcatcgtccaagtcgtcgcgaacggagggttgaagggaagcctgaccgggatcagcatcggcgtggtgacgccgatggacaaggtgtggaggagcctgcaggcgttcggcgacatcgcgttcgcctactcctactcgctgatcctcatcgagatccaggacaccatccgggcgccgccgccgtcggagtcggcggtgatgaagcgcgccacggtggtgagcgtggcggtgaccacggtgttctacatgctctgcggcagcatggggtacgcggcgttcggcgacgacgcgccggggaacctcctcaccgggttcggcttctacgagcccttctggctcctcgacatcgccaacgccgccatcgtcgtccacctcgtcggcgcctaccaggtgttctgccagccgctcttcgccttcgtcgagaagtgggcggcgcagcggtggccggagtcgccgtacatcaccggggaggtggagctccgcctctcgccgtcgtcgaggcggtgcagggtgaacctgttccggtcgacgtggcgcacggcgttcgtcgtcgccaccacggtggtgtccatgctgctgcccttcttcaacgacgtggtcggcttcctcggcgcgctcggattctggccgctcaccgtctacttccccgtggagatgtacgtggtgcagaagaaggtgccacggtggagcacacggtgggtgtgcctgcagatgctcagcgtcggctgcctcgtcatctccatcgccgccgccgcgggctccatcgccggcgtcatgtcggatctcaaggtttaccgcccgttcaagggttactga

SEQ ID NO: 3045 - DNA, 1531 bp, Oryza sativa
  UNSURE (1)..(1531): unsure at all n locations
  Clone ID: PAT_MRT4530_102377C.1
  unsure (1)..(1531): unsure at all n locations
acagcactcctatctgctcaaccacttgcttggcttcctctgctccggcgaccgggcggccggcgggccggctgcnagaggtagcgccaggggcacagggctgcaattggaacctgaacttgaaagcaagttgtgcaagaggacagaaaagaatcagtctgaatatggctgccaagcatacgctcctccgctgctgtctcgcgcgagcgtcgtcgtcatcgcctccccgccccgactattcaggtgtaaacctcattcatttgctatgcaccagtacccgctcgcgaatcccgattcccaattccctactcccaaatcccaacctcccattcatcgggtcgtgtcgccgccgacgaacaacacggcgagcggcgccggtagcgagctacctaccctccatctctccagatcccttccagggacagtacaagacaagtcgcacaaaacagaaaatcttgtgatagtttaaatggcttcaaagcttcaagccttttggaaccatcctgctggccccaaaaccattcatttctgggctccgacatttaaatggggtattagtattgccaatgttgcagactttgctaagccacctgaaaagatatcctatccacagcaagttgctgttgcttgcactggagtcatttggtcacgctacagtatggttataacaccaaaaaactggaatctattcagtgttaacgttgcaatggccggcacaggcttgtatcagctttcccgtaaaataaggaaagattacttttctgatcagaaggatgatgttgcatcattggaaggataatgatgactgacatgatgaaaacccggcccacaacctttgagcgatactcaactcactctgaattgcagagacgcgtcgttttctccaagacaggaacctgtcgtttgtttctatgtttctcttgcaccaatttatggatcgatctggaatgttacatcccaaaaaaaaaatcaaataatctttttgacaatctctgcgaataaatgtgcaaatacatcaagtagtctctcctttatgtttctccgttgtttattcacatgttttgctaagaagctgttacagcgaacaatctttctgtttgctatctgaagttactacattgtaacctggctttcagctttcagattaccgtaccctgtctggtaatcgaatgattaaagtttgctgtgattttctgatgtgttgctctgcctggcgcccgccgggggcggcggcgtggagggggcgcgacccccggtcccgccaccgctcgccgccgcgcccctcggtgtccgcccacgagcacgtttccgcgagctcgccgccggcccacccggggaggagctccttcaccgccgtcgccgcctccttcgtcaggaaaccctcggcgatcttgcacaccatgtagtggccctccttgccccacgcgtgggccgtgggggctctcgccatggccgcggcgacgacgacgacgaggaggagggggagcacgcgcgcggccatggttgctctgcggcacgaggcctcgggccg

SEQ ID NO: 3046 - DNA, 1047 bp, Oryza sativa
  Clone ID: PAT_MRT4530_102380C.1
cccaaatcccaacctcccattcatcgggtcgtgtcgccgccgacgaacaacacggcgagcggcgccggtagcgagctacctaccctccatctctccagatcccttccaggtgagagcccgccgcccccaccctcccctcccctcccctccctttcgccgcggacgcctcgctcttcgcctcttcgccgccaccgctttacccccgccgcgcttgatacattcagaatctggcctgctcgcgtgaaccgatccgaggccccctgaatcatgttgttgtttgaacgaatctgattgatgtcctgggacagtacaagacaagtcgcacaaaacagaaaatcttgtgatagtttaaatggcttcaaagcttcaagccttttggaaccatcctgctggccccaaaaccattcatttctgggctccgacatttaaatggggtattagtattgccaatgttgcagactttgctaagccacctgaaaagatatcctatccacagcaagttgctgttgcttgcactggagtcatttggtcacgctacagtatggttataacaccaaaaaactggaatctattcagtgttaacgttgcaatggccggcacaggcttgtatcagctttcccgtaaaataaggaaagattacttttctgatcagaaagatgatgttgcatcattagaaggataatgatgactgactagattaaaccgatctacatcctttgagcgagtctcagcttactctggagtcttggactgcagatatctctggctttacccaagacaagaacctgttgtttctttctgaatttcttctgcacccactgctggagcagttgaaaatactgtccccaaaaatccaaaataatcctttttttgcattttgtgaaaataatatgcatatactcaaaacatccctttctgttatgctggtggtgcccattaaaatttgtatcggggatacttcgctaacagtagtcaaggatctctctgtttgcaatctaaagccacttctgttatcatcagaaagaagctatatactacaatttcccc

SEQ ID NO: 3047 - DNA, 3490 bp, Oryza sativa
  Clone ID: PAT_MRT4530_102471C.1
cctttttttttttttttttttttttttttttttttttttttaaacagccacaacaaggaacatgcatgtctggatgcaacatttgcgtttttttatgtgttcgtttgtgatcatcaaagatggtcgattaatcaacaagttctctgcaaaaatgaatttatatggcagttgccggcggcggcgcgtcgagctccctgagcatggcgaccacctgcagcatgtttgggcgctttgaggggaagtcgtcgacgcactgcagcgccatgtccatgaacctggccatctcgtcggcgtcggcgccctcgacgacgagctccgggtcgagcacctccttcccggcgccgtccccgaccttcatcttgacccagcccacgaggttggtgtccccgaagtcgtccttgtcggtggggcggcggccggtgagcagctcgaggaggacgacgccgaaggagtagacgtcccccttcaccgtgcaccggaagctctggtagtactccggcggcacgtagcccggcgtcccggcgagcgtgctgacgctcaggtgcgtgtccagcgcgctgatgaggcgggccatgccgaagtcggcgacgcgcgcctccatgtcgccgtcgaggagcacgttgctggacttcatgtcgcggtggatgatgtgggggatgcagttgtagtggaggaagcacaggcccctcgccgcgccgcgcgccaccttcttccgctgctcccacgacatcgccggtgatgccgatctgccgccgtcgccgtgcagcgtgtcctccaggctgccgtggctcatgaactcgtacaccagcagccgctcctcgccgatcttgcagtagccgaggagggggacgaggttcttgtgcttgatcttgcccagcgtctccatctccgccatgaactcgcggtcgccctggtagctcaggtggatcagcttcttgatcgccacgcacgacccgtccttgagcgtcgccttgaacacctcgccgaacccgccggagccgatcaggctggcggtggagaagccattggtggcctcgatcagctgcgtgaaggtcagcttccggagctgccgctggaacgtcgccacgttgatgctcagcgcctccttctccgccttcccgagcttccatgtcgtcgccgtccgcgtcccgtcctggaggctgctcagcatcatcgccgagcgcacctcacgccgccgcgcccgcgccgccaccgcccatatcgccgccgcgcacgccagcccggccgacaccagcacggcgaggatcacgccgttggcccacgtcgccacggcgcgccgtgggggcggatccgtcgacgccgcggcggcgagcccggacatggtcgccgtcgggaggcggtcgccgcagggctccagcggcatgccgcacagccccgggttgccggcgtactggctcgccggcagcgtgctgagctggccccgctgcgggatctcgccggagaggttgttgtcggagatgtcgatctggacgaggaaggagaggttggagaaggagtccgggatgccgccttgcagccggttgcgcgacacgtcgaacacgccgaggttgcggaggcggccgagcgacgccgggatctcgccggtgaggttgttccgcgccaggtcgagcacctggagcacgaccatgtcgcccaactcctcggggatctcgccgtcgaggctgttgtacgagaggtcgaggtactccagcgtctggtaccgcgtccacccgctcacggcggcgccggagtagagccgcgtgaagtcgcagctcttgagggtgggcacctgcagcagccgctccggccggattccggcgaactccagcaatcccccaactcccttgcacgagttgccgacgttgcggacgaacgccagcgtgttcccggacaggatgccgctgagcggcgtggagccgagctggcggccgaggcggcgagggatctcgccggtgaggcggttgctgttgaggtccaaccacatgaggctgctgcagttgccgagctccctggggatctcgccggcgaggctgttgttcgccagctgcagcacggcgaggcgggacagccgcccgaactccggccggatggtgccggtgatctggttgctcgtcagcgacacccactcgaggccggtgcagttgaagagctcgacggggatgtcgccgccgatgaagttgttgttcaggatcagcgtccggagattccggcattgcccgagatccgccggaatccggccgtcgaggccattgaaccacatcaccagcttctccagggcgcggagccggccgagctccggcgggatcgggccgcgcaggtagttgatgctgaagtcgatcacccgcagccgcgagcagttggacaagcccggcgggatcgtgccggcgacgaggttgtccggcagccggagctcctccagcgccgcgccgggcgagcagagctcggccgggagcgcgccggagatcttgttgctgctcaggtcggcgacgcggaggttcttgcagtgggcgatggtatccgggagagagccggagatgaagttgttgctgaggaggaggctctcgaccgccgtgaggttgccgagcacggcggcagggatcccgccggagacgttgttgttggcgacgtcgagcagccggagcgcgtggcacgacgacagcgactccgggatggagccggagatgttgttactcgagacgcggaggacacgcagcgacgcgcacgcgttcctcccgaggccgggcgggatggcgccggtgaggtggttccacgacacgtcgagcacttcgagcccggcgatggcgccgattccctccggtatcgcgccggcgaggccgttgtacgacaggttgagcgtcgtgaggcccgcgcagccggacagcgacggcgggatggcgccggtgaagcggttgccggacaggtcgaggacggccagcgtcgcggggagcgacacgccggagatgtcgccggacatgttgttgccggacacgtcgaacgaccggatattgctcgccaggagcatcccgggaagctcgccggtgaggttgttcctcgcgaggctgacatcggtgaggttggggtaacacgccagaaagccgtcgggaagccggccggcgaggccgccatcggagaggtcgagctgcagcagcgcgcgcgggagcttaaccaggtcaccggcatcaacgtgcagctcgccattgccggagaggttcaacctgcacaacgtgtcgagaccagagagggcggcaagctcggcgcgcccggcgaggccgccggcggcgaggtcgagctccgtcaccctgccgtcgccgttgcacgtcacgccacgccagcgacatggaccaggatccacccacgacgagaggactcctctaggatccttgtggacgaacgccttgaagcggaggagcgccgccgcatcggtttccgccgccgccgccgacgacgacacgtagatcgaggagaggagaagtgggatgagaatgtccat

SEQ ID NO: 3048 - DNA, 817 bp, Oryza sativa
  Clone ID: PAT_MRT4530_102501C.1
ccccgcgtccggaagaaggggagaaaataaaaagctcaccggcggcttctctcctctcgccggtcgacggcgcgatgctgcgcggattccctcaggcccggaggctcctcaggaggatggggttggagaaggaagacgcctacttctggaagcagatgggcaagggcatgctctgcacctacgcgctcttcggcgccgcctggctctggaacgagacctctcccctcggctggtggacgctcaagccgcgccccaaggaagaaagagaaatggcccacctttacgagcgcaggatgtttccatacccaggtgatgaagaggcagttgaggagttcataaaaagtggaggtgctctaggcaccacaattggacccaaaggttttgctgattccaacatggactctgataacatgcagaaacaattgcagtcaaaaaagtttgaccaagaagcacagaagctctggtttcggatgaggaatgaggtcgtacaagaactccaagagaagggattcgatgttgaatgaaattttacttctacataaacagaaatggagtaaagctgaagtatgtgcaaattgtttcagcttgttagccgtctaggaaattaggagcttagaatgcacgcaaaatgttaaaacacctactttgcaatctggagatttttttttttaatttgagaaagcaatctggagaatctagagagtttactattcaacttcaatttggtcttgttgggtcattgcattccatcagttacagattttgtaccttaaagatatggtatcagttaccagtatctccacgcgtttcagttttg

SEQ ID NO: 3049 - DNA, 1280 bp, Oryza sativa
  Clone ID: PAT_MRT4530_102600C.1
ttttgttgtgttgtttttgctccgtactccttttgaaataaaaccacaaccgtagtatagttttaaatcacaatcttacaagctgcaattacccatagctgaagtccaaattttgtggttctagtatattttttttttttttttttttttttttttaagcaaagggaaccaagtttgcattaaggtttagtactcaatcaaagttaacaaccgaccacaaatacagtgttccaatgactgaagcagtacgaggaaaccattacacagatggattgctgatatatgaaaagcttgactaaaacctacacggtaactaggactcatcacacaaaagtccagtttaaactaaggatgctcctgtcctaatcttcactctttggaggacttgttgatcagggacttgtggatgtgaggaatgacacctccaccagcgatggtacccttgatgagagtgtcgagctcctcatctccacggatggcaagctgcagatggcgaggggtgatacgcttgaccttcagatccttgctagcgttcccagccagttccagaacctcagctgttaagtactccagaatagcagcagagtaaactgcggcagtagcaccaacacgtccatttgcctgagtcctttgcttcaactggcgatggatacggccaacagggaactggagaccagcgcgggacgagcgggagacgggggccttcttccccttgtccttctccgccgacttggcggccgtcgtcttcgcggcgagcaagcccttacctccttttcccgccatcgctctctctccctctccctctccctctcctgtctcctccccttccgctccgctcgaacgcccgcgcgaccccggcggcggaaaccctttcgcgagctcgcggagcctcggcttcctcctctcctaccccctgacgcgacgcggacgaaagcgagatttttttttcccggcggcgaaatccgcgcgggaagcggaggaatttgggggcggattcggggcggcgaggaggcggaaacccccggtcccctgcagcccggggatgctcctgtcctaatcttcactctttggaggacttgttgatcagggacttgtggatgtgaggaatgacacctccaccagcgatggtacccttgatgagagtgtcgagctcctcgtctccacggatggcaagctgcagatggcgaggggtgatacgcttgaccttcagatccttgctagcgttcccagccagttccagaacctctgctgctattctggagtactacagcctcgtgccg

SEQ ID NO: 3050 - DNA, 887 bp, Oryza sativa
  Clone ID: PAT_MRT4530_102751C.1
cccacgcgtccgcccacgcgtccgagcttctagctgtgatcaagcaaagaagaattgaaaaaaaacatatatatattatatatatggcaggggtgtgggtgtttgaggatgggatggtgaggagggcagatagcgaggcgccgtcgagagggcgcggtgtcggtggtggaggtgggggagggaaggtgcttgtgcacgtgccgagcagcgaggtggtgacgagctacgaggttctggagaggcggctgcgggagctcgggtgggagaggtacctcaacgacccgtgcctcctccagttccaccagcgctccaccgtccacctcatctccgtgccccgcgacttctcccgcctcaagctcgtccacatgtacgacgtcgtcgtcaagacccgcaacgtcttcgaggtccgtgacgccgccaccactgcttccccgccatgatcgcatcgatgtctatgctttgatcatcatcgatatgaccttcctcgactccgggctcaggccagacacgccgccatggcgcctacaatcgtatgtgtgtattgtatgaatctcaattcaggtaatgaatgattgtatatcatatgatttgtaattctgtacaggtataacgtatgcgtatatacgtacgtgtgcgatcgatcgggtgtgtgtgatatatattaaaataagcgtggctggtttaattgcaagtgagtgtttagttatttaattatacgagagccatgagcacgtgtgtagctagctttggagtcttgtactttgtggtttggagccattgcttgactgattccgtggcacgaatcaatcatccatgcgttatgcagtgacaataaataattagttttgtcacaattaattaatagtatgttgtttgctgtattgatt

SEQ ID NO: 3051 - DNA, 1259 bp, Oryza sativa
  Clone ID: PAT_MRT4530_102917C.1
ccgccggccggggggtcccctccccttcccccctcccctccggcgaactccgagctcttcccggtgagcgccgccgattcggccggagaggctcgccggagtcgcctccgccctgcccacgatggccgccaacttctggacgtcgtcgcactgcaagcagctgctggaccaggaggacgtggacaaggtcccccaggcggacagcgaccggggcatcacgctggaggagttccgcctcgtcaagatccacatgtccttccatatctggcgattggcacaacaggtgaaagttagacaaagggtgatagctactgctgttacttatttcaggcgtgtatacacaagaaagagcatgactgaatatgatcctcgtctggtagcaccaacctgtttgtatttggcatcaaaggtggaagagagcacagtgcaagcaagacttcttgtcttttacataaaaaagatgtgtgcttctgatgagaagtaccggtttgaaatcaaggatatccttgaaatggaaatgaagctcctggaggcacttgactattatttagttgtttaccacccatatcgtcctcttttacagttattgcaggatgctggcataacagatctgacacaatttgcctggggaattgtcaatgatacttacaagatggatcttattctcatacacccaccatatatgatagcattagcctgcatctacattgcaagcgttcttaaagacaaggacataactctgtggtttgaagagctccgtgttgacatgaacattgtcaagaatatctcgatggaaattttggacttctatgacacctacaagattgatcctcaaagagggctcccagaggacaaaatagcccctgtgatgaacaaactgccttcaaaggcctaaagcagactgagccctagttcagttgttatcagtctgagcgtcaaatcaccttatgctcgtacaacaggaaatatgtgtcaccttccttggagaactttatatttcaaagccatatatatatatagtatcagaattcagaattgcccctaacgaacgatttaattcagaattccgaactatatacagctgttcctgttgcagcagcttgcgaggcaaatcatttacaatgaagatcccaacgggttgggaatggtctgtatctgtatgtgtttttgatgtgtaaaaaaaaacatggctttggtactatttagtttctatagcaaatgaaatcctgaaaaattcttgcggtgaaaaacaccaaaac

SEQ ID NO: 3052 - DNA, 834 bp, Oryza sativa
  Clone ID: PAT_MRT4530_102919C.1
atggccgccaacttctggacgtcgtcgcactgcgagggcagcaagcagctgctggaccaggaggacgtggacaaggtcccccaggcggacagcgaccggggcatcacgctggaggagttccgcctcgtcaagatccacatgtccttcctcctacaaattaaggcaaatcatttgatgatttcagatatctggcgattggcacaacaggtgaaagttagacaaagggtgatagctactgctgttacttatttcaggcgtgtatacacaagaaagagcatgactgaatatgatcctcgtctggtagcaccaacctgtttgtatttggcatcaaaggtggaagagagcacagtgcaagcaagacttcttgtcttttacataaaaaagatgtgtgcttctgatgagaagtaccggtttgaaatcaaggatatccttgaaatggaaatgaagctcctggaggcacttgactattatttagttgtttaccacccatatcgtcctcttttacaatgctttgattttaggttattgcaggatgctggcataacagatctgacacaatttgcctggggaattgtcaatgatacttacaagatggatcttattctcatacacccaccatatatgatagcattagcctgcatctacattgcaagcgttcttaaagacaaggacataactctgtggtttgaagagctccgtgttgacatgaacattgtcaagaatatctcgatggaaattttggacttctatgacacctacaagattgatcctcaaagagggctcccagaggacaaaatagcccctgtgatgaacaaactgccttcaaaggcctaa

SEQ ID NO: 3053 - DNA, 200 bp, Oryza sativa
  Clone ID: PAT_MRT4530_102927C.1
atcggacgctacctaaagaagggccgctacgcccagcgcatcgggaccggcgccccagactacctcgccgacgagctagagtacctcgctgccgaggtgctggagctcgccgggaacgcggtcagcgacaacaagaagaacaggatcataccgcgccacgtgctgctggcgatcaggaacgacgaggagctctgcaagct

SEQ ID NO: 3054 - DNA, 2388 bp, Oryza sativa
  Clone ID: PAT_MRT4530_102993C.1
atgggtaagttcctgtgcccactcttcatttccttcatctccgttcttttgtgctgcgccgcatctgcatccccatggcaaaccacaggcacaggtacatctctccaggtagatcatggagaaaccttccttgtttcaccagacacaaccttctcctgcggcttctacccatctggagatgacacaaacgccttctacttctccatctggttcacccatgccaccgacaggacggtggtctggaccgcagactctggccttccggtgaacggccatggctccaagatatccctgagccatgagggcaacctggcttttaccgatgtcaatggcaccacggtctgggagagcaagactggctggggcaagcacaccacggtggctctgctcaacagtggcaatatggtaatgaaggcatccgactccgaggataagatcgtgtggcagagcttcgactggcctactgacaccctgctaccatcgcagcgtctcacaagagagaagaggttagtctcccaatctggtaaccatttcctgtatttcgacaacgataatgtcctccggctccagtacaatggaccagaaatcacaagcatatactggccaagtccagactacaccgcagtgcagaacggccggactagattcaacagcagcaagatagcggtcctggacgacgagggcaggttcttgtcaagcgacgggttcaaaatggtagccctggattcaggtttagggatacagagaaggatcacaattgattatgatggcaacctcagaatgtacagcttgaatgcatcagatggcaactggactatcacaggggaaggtgtattgcagatgtgctatgtgcatggattgtgtggaagaaatggaatttgtgagtactcaccaggtctcagatgtacttgtcctccaggatacgagatgactgatcccgagaactggagtagaggctgcaggccaacattcagcgtcagctgtggccagcaacgcgaggattttacgttcgtcaagattcctcatggtgactattatggctttgatctgacttcaaacaagtcaatctcgcttgaagaatgcatgaggatttgtatggacagctgcgtgtgcttatcttttacctacaaaggtggagatggtctatgttacactaaaggcctgctctacaatggccaggtttatccatattttcctggagacaactacatcaaacttcctaagaacgttgcttcaacatccttgatctccaaacatcatggtcttacctgcaagccaaatgcttcaaaagttatgttagtatccatagatgcatacagaaaaaattctgacaacataatgtgggcatacttatatgtttttgctactataataggagcagttgagttggtctttatcatgacagggtggtactttctttttaaaatgcataacatacccaagtccatggagaaaggttacaaaatgataacaagccagttcaggaggtttacataccgcgaattggtggaagcaacgggaaaatttaaagaagagcttggaaaaggtggcagtggtacagtttacagaggaatacttggggataagaaggtggttgcagtaaagaaacttacagatgttagacagggtgaagaggaattttgggcagaagtgacgttaattgggaggatcaatcacataaatttggtcagaatgtggggattctgctcagagggtcgtcagaggttattagtctacgagtatgtggaaaatgagtcattggataggtacctttttgatgacagtggcaccagaaatttgctctcatggagccaacggttcaagattgccttaggaacaactagaggccttgcctacctccatcatgaatgccttgaatgggttgttcattgtgatgttaagccagaaaacatactgctgaaccgagattttgaagccaagatagcagactttgggctatccaaactttcaaagagagacagttctacctttaacttcactcatatgagaggcacaatgggctacatggcaccagaatgggcactgaatttgccaatcaatgcaaaggtcgatgtttacagctatggggttgtgcttctggagattgtgactgggactagagtttcaagtgggataacaatagaagaagaaaacatagacttgatgcaattcgtgcaggtggtaaaacagatgctcactagtggtgaggtcctggacactatagtagacagtaggctgaaaggccatttcaattgtgatcaagcaaaagcgatggtgaaagcagctatttcatgtcttgaggaaagaagcaagaggccaacaatggatcaaatcgtaaaagatctcatggtatacgacgatgaagattatcacccagcatacttttga

SEQ ID NO: 3055 - DNA, 305 bp, Oryza sativa
  UNSURE (1)..(305): unsure at all n locations
  Clone ID: PAT_MRT4530_10588C.1
  unsure (1)..(305): unsure at all n locations
accccagcaaaaaaaccaacnagcnaggccggccanggagacggnggccgcggccagcaacacccgcggggcggcgacgcgcccgccagcgngcagcgccgccaagnccnncncgcagnccaacaggcccaaggccgcnagaccgccgagcacgnncaacggcgagncgcngcgggnaaacacggcgaggncgcngccgncagggaggcagnccaaggcggcgagccgggcggcgcgcagcacccggngcgagaacggggacagccnggaggagnnccagaccaaggcgacgccggaaaagaacc

SEQ ID NO: 3056 - DNA, 752 bp, Oryza sativa
  Clone ID: PAT_MRT4530_1065C.1
ccggccggggctgtcgcggatccatcccatcccatctcttcctcgtctcccactcctccggattctttctgttcttggttgattgccggagatgtcggattcggaggagcatcacttcgagtccaaggccgacgccggcgcctccaagacctacccacagcaggccggcaccatccggaagaacggatatattgtcattaagaaccgcccctgcaaggtggttgaggtctctacttccaagactgggaagcatggtcacgccaaatgccactttgttggtattgacattttcaatggaaagaagcttgaagatattgtcccctcatcccacaactgtgacgttcctcatgttgatcgtactgattaccagctgattgacatttcggaagatggatttgtgagccttttgactgagagcggcaacactaaggatgacttgaggcttcccactgatgatactctgactaaccagatcaagaacgggtttggtgaagaaggcaaggatatgatcttgactgtgatgtccgccatgggtgaagaacagatctgtgccgtcaaggagattggggccaaaaactaagcggctttgctcgattgcctgcctgcctacgatactttgctatcttagtgttgagagctgagacacataaatagaagttttttttatgctacctgtggatgaaatgacgatcaaaaccttcatcgattttatgttacactggatggtcatgagatacttgttaatgcttttt

SEQ ID NO: 3057 - DNA, 1732 bp, Oryza sativa
  Clone ID: PAT_MRT4530_10807C.1
atggcggtgcaccactccctcgaggtggccgccgcaggaggcgacggcggcggcggccgatgctacgacgacgacggccacccggcacgcaccgggacggagtggacgtgcggcggcgcacgtgatcacggcggtgatcgggtccggggtgctgtcgctggcgtggagcgtggcgcagctggggtggctggcggggccggggatgatgctcgtgttcgcggccgtgacggcgctgcagtcggcgctgttcgccgactgctaccgctcgccggacccggaggtcggcccgcaccgcaaccgcacctacgccaacgccgtcgagcgcaacctaggtagctcgagcgcgtgggtctgcttgttgctgcagcaaacggccttgttcggctacggcatcgcctacaccatcaccgcctccatcagttgcagggcgatcctgaggtccaactgctaccacacgcacggccacgacgcgccctgcaaatacgggggtagctactacatgctcatgttcggcgcggcgcagctgttcctctccttcataccggacttccacgacatggcgtggctgtcggtcctcgccgcggtcatgtcgttctcctactcgttcatcggcctcggcctcggcctcgccaacacaattgctaatggaacgatcaaaggaagcataacaggtgctccaacgagaacccctgtgcagaaggtctggcacgtctcgcaggccatcggcgacatcgcattcgcgtacccgtactcattaatcctcttggaaattcaggacacactgaaggctccaccggccgagaacaagacgatgaagaaggcgtccatcatctcgatcgtcgtcaccaccttcttctacctctgctgcggctgcttcggctacgccgccttcgggagcgacgcccctggcaacctcctcaccggcttcggcttctacgagccctactggctcatcgacttcgccaacgcctgcatcatcctccacctgctcggcggctaccaggtgtacagccagccgatataccagttcgcggacaggttcttcgcggagaggtacccggcgagccggttcgtgaacgacttccacacggtgaagctgccgctgctgccgccgtgtcgggtgaacctcctgcgggtgtgcttccggacggtgtacgtggcgagcaccacggcggtggcgctcgccttcccctacttcaacgaggtgctcgcgctgctcggcgccctcaacttctggccgctcgccatctacttccccgtggagatgtacttcatccagcgccatgtcccgcggtggtcgccccggtgggtcgtgctgcagtcgttcagcgtcctctgcctcctcgtcagcgccttcgcgctcgtcggctccatccagggcctcatcagccagaagctaggctaaagatttagcctagcatcctgaatttcggatttgctttttctttgtgtaaccgtaatgggatgagaatgcatttggtggtcgtgtgttgtttgtaacaactggggagcggagctttgtccctggtgaatggcgcgatgaactcatgaacaatagcatagtggtggtggtacattgtgtctgcaggggtcagagggtggtggcactctgtttttcagtgcctttcctcctgtgctgcagagaaactgctcctatatatgtacagaatgtcgtcatattattgccatgatacttggaacggtgaaaggaacctgctcttgaatgatgtat

SEQ ID NO: 3058 - DNA, 246 bp, Oryza sativa
  Clone ID: PAT_MRT4530_10972C.1
gttcgagccaggggagctcaagtcgtggtctttctaccgggccgggatcgccgagttcgtcgccaccttcctcttcctctacatcaccatcctcaccgtcatgggggtcttcaagttcttcttcaagtgcgccaccgtcggcattcagggcatctgctggtccttcggaggcatgatcttcgcgctcgtgtactggaccggcggcattttcggaggacacaataacccaacagttacttttgggct

SEQ ID NO: 3059 - DNA, 1152 bp, Oryza sativa
  Clone ID: PAT_MRT4530_11027C.1
cacgagggagacactgtgtcagtcactgagtcacactcacagtgccactgatccgccatgagctagctcaagcgctgcggcaggcggcgcgcgggtcgccgccgccgccgccccgccccccccccccccaggcgcgtcggttccatcgccaccggccgggccggcctcccctcctcccccctcgccgtcgccgccgccgccgccgccgacgccgccgcgaccacctctcgcaaggggattttgtaggggtttctgatccgaggagcgggcgatgtcggactccgaggagcaccacttcgagtcgaaggccgacgccggcgcctccaagacctacccgcagcaggctgggaccatccgcaaaaatggctacatagtcatcaagaaccgcccctgcaaggttgttgaggtttcaacctctaaaactgggaagcacggtcacgccaagtgccactttgttgcaattgacatctttactgccaagaagctcgaagatattgtgccatcttctcacaactgtgatgtcccgcatgtgaaccgtacggagtaccagctcattgatatatctgaggatggatttgtgagtctgttaactgaaaatggcaacaccaaggatgacctcaggctccctactgatgataacctgcttagtcagatcaaggatggatttggagaagggaaggacctggtggtgactgttatgtctgccatgggagaggagcagatctgcgcgctgaaggacatcggcccgaagtaaacctcacctgttccatgtgattactactgaactttcagttatgatcggtttgggtatgtaggaacaaggattctcttaaaacatacagagtcacaaccattaaggaattgtatcacaaaactcgtccccgccagtcaggctcttatttatctgggtctcgtcgtcgattcactgtcctaaatttcctgagttcctgtacccctaaaccaccatccctagacgttttgttaaccctttgggtatttggtagcaactttcattgtggagttggattgtgtgcttaaggtgaaaatatcatttgtgataaaccaaaaaaaaataaaaagctgtcaccatgaccactgctattagcatctgcagatgcaacttttgacagttaaaaaaaaaaaaaaaaaaaa

SEQ ID NO: 3060 - DNA, 1432 bp, Oryza sativa
  Clone ID: PAT_MRT4530_11056C.1
ccccgggcgccaggggcgcggcccgagggaggcacttttcaggctggcaccttggggtagcgggcgccgcagtcccgtcggggggcggaccagcgagcaaccagccccccgcccccaatggcggcagcagcagcagctttgcccaccgctgccgcttttgcccacctctcctccgattaatcccctcccctcctcttcctcccacttctccgcctcctcttcctcccctcgccgaccctacctactcgcgccgccgccgtcgcattgggcggcaaacggagggggggttaaccctgatggagcagtacgagaaggaggagaagattggggagggcacgtacggggtggtgtacagggcgcgggacaaggtcaccaacgagacgatcgcgctcaagaagatccggcttgagcaggaggatgagggcgtcccctccaccgcaatccgcgagatctcgctcctcaaggagatgcatcacggcaacatcgtcaggttacacgatgttatccacagtgagaagcgcatatatcttgtctttgagtatctggatctggacctaaagaagttcatggactcttgtccagagtttgcgaaaaaccccactttaattaagtcatatctctatcagatactccgcggcgttgcttactgtcattctcatagagttcttcatcgagatttgaaacctcagaatttattgatagatcggcgtactaatgcactgaagcttgcagactttggtttagccagggcatttggaattcctgtccgcacgtttactcacgaggttgtaaccttgtggtatagagctccagagatccttcttggatcaaggcagtattctacaccagttgatatgtggtcagttggttgtatctttgcagaaatggtgaaccagaaaccactgttccctggtgattctgagattgatgaattatttaagatattcagggtactaggaactccaaatgaacaaagttggccaggagttagctcattacctgactacaagtctgctttccccaagtggcaagcacaggatcttgcaactattgtccctactcttgaccctgctggtttggaccttctctctaaaatgcttcggtacgagccaaacaaaaggatcacagctagacaggctcttgagcatgaatacttcaaggaccttgagatggtacaatgaccctgctatggctttacattggattggcatatgtatgggctgggctcctcatttcattccttctgtgaacgctgtgcccttcgtttgggcatttttgtcattcagctggatatttcaaatcttgtgtgtttgatatgtattcaggaacgctaaatagatcaccgtcttggtctctatttgttcagagtaaatatcttccaatgctgcctttcagtttccaaaaaaaaaaaaaaaaaaactcccgaattcct

SEQ ID NO: 3061 - DNA, 280 bp, Oryza sativa
  Clone ID: PAT_MRT4530_11109C.1
aaaacttgggtaaatatagctcaacttgtacaaagttcacataaaaaggcattgattcatgacacttagagagccatgcacaccacttattaggacacacaaagggcaaggctgcagagaaattcaaccaacacaagctgaactaacggccccacctgtcaacctttaactggtcgaggccggatactcttgtgaaaaacagcaacaccacccatgcagaaaaagacaaatttttacacacacaaatcgacgacactgcagcctacgacatacggggagg

SEQ ID NO: 3062 - DNA, 904 bp, Oryza sativa
  Clone ID: PAT_MRT4530_11190C.1
ccatcatcgatcgatcgatcacaactactagaaatccagccaagaagatcgagaccggatacagctagcaatccatccaagaagatcgagagagcggatacagctagcctagctacgcgaaggatcagatcatcggcatggagctggagcttgggctggcgccaccgaattccggtcatctcgtcgtcgacgagctcagcagcagcagcagcagcggcggcggcagcggcagcgcgccggtgtctgcctcgtcggccgggaagaggggattcagggaggcgttccaggagacgctgctgctcttcgacgacggcagctgctgcaacaccagcgacgacgattgcaggaggaggaagaagacggtggtggggtggccaccggtgagctcggcgcggcgggcgtgcggcggcgccaactacgtgaaggtgaagaaggaaggcgacgccatcgggaggaaggttgatttggccctccattcctcctacgacgagctcgctgccacgctcgcccgcatgttccccaccaacgaccaccaaggcgagaagaaaatggccaatgatgatcatggcgatgccgctggacctgtggtcacctacgaggatggtgatggggattggatgctggttggggacgtgccatgggatgattttgcacgatctgtgaaacgcctgaagatactgggttaactgaactgaaggagatgcatgcgtgagttgatggagcacagctcggttttggttgcctggcatctgcgtgtgggtgtgcactgatgtatgtacatgttttcgttttcagtcaggatgttaggacgagagaaagagctttctgtcaaagactatatactgctagcttatatatactgtagttgggcacatctcatgtgtgcccagggctaggttttgag

SEQ ID NO: 3063 - DNA, 1517 bp, Oryza sativa
  Clone ID: PAT_MRT4530_11246C.1
ctagtggatccccgggctgcaggctgtgaaggttgtccacttccttttcatgaagtggaagaggactaacaaaatagggcatcatcatcagcagtgcagcagattctagggattcagaactctaagcagttcagatgtaacaccaactaatgttagaaagcctgcactaccctattatgattcaattaaattttttggtgtgaggaataatgggcatttaacatgttcagtttggagaggatacaagcaaaaggcaaacactatatagatggactacctgccccagcacaagagggccgccgccgccaccgaagtaatcccttaattggtcaaaatgtctcgggaggagaatgtctacatggccaagctggccgagcaggctgaaaggtatgaggagatggttgagtacatggagaaggttgcaaagactgtagatgtggaagagctcactgttgaggagcgcaacctcttgtctgttgcttacaagaatgtgattggtgcccgccgtgcctcctggcgtattgtctcatccattgaacagaaggaggagggtcgtggcaatgaggaacatgttactctgatcaaggagtaccgtggcaagattgaagctgagctgagcaagatttgcgatggtatcctgaagttgcttgactcacaccttgtgccctcatctactgctgcagaatctaaggtgttttacctcaagatgaagggtgattaccacaggtaccttgcggaatttaagactggtgccgagagaaaggaagctgctgagagcacaatggtggcttacaaggctgctcaggatattgctctggcggatcttgctcccacccatcccataaggcttggactggcacttaacttctctgtgttctactacgagattctaaactctccagacaaggcttgcaaccttgctaagcaggcgtttgacgaagccatctccgagttggataccctcggggaggagtcttacaaggacagcactttgatcatgcagctcctgagggacaacttgaccctctggacctctgacctcacggaggacggtggtgatgaggtgaaagaagcctccaagggcgacgcctgcgagggccagtaaaatgggaagatcgatcgatcgatggctccgcatgttattggagaccatcgatttagatgccctcatgctgctgtcaccatgatggatggattcttctcctgttctactagaatgtttttcttcctgtccccccttcctctctcttctctggtttttactagggtggtagcggtcgaattagttcttcccattgctttgcatttggtgctagtggtccgtctgggctgattgttttcctctggatatgactctcgtgtgtgttgtctccagatagtgttttattgagcaatatttaaagttgtcgtccacctaaaaaaaaaaaaaaatcaacaaaaatacaatgtagaaaaaaaaaaaaaaaaaaaaacaatcggtgaggccggccccccgagggccggcagcccggggatcc

SEQ ID NO: 3064 - DNA, 1816 bp, Oryza sativa
  UNSURE (1)..(1816): unsure at all n locations
  Clone ID: PAT_MRT4530_11349C.1
  unsure (1)..(1816): unsure at all n locations
cccgggctgcaggaattcggcacaaataataatgtcttgcatgttgctcccctctgctgcttcttcttcttctggagcatcgagagagagagagagagggggggagagaggtggcagggcagcaatcttcttcctcctctctcgtcttctagatcgttagaacgtcagcaatggagaacatgagatctgagaactttaaccaaggtgtttcaatggagggcgtcaagcatgcgcccgagatggcaaacaccaacaggagggctctgcgggacatcaagaacatcatcggagcacctcaccagcacatggctgtgagcaagaggggtttgctagataaacctgccgctaagaaccaatctggacaccgtcctatgacgaggaaatttgctgcaacactggcaaaccaaccctccagtgctcccctggcacccattggaagtgagaggcaaaaaaggacagcagattctgcatttcatggtccagcagatatggagtgcaccaagatcacatctgatgatttgccattgccaatgatgtctgagatggacgaagtgatgggttctgaactgaaagaaattgagatggaagacattgaggaggcagcacctgatattgacagctgtgatgcaaataactcccttgcagtagttgaatatgttgatgaaatttacagcttctacaggaggagtgagggtttgagctgtgtctctcctaattacatgttgagccaaaatgacataaatgagaagatgcgcggcattctcatcgattggctgatagaggtgcattacaagttagagctattggatgagaccctcttccttactgtgaatatcatagaccgattcttggctcgcgaaaatgtggtgcgaaagaagcttcagttggttggcgtgactgccatgctgctcgcctgcaagtatgaagaagtgagcgttcctgtagtggaggatcttatcctaatctgcgaccgcgcctacacaagaacagatattctcgaaatggagaggatgattgtaaacactcttcagtttgatatgtcagttccaactccatactgtttcatgagaaggttcctcaaggctgcacaatctgacaagaagcttgagctcatgtctttcttcataattgagctgagccttgtcgagtatgagatgctcaaattccagccgtcaatgctggcggctgctgccatctacactgctcagtgcaccattaatgggttcaagtcctggaacaaatgctgtgagctgcatacaaaatactctgaagaacagctgatggagtgctccaagatgatggttgagctccaccaaaaagcaggacatgggaagcttactggagttcatagaaagtacagcacatttaggtatggttgccccgcaaaatcggagcccgccgtcttcttgctcaagagcgtggcactgtaactgattggctcactatacacactctaactacttccatggaaagagggaatgaggggtgtatatatagaggccggctgctttgatgaaattacagagaagagatctgcatatatgcaacagctgttgcaaaggattatttgatgggtgggttgggttggtgcaatgtgtgcctttacttccaataacttaacatcgtcgagacattgatctgcgtttggatgttttaggttgcttccaattaaatctgttggaacttgatttcatgttgtatttaagagaattattcttcatttgttctgtggcacatgcaatttgccaataaacattaattgaattgcctgttnaaaaaaaaaaaaaaaaaaaaaaaaaaaacaaaaaaaaaaaaa

SEQ ID NO: 3065 - DNA, 1157 bp, Oryza sativa
  Clone ID: PAT_MRT4530_1149C.1
atgggctcatcctgtagcagatctcattctttaagtgaggctgaaacaaccaaaaatgcaaaatctgcagacattgacaggcgaattttgcaagagacaaaagcagagcaacacatccacaagctcttacttcttggtgcgggagaatcagggaagtctacgatatttaaacagattaagctccttttccaaactggctttgatgaggcagaacttaggagctacacatcagttatccatgcaaacgtctatcagacaattaaaatactatatgaaggagcaaaagaactctcacaagtggaatcagattcctcaaagtatgttatatccccagataaccaggaaattggagaaaaactatcagatattgatggcaggttggattatccactgctgaacaaagaacttgtactcgatgtaaaaaggttatggcaagacccagccattcaggaaacttacttacgtggaagtattctgcaacttcctgattgtgcacaatacttcatggaaaatttggatcgattagctgaagcaggttatgtgccaacaaaggaggatgtgctttatgcaagagtacggacaaatggtgttgtacaaatacaatttagtcctgttggagaaaacaaaagaggtggagaggtatataggttgtatgatgtaggaggccagaggaatgagaggagaaagtggattcatctttttgaaggtgttaatgcggtaatcttttgtgctgccattagcgaatatgatcagatgctatttgaagatgagacaaaaaacagaatgatggagaccaaggaactctttgactgggttttaaagcaaagatgttttgagaaaatacaaaaggttcctttaagtgtgtgcgagtggtttaaagactaccagcctattgcacctgggaaacaggaggttgaacatgcatatgagtttgtcaagaagaagtttgaagagctctacttccagagcagcaagcctgaccgtgtggaccgcgtcttcaaaatctacagaactacggccctagaccagaaacttgtaaagaagacattcaagttgattgatgagagcatgagacgctccagggaaggaacttgattcagagctaagactaggttgtaagtcacacagggaaggtaattaggacggcgagaggaaca

SEQ ID NO: 3066 - DNA, 813 bp, Oryza sativa
  Clone ID: PAT_MRT4530_11646C.1
atggggaggcctccttgttgtgatgagaatggcctcaagaagggcccctggactcctgaagaagatgagaagctcatgagctacattcagaaacatggccatgcaagctggagagtcttacctgaacttgctggcttgaacagatgtggtaagagctgcaggctaagatggaccaactatctgaaaccagacatcaagagagggaacttctcgcgtgaggaagagcaaactatcctccagctgcattccatccttggcaacaagtggtcagctattgcaaagcatctccctggacggacagataacgagatcaagaacttctggaacacccacctcaggaagaaactgatcaagatgggcattgatccaatgacccactgcccaagaacagacttctttcagtccctcccgcagctcattgcacttgccaacctccgccagattatcgagcgacaaccgtgggatggccacattgagggcctgcagactgtggcagttcaggctgccaagctcgaatacatgcaatcactgctacattctgcagtgtgccattgtgaccagccccaccaccaccaccaccaccagcagcttaaacaccttcaccaccgaactggagcagaccaaccacctatgccctccacaggtgccttcttcaacaacattgccctagtttcgggatggatcacattgaaacttgaggacggcgttatacctaccggcaactcaccggtgctcgaccacctcgccggcgaagcgctcgagggggctctcggcattcgggatttcgggtccaccacagcttcctccgcctga

SEQ ID NO: 3067 - DNA, 783 bp, Oryza sativa
  Clone ID: PAT_MRT4530_11916C.1
agctgtgtctgttggaacagctacataaaaaattacttggcatcaacagactacgatggcactgttcagttgtgggatgcaagctcgggtcaaggattcacgcagtttacggagcaccgaaaaagagcttggtctgtaagtttctcagaggtggatccaactaaattggcaagtggaagtgatgattgctgcgtgaaagtttggagtattaaccagaaaaattgcactgataccatcagaaacgtggccaacgtgtgctgtgtacagttctccccatactcctctcgtatgttagcttttggctcggctgattataagatatactgttatgatctgaggaatacaagaatcccatggtgtactatttctgggcatggaaaagctgtcagctatgtacgattcttggatccagaaacacttatctctgcatcaactgataacaccttgaaaatatgggatctcaaccagactaattccagtggattatctactgatgcctgcagtatgacgttgagtggccataccaatgagaagaattttgtggggttatctgttcacgatggatacataacttgtggttctgaaaataatgaagtattttcttattacaaaacctttcccatgccaataacttctcacaagttcggttcaatcgacccaataactggacaagagacaaatgatgataaccaacaatttgtgtccagtgtttgctggcgagggaggtcgaacatggtagtggctgccaattctactggcagcattaaagtgcttgagcttgtg

SEQ ID NO: 3068 - DNA, 2786 bp, Oryza sativa
  Clone ID: PAT_MRT4530_12732C.1
ttatactcgaaccggcaagacgagaaggccgtggagaactcccccttcttggagaagctgaagaagaagggttacgaggtcctctacatggttgatgccatgcacgagtatgctgttggccagctcaaggagtttgagggcaagaagctcgtctctgccaccaaggagggactcaagcttgatgagagcgaggacgagaagaagcggaaggaggagctcaaggagaaattcgagggtctctgcaaggtcatcaaggaggtgctcggagacaaggtcgagaaggtggtggtctcggaccgtgtggtggactccccgtgctgcctcgtcaccggcgagtatggctggacggccaacatggagaggatcatggcctcggagacggagacgttcgccttccaggcggagatcaaccagctgctgtcgctcatcatcaacacgttctactccaacaaggagatcttcctccgcgagctcatctccaactcctccgatgcgttggacaagatcaggttcgagagcttgacggacaagagcaagctggatgctcagccagagctgttcatccatattgttcctgacaaggcctccaacacactgtcgatcattgacagtggtattggtatgaccaagtcagatcttgtgaacaacctgggtaccattgccaggtcagggactaaggagtttatggaggcactggctgctggtgctgatgtgtccatgattggtcagttcggtgttggattctactctgcctaccttgttgccgagagagtagttgtgaccaccaagcacaacgatgacgagcagtatgtgtgggagtctcaggctggtgggtccttcactgtcacacgtgacacatctggggagcagcttgggaggggtactaagatcaccctctacctcaaggatgatcagttggaataccttgaagagcgccgcctcaaggacctgatcaagaagcactctgagtttatcagctaccctatctctctatggactgagaagaccactgagaaggaaatttctgatgatgaagatgaggaagagaagaaggatgctgaggagggcaaggttgaggatgttgatgaagagaaggaagaaaaggagaagaaaaagaagaagatcaaggaggtttctcatgagtggtccctggtcaacaaacagaagcctatctggatgaggaagcctgaggagatcactaaggaggagtatgctgctttctacaagtccctgacaaacgactgggaggagcatcttgctgtcaagcacttctctgtggagggtcagctggaattcaaagctgttctctttgttcccaagagggcaccattcgacctctttgatacgaggaagaagctcaacaacatcaagctctacgtccgccgagtcttcatcatggacaactgtgaggagctgatccctgagtggctgagctttgtcaagggcattgttgactccgaggatcttcccctcaacatctcccgtgagatgctgcagcagaacaagattctcaaggtcatcaggaagaaccttgtcaagaagtgcgttgagctcttcttcgagattgctgagaacaaggaagactacaacaagttctatgaagccttctccaagaacctcaagctcggtatccacgaggactccaccaacagaaacaagattgccgagctcctgaggtaccactccaccaagagcggcgatgagctgaccagcctcaaggattacgtgacgaggatgaaggaaggccagaacgacatatactacatcaccggcgagagcaagaaggccgtggagaactcccccttcttggagaagctgaagaagaagggttacgaggtcctctacatggttgatgccatcgacgagtatgctgttggccagctcaaggagtttgagggcaagaagctcgtctctgccaccaaggagggactcaagcttgatgagagcgaggacgagaagaagcggaaggaggagctcaaggagaaattcgagggtctctgcaaggtcatcaaggaggtgctcggagacaaggtcgagaaggtggtggtctcggaccgtgtggtggactccccgtgctgcctcgtcaccggcgagtatggctggacggccaacatggagaggatcatgaaggcccaggcgctgagggactcgagcatggccgggtacatgtcgagcaagaagacgatggagatcaacccggagaacgccatcatggaggagctccgcaagcgcgccgacgccgacaagaacgacaagtccgtcaaggacctcgtcttgctcctcttcgagacggccctcctcacctccggcttcagcctcgacgaccccaacaccttcggcagcaggatccaccgcatgctcaagctcggcctgagcatcgacgaggacgagacggcggaggccgacaccgacatgccgccgctcgaggacgacgccggcgagagcaagatggaggaggtcgactaagcgggtttccttttttttcccctcgtcaaatccttcgcagcgaaagtacaccatggagcattggagctagcttatctgttttaccttttgaacatcgcgttgttgggtcggttcggtttattttgtgcgatttgctttacctttacctagcctgcaatgcatggggctagattgtgctatgggttctcgaactgcgtacgttaattatattgctaaatatgagtattatattagtgtcctcatgagttgtctattttttcctctgcaagttagatgtatcaattaattttgcgaatattcttctgcctcaattcccagat

SEQ ID NO: 3069 - DNA, 1467 bp, Oryza sativa
  Clone ID: PAT_MRT4530_12828C.1
atgaagaagctcttcttcttcctcttcctgctgatactggccgcctcggttgttcacggcgaggacggggcgtacatcggcgtcaacattggcacggccatgacgtcggtaccggcgccgacacagatcacgacgctgctccgctcgcagaacatccgccacgtgcggctgtacgacgccgacccggcgatgctcgcggcgctcgccaacaccggcatccgcgtcatcgtctccgtgccgaacgagcagctcctcgccatcggcaactccaacgccacggcggccaactgggtggcgcgcaacgtggccgcgcactacccttccgtgaacatcacggccatcgcggtcggctccgaggtgctctccacgctgcccaacgcggcgccgctcctcatgccggccatccgctacctccagaacgcgctggtggccgcggcgctcgaccggtacatcaagatctcgacgccgcactcctcgtccatcatcctcgactcgttcccgccgtcgcaggccttcttcaaccgctccctggacccggtgctggtgccgctgctcaagttcttgcagtccacgggctcgccgctgatgctcaacgtgtacccgtactacgactacatgcgctccaacggcgaagccgtggacgccaacaccctgctgcactacaccaacgtgttcgacgcggtcgtggacgctgcctacttcgccatggcgtacctcaacgtcaccaacgtgccggtgatggtgacggagaccgggtggccgcacaagggcgacccgtccaacgagcccgacgccacctccgacaacgccgacacctacaacagtaacctcatccggcacgtgatgaacaccaccggcacgccgaagcaccccggcgtcgccgtgccgacgtacatctacgagctctacgacgaggacacccgccccggctcgacgtcggagaagtactggggcctgttcgacatgaacggcatcccggcgtacaccctgcacctgacaggctccggcgtgctgctcgccaacgacacgacgaaccagacctactgcgtggcgcgggagggcgctgacgagaagatgctgcaggcggcgctcgactgggcttgcggcccgggcaaggtggactgctccgcgctgatgcaggggcagccgtgctacgacccggacaacgtcgaggcgcacgccacctacgccttcaacgcctactaccatggcatgggcatgggctccgggacgtgctacttcagcggtgtcgccgtgatcaccaccaccgatcccagccacgggtcttgcgtttacgctggaagtggtgggaagaacgggacgtcgttgctgaacggcacatcgctggcgccgtcgtcgaactccacggcgggggactccggcgcgcaccgggcgatcggggacgtctcgtcgttcgtccgcgccgtcgtcgcggcgctgctgttgagcgtcgtcctcctgttgtag

SEQ ID NO: 3070 - DNA, 2219 bp, Oryza sativa
  Clone ID: PAT_MRT4530_12829C.1
cttgcaactcttcattccagttcgcttcctccctcccacctcttctccacttcttcttcctcctcccctttcacactccacttctttggtctgctcttcttggtatccttctcctacgcatagttaagctccgagctcaggaggtaggttggtaggtttctattgcttcttctcagctgggagagtgaaaataccgaggagaaaaggcacatcaagattgtttctttcggtttcttgggcttctcttgcggcaacatgaagaagctcttcttcttcctcttcctgctgatactggccgcctcggttgttcacggcgaggacggggcgtacatcggcgtcaacattggcacggccatgacgtcggtaccggcgccgacacagatcacgacgctgctccgctcgcagaacatccgccacgtgcggctgtacgacgccgacccggcgatgctcgcggcgctcgccaacaccggcatccgcgtcatcgtctccgtgccgaacgagcagctcctcgccatcggcaactccaacgccacggcggccaactgggtggcgcgcaacgtggccgcgcactacccttccgtgaacatcacggccatcgcggtcggctccgaggtgctctccacgctgcccaacgcggcgccgctcctcatgccggccatccgctacctccagaacgcgctggtggccgcggcgctcgaccggtacatcaagatctcgacgccgcactcctcgtccatcatcctcgactcgttcccgccgtcgcaggccttcttcaaccgctccctggacccggtgctggtgccgctgctcaagttcttgcagtccacgggctcgccgctgatgctcaacgtgtacccgtactacgactacatgcgctccaacggcgtcatcccgctggactacgcgctgttccggccgctgccgccgaacaaggaggcggtggacgccaacaccctgctgcactacaccaacgtgttcgacgcggtcgtggacgctgcctacttcgccatggcgtacctcaacgtcaccaacgtgccggtgatggtgacggagaccgggtggccgcacaagggcgacccgtccaacgagcccgacgccacctccgacaacgccgacacctacaacagtaacctcatccggcacgtgatgaacaccaccggcacgccgaagcaccccggcgtcgccgtgccgacgtacatctacgagctctacgacgaggacacccgccccggctcgacgtcggagaagtactggggcctgttcgacatgaacggcatcccggcgtacaccctgcacctgacaggctccggcgtgctgctcgccaacgacacgacgaaccagacctactgcgtggcgcgggagggcgctgacgagaagatgctgcaggcggcgctcgactgggcttgcggcccgggcaaggtggactgctccgcgctgatgcaggggcagccgtgctacgacccggacaacgtcgaggcgcacgccacctacgccttcaacgcctactaccatggcatgggcatgggctccgggacgtgctacttcagcggtgtcgccgtgatcaccaccaccgatcccagccacgggtcttgcgtttacgctggaagtggtgggaagaacgggacgtcgttgctgaacggcacatcgctggcgccgtcgtcgaactccacggcgggggactccggcgcgcaccgggcgatcggggacgtctcgtcgttcgtccgcgccgtcgtcgcggcgctgctgttgagcgtcgtcctcctgttgtaggcagaacagtggttattttattagccaaggcaccaaagtccgtaggaattcatggggggattttttttttggtggtgggattggccccggtgttatgggtgggtggtgatcattgagaacgaacaaaattgccttgttcatctgttgccctgagctacgtggatggaactcttccgagagacttcgggttcgacccactggcgctatcagacccggaggggaccgggggtttcatctagccacggtggctggcctacggcgaggtgttcaacgggcggacgtcgatgatgggtgtcgtcggcatggtcgccccggagctcctcggcaagctgggcctcggccccagcgagacagagatcccgtggatccagaccggagtgattccccccgcgagaacctacacgtactgggacgagccttaccatctcttcatcttcgaactcgcccct

SEQ ID NO: 3071 - DNA, 328 bp, Oryza sativa
  Clone ID: PAT_MRT4530_13180C.1
ttgggttaagaaccaaaccggacatatattattattgcaaagggggggcaccagtcaaagggcctctaagcgaaaccaggcgaataattcaatttccaagggtggtagaaccggattaccatttggcgtgacataactcaaaagcccaggccaaagcagatgaaccatcatcgggtcatttatcagttgcccgaacacaccgcaggcaggcaccttcatgcagcaggtcaaacgccttggtgatgtcagtcaggttcatgccgggaggaacgtacccgtccaccttgatttccttggtcaaggacttctcaacgagccatggaacttg

SEQ ID NO: 3072 - DNA, 1677 bp, Oryza sativa
  Clone ID: PAT_MRT4530_1353C.1
gcacgagggagattccgggcttccgcgttcaccggcgacggcgtcctggccatgacgctcgatctatcgagaatttccgggacgccatggggcacctccgtccgcttgtaccaccttcgtttccgaatccctcgcactaggtcaaccgccctgcctctggcccccacctgtccacccgccgcttctcaaccccacagccaaagctccgccgcctcgccggccaccgcggccgtccgtccactacggcatcctgagggcgccgagccgccgaggcgctccgccgcgagtgcgctgtttgttgagcacaggggcattatgggatgggatggtgaccaccggccattccaggcagtcaggcaccactggttcttggatgcgtcagccatggcgcaagatctttcttcctcggcagtgtggccggagcggaatggaagaatatttgagcacaagtttaaggtcgctgagcagctcgttggggatatcaaggagattctcaaggtcaaggtggttgaccctcgatacgtcctcattaacatcgacggcaaccattttggggcttctttgttgccctcactatcgttgttatcttcattcatcgagcctgctatcatggaaaacacctgcaagaggatctccaacacccccaactccatgccagtgctccaaggatgggcagacctcccagatgacctactgcagtgtgtccttgctctgttgagttcacccagtgaccttgctgccttcattgccacctgccccaattggcatgctgccttcaggtctgcaaaatctaccttacgcaccaccctcttccgtcctcttgccatccgcagctgcgcttcctctggcgatgatccagtagtatgggagctctttgatccagccaagccaaccatctgcatacaccgcgtgactccgccagattttctggcggggatggattatgaatgctgttcttatggccatgccatcttctctggcaatgccccctcgctgaaggacacaaccttcgccatcgtcgacgtgttcaccggcactagtgtttcacctccaccctgcccattctttacttttgtcaactcttgtgccctcacagctccccttgattatcacaactcgcatttccttgtcgaggccaagcactccctgttcgcatggcgagttggaagcgaccattggtcgcagtgcagttgcccgcccaattctaaagctcttgagcagtttgtgcccttcaaaggccagctctatgccctcgagtatcagcagctttacaccgtcaagctggaaccccagctcagcctggaagaagtacaagttgtctggagcgtcgagatgtcggagcctgacctctgcgagccatcgctggtggtgtgtgatgacatgctcatcctgctcgccgcctccatcggcgaggccttctgccttgacctgtcatcccagcctgcaatgtgggtgaagatggaagaggaagagttgaaggaatgggccttcttcttcgatgagaagagggaggctttcaggccacggccaccattgtcttgcaagaacccacagagatggggagggatcggctatgattcatactgtgtgtcatccttggcgccaaatcaaggcaatcgcagagggttgctgcccaactgggtgaagcccaggatgctactctcttgcgatcattag

SEQ ID NO: 3073 - DNA, 379 bp, Oryza sativa
  Clone ID: PAT_MRT4530_13758C.1
ggaccgaaattagacggccattaatttgaactagggtttcacaaacttcgtccattgacaaaatccccggataatggggcctaaccattttcgcagggaaaaagggacccccctcgaaaccatcacatttttaaacaacctaacccaagagctagataaaaaaacaacgggggggggggacacatcactacaggtgggccttataaaacaacgacgggtccgcctcctccttgaggggggaggattcctttttttaaacctggggctcctcgacctcctttttcttttccacgggcgggtcggggctcagggaaaggtttttttgcccccacctgtaaatgctggaggcaaaacccttgggaacaggaaggttgaagcc

SEQ ID NO: 3074 - DNA, 1558 bp, Oryza sativa
  Clone ID: PAT_MRT4530_13914C.1
ccacgcgtccggtggccccatcccccatctcctctccaatactcgccactaatttcttctctctttctctctctctccgcgccctcgcatcgcacgtgaggcagtcgagggatagcggcgcaatggcggcggcggtggtggcgaacggcgcgagcggcgactcctccaaggccgcgttcgcggagatatacagcaggctcaaggaggagatgctcgaggacccggccttcgagttcaccgacgagtcgctccagtggatcgaccgcatgctggattacaatgtgctcggaggaaagtgcaaccgcgggatctctgtcattgatagtttcaagatgttgaagggcactgatgttctgaataaggaggagacatttcttgcctgcacccttggttggtgcattgaatggcttcaagcttattttcttgtgcttgatgatattatggacaactctcaaacacgacgtggccagccttgctggtttagggtgcctcaggttgggctcattgctgtaaatgatggtattatccttcgcaaccatatttcacgaattcttcaacgccattttaaaggaaagctgtattatgttgatctcattgatttgttcaatgaggttgagtttaagactgcttcaggtcaattgttggatcttattactactcatgagggagaaaaggatctcacaaagtacaacttgacagttcaccgccgcattgttcagtacaagacagcttactactcattctatcttccggttgcatgtgctttgctgctatctggtgagaatttggataacttcggtgatgttaagaacattcttgtggaaatggggacatacttccaagttcaggatgattatctagattgttatggtgatcctgagtttattggcaagattggaacggacattgaagactacaagtgctcatggttagttgtgcaagctctcgagcgtgctgacgagaaccaaaagcacattctatttgaaaattatgggaagccagatcctgaatgtgttgcaaaagtgaaggatctgtataaagaacttaatctggaggccgtatttcatgaatacgagagggagagttacaataagctgattgccgacatcgaagcacatccgaacaaagcagttcagaatgtattgaaatccttcctgcacaagatctacaagaggcagaagtagagctaagctcatggagaagctgtttcatgtttgcttggtaactagagtcgtggggacaaataactggtaactagaatcatggggactgttccctgatgttgtgtgtattatggttatgttcgtaccgtgtagtacagcgtgctactccgtaaaataatgaagcatggtgctatttatgcgtgcgtgaactgcttgagtcattaattttagtttttggcttttgctagcttcatttttaccaatttcatacttatctgcattcgaaggctcaaatagcagggcgcatttcaaagtaagccctgtttgagcatgcgaattttaagtaagggcagatctagaaagagatattatcgtatgaaaagaagcttcctgtc

SEQ ID NO: 3075 - DNA, 1128 bp, Oryza sativa
  Clone ID: PAT_MRT4530_13916C.1
atggcggcggcggtggtggcgaacggcgcgagcggcgactcctccaaggccgcgttcgcggagatatacagcaggctcaaggaggagatgctcgaggacccggccttcgagttcaccgacgagtcgctccagtggatcgaccgcatcatttctttgacatatgaatgcagatggataaaggagttgagggtggcccaaagtgccacaaagatgctggattacaatgtgctcggaggaaagtgcaaccgcgggatctctgtcattgatagtttcaagatgttgaagggcactgatgttctgaataaggaggagacatttcttgcctgcacccttggttggtgcattgaatggcttcaagcttattttcttgtgcttgatgatattatggacaactctcaaacacgacgtggccagccttgctggtttagggtgcctcaggttgggctcattgctgtaaatgatggtattatccttcgcaaccatatttcacgaattcttcaacgccattttaaaggaaagctgtattatgttgatctcattgatttgttcaatgaggttgagtttaagactgcttcaggtcaattgttggatcttattactactcatgagggagaaaaggatctcacaaagtacaacttgacagttcaccgccgcattgttcagtacaagacagcttactactcattctatcttccggttgcatgtgctttgctgctatctggtgagaatttggataacttcggtgatgttaagaacattcttgtggaaatggggacatacttccaagttcaggatgattatctagattgttatggtgatcctgagtttattggcaagattggaacggacattgaagactacaagtgctcatggttagttgtgcaagctctcgagcgtgctgacgagaaccaaaagcacattctatttgaaaattatgggaagccagatcctgaatgtgttgcaaaagtgaaggatctgtataaagaacttaatctggaggccgtatttcatgaatacgagagggagagttacaataagctgattgccgacatcgaagcacatccgaacaaagcagttcagaatgtattgaaatccttcctgcacaagatctacaagaggcagaagtag

SEQ ID NO: 3076 - DNA, 3168 bp, Oryza sativa
  Clone ID: PAT_MRT4530_1407C.1
atgaggttcttgttaaattctaggttatccagctcttgtttggttggctggtctggaactctgaattccctctgtagctttttactagatgtccggaattctcttctaagggagcctaaacacggcagttcagttcagattaattatgggtctgggtttgaagaaaagaataaagggagtgaaataaagaaacaaacaggtaacctggataagacggtggaggagctatcaaatgtttatagaggagctcaagaaaccaatagaaagctctatcaggaactgttcccaattcagattatgcaaatgtgtggatggttactgaaggttgttcgttgggaaaacttaaattgtgtgcacatggaagctcatggcaatcgtcgcagcagtccaacataccttgttatgctgtggatgatttcggtagctagcctattgataacatgtcgtggcagtatccagaagcaagttctctttccagggttcactgccgcgcaaatggattacattgataacgatgggatatttctgctttctaatggctctgtctttggctttggttttgtcacgagcaatgtctcagacaacacgttctacattcttgcagtggttcacatggccactactaccacagtctggtctgccaatcctaactctcctgtcacccattcagatgacttttttttcgacaaggatggcaatgccttcctgcagtcaggaggaggctccaatgtatgggctgccaatatctccgggaaagggactgccacctctatgcaactactggactctggcaatcttgtagtgcttgggaaagatgcctcttctcctctctggcaaagtttcagccatccgacagacactcttctgtctggtcagaatttcatcgaagggatgacgctgatgagcaagtccaacacagtacagaacatgacctatacacttcagatcaaatctgggaacatgatgttatacgccggcttcgagacacctcaaccatactggtctgcacagcaggatagcaggataattgtcaacaagaacggtgacagcatctaccctgcaaacctcagttcagcttcttggtccttctatgatcaatcagggtcccttctatcacaacttgtcatcgcgcaagaaaatgccaatgccacattgtctgctgtccttggtagtgatggattgatagctttctatatgctgcagggtggaaatggcaagagtaaattctcgatcacagttccggcagactcttgtgacatgccagcctactgcagtccttacaccatttgcagtagtgggacaggttgccaatgcccttcggccctcggctcgtttgcaaactgcaatcctggtgttacatcagcatgcaaatcgaacgaggagtttccgctggttcaactggatagtggagttggatatgtaggcactaacttcttccctcctgcggctaagacgaaccttacgggttgtaagagtgcctgtacaggcaactgctcttgtgttgctgtgttctttgatcaatcttcaggcaattgtttccttttcaaccagatcggaagcttgcagcacaaaggtgggaatacaactcgtttcgcatcttttatcaaggtatcaagcagaggaaaaggtgggagtgatagtggcagtgggaagcacaataccattattattgtcattatgctcggaactttggctatcataggcgtccttatttatattggtttctggatctacaagaggaagaggcatcctccaccatcacaagacgacgctggttcatcggaagatgatggatttctgcaaacaatatccggagcaccagtgcggttcacttacagggagctccaggatgcgacaagcaacttctgtaacaagcttggtcagggagggtttggatctgtgtatcttggtacactcccagacggcagtcgtattgctgtgaagaagctggagggcataggccaaggaaagaaagagttccgctctgaggtaacgatcattggtagtatccaccacatccatcttgtcaaactccgaggcttttgtactgagggaccacacaggcttcttgcctacgagtacatggcgaatgggtcgctggataagtggattttccattctaaagaagatgatcacctgctcgactgggatacaaggtttaacattgcgcttggaacggcaaagggattggcatacctccatcaggactgcgattcgaagattgtacactgtgacattaagcctgagaatgttctacttgacgacaacttcatcgcaaaggtatctgattttggccttgccaagttgatgaccagggagcagagccatgttttcactacgctcagaggcacgcgcgggtaccttgcacctgagtggctcaccaactatgccatctcagagaagagtgatgtgtacagctacggcatggttttgcttgagataatcggtgggaggaagagctacgatccctcggagatctccgagaaggctcacttcccttcctttgcattcaagaagctggaggaaggcgatcttcaggacatcttcgacgccaagctgaagtacaatgacaaggatgggcgggtcgagaccgcgatcaaggtcgcgctctggtgcatccaggatgatttctaccagagaccatccatgtcaaaggttgtgcagatgctcgaaggcgtctgcgaggtgctccagccaccggtgtcgtcgcagatcgggtacaggctctacgcaaacgccttcaaatcgagcagcgaggaggggacttcatcagggatgtcggactacaacagtgatgctctgctttcagctgtgaggctttctggtcccagatgatgtgaagaatcccatgtacagtgccttgtctagttaggttgcaaagtgtgcaaattttgctgtagtttccagtgttttggtgatcatttgcttcacactattgtacatatcttcttggtcatttctggtggtagtttatacatatcttgctgattatttatggtggtagtttatcggtgccattctttttttgttgcccttttggttatacataaggtctccaaaacctttgacaattaccttttgtagttatgtcttggtaaaaataataggaaatgcaatgatacaaaaggctttttcatgaaaaaaaaaaaaaaaaaaaaaaaaaaaaaa

SEQ ID NO: 3077 - DNA, 2101 bp, Oryza sativa
  Clone ID: PAT_MRT4530_14135C.1
cgggctgcaggaattcggcacgaggctccactccactccactctccgttgctcgcgcggttggcgttgcgttttttcccctcgaatcgcgggggggaatccgccggttgatgcagcagaggggcctcgcgcacaaccgccgctcccgcggcttctcccgatcccgccgcgccgtcgagggcgcctaaaccacacgcctttttttttcccttaaaaacgaatagatctctctcaatttcctgaaacttataataatttcaaaaacgccctagacgaggacgaggagacgatcgagatggacgccgtcgcggcgaatgggatcggggaggtggagaggaaggcgcagcggagctactgggaggagcactccaaggacctcaccgtcgaggccatgatgctcgactcccgcgccgccgacctcgacaaggaggagcgccccgaggtcctgtctgtactcccttcttacaaagggaaatcagtactggagcttggtgctggaataggacgctttactggggaactggcaaaagaagctggccatgttttagccctagacttcattgaaagtgtgattaagaagaatgagaacataaatgggcatcacaagaacataacctttatgtgcgctgatgtcacgtctccggacctgacgatcgaagataactctattgatctcatattctcaaactggctactaatgtacctttcagatgaggaggtcgagaagctagtaggaagaatggtgaaatggctgaaggtaggtggccatatattctttagggagtcatgctttcaccaatctggagattccaaaaggaaggtgaatccaacacattaccgggagccaaggttctatacaaagatatttaaagaatgccattcctatgataaagatgggggttcttatgaactttctctagaaacatgcaagtgcattggggcttatgtgaaaagcaagaaaaatcaaaatcagttatgttggctatgggaaaaggttaagtcaacagaagacagaggattccaaagattcctggacaatgtgcagtacaaaaccactggaatcttacgctatgagcgtgtcttcggagagggttatgtcagcactggtggaattgaaaccacaaaggaatttgtggataagctggatcttaaacctggacagaaagtgcttgatgttgggtgcggaattggaggcggcgacttctatatggctgaaaactacgatgcccatgttcttggtattgatctttcaatcaacatggtttcatttgcaatcgaacgtgccattggacgcaagtgttcggttgagtttgaagtagctgattgcaccacaaagacctacgcaccaaatacatttgatgtgatctacagccgtgacaccattcttcacatacatgataaacctgctttgttcagaagtttcttcaagtggctgaaacctgggggcaaagtcctcatcagtgattactgtaggaatcctgggaaaccatcagaagaatttgctgcttacattaagcagagaggctatgacctccacgatgtgaagacttacggaaagatgcttgaggatgctggtttccatcatgtcattgctgaagaccgcacggaccagttcctgcgtgttcttcaaagggagcttgctgaagttgagaagaacaaagaagccttcatggcagacttcacccaggaggactacgatgacattgtgaacggctggaacgcgaagctgaagcggagctctgccggtgagcagaggtgggggctgttcattgcaaccaaatgattcagaagcagagagggttcagaataaaacgggtgctgctgttgttggctgtgttaactagtactcctactagatctgttgttgcagatttatttgtgcgccccaattggtagtttgtttgtgtgtgatgtagtattccagttttagaggacggccaatgttccatgtgacgtgatgtacgttaaactcagtctgtttaaagtatgtattatcgtgcgtatttggtatggaactgtgttattgtttgcagataaataaacacagatgtgttcctcttttgcaccaaaaaaaaaaaaaaaaaactcgagactagttctcc

SEQ ID NO: 3078 - DNA, 2269 bp, Oryza sativa
  UNSURE (1)..(2269): unsure at all n locations
  Clone ID: PAT_MRT4530_14370C.1
  unsure (1)..(2269): unsure at all n locations
gcgccccgaccttatctcctttccccccaccacctccaagatatttccccacctccgccgccgccgccgccatggagtccggcctcgtcgcaagccaccgcctccgcgtccccttcgccgccgcccaccaccgccaccacccggccgcgccgccgcacctcctccgccagcggcggggcagcgtcgccgccaccccactccggctcgggctccacctccccacgccgaccccgctccgcctccccgccgcgctcccgctccgcccttccctcccgcctctccgcgccgccgccgcgtcggcggcggcaccggagccggtggggtcggcctcgcccaagttcctgggcgtggagacgaagacgctgaagaagatcgtgccgctggggctcatgttcttctgcatcctcttcaactacaccatcctgcgggacaccaaggacgtgctcgtcgtcaccgccaagggcagcagcgcggagatcatcccgttcctcaagacgtgggtcaacctccccatggccatcgggttcatgctgctctacaccaagctcgccgacgtgctctccaaggaggccctcttctacaccgtcatcttccccttcatcgccttcttcggcgccttcggctacctgctctaccccatgcgcgacgccatccaccccaccgcgctcgccgaccgcctcctcgccgcgctcgggcccagctttctgggccccgtcgccatcctccgcgtctggagcttctgcctgttctatgtcatggccgagctctggggcagcgtcgtcatctccgtgctcttctggggattcgccaatcagattactacggttgaagaggccaaagagttttacccactgttcgggcttggggccaatattgcactcatcttctcgggtcgcacagtgaaatacttctcaaacatgaggcagaatttgggtccaggggtggacggatgggcgatttcattgaggggcatgatgagcatagtggttttgctgggccttgtgattgccggcatctactggggagtaaacaagtttgtaattgataaatcagctgcgccagtcgtcgagcggaagaagaaggataagccaaagctgagtatgggagagagtttgaaggtgcttgtgtcatctcggtatgtgagggatcttgccaccctggtcgttgcttatggtataagcattaaccttgtggaggtgacatggaagtcaaaactgaaggcacaatacccaagccctaatgaatattcttcattcatgggggatttctcgactgctactggcatagccacatttacaatgatgttgttagggagagtaattcttaggaagtttgggtggggagtcgcagctacaatcacccctgcagtgttgcttctcactggagttggattcttctcactgattttattcggtgagccattgactcctcttatggccacacttggaatgacacctttgcttgctgcggtctatgttggggcaatgcagaacattttcagtaagagtgcgaagtacagtttgtttgacccttgtaaggaaatggcatacattcctttggacgaggacatgaaggtcaaaggtaaggcagcaattgatgtggtctgcaacccattggggaagtctggaggcgccttgatccagcagttcatgatcttatcatttggatctctcgcaaattctacaccctacctgggaggaattctattggtaattgttcttgcctggttgggtgctgtaaggtcccttgactcacagttctccccactggcaaagcaagagcttgagaaggagaaaatgctgaaagcaaagacggtcgaaacaactgctcaagttgttgggtcaggaaatggttctctccaagaaactctagccagtgagaactctgcgaatggttcggccatcaaagtgtctcaggaacctgagagtacgacctcggagaagtctggtcaacaatctcaataagttctttgccttgcaaatttagttagtataagtcttccgtggaatcaaaagctgcttagtttggcctgccctgggttgttgctgaggaaagcagcagagtggtaagaaaaataagcaggccattttttttgtgttgttgtagcatgtatattttgacttcaccttgagaattgtctttagttctttgcttgagaatatctgtagctgtctgttgttccatcccatagatatgaaactgcctttttggtaattacaattttgtggaaattccggttcctcaaaaaaaaaaaatcaaaaaagtgccn

SEQ ID NO: 3079 - DNA, 1578 bp, Oryza sativa
  Clone ID: PAT_MRT4530_14451C.1
ttggttttggaaccccacttgatgagaagtttctcttattgcaacgaaggaaagatgttgcatttttttttcttttgggcgaggaaaccgtgtcagctcagttctcagctagttacagaatgtgtcacaaaaagcaaaaataaacagattacagaatgtacaaaatttccttatgatcacacaagttttactcctacacacccttagttgagtacaccttcacccttccttgtcaagcagagcaactatgcggcttttcgttgtcttgaaatgctcgaaccactatctgcggtagagctatcttctacctcatcaacacagtttctacctgcttcctgcaggagatatcttgaaggcccaactaaggaaccaccatgatcttgaatatgcgaatgcacttcagctgaagatgaataagatgggacatgaaatgcagtctcacaaaaggatcttttccttgataccggtgagtttgctacagagctcgttgcttccatctttgaggacctgatcatatcaacacaaatagaacttctatttgaggccttcaatacctttgactttaaattatgatccttgctgctagcatggggcactctttgatcaatgggcaaagcacatggagatgtttccctcaaaacaacttttgggatgtcaaaagtcttgatattgctcaagttgtcctccacaacctcaccatctaattctgcaagtttctcagctgtatccaattgccacatcgtggagatggaatcatctaaacactccctagcaatgtgaaggtctacgattggcttaggatagttaaaccccagctcaactccagcaacttcaagaatacagctcggtgcatcccatggatgatgaatccattctgtcggcattctagctagttcaggtatccaagttcttacatatacaccatctgggtcatacttttgaccttgaacctctggattatcaagacgactgagctcatggccatcaggcaggctcccagatatgtactgccaaccaagaatatcactttccagatcagcatccaatagcacatcccaaaaatacttcataccccaagtccatgggataagtagaaatttcacagcaaaacttgaaatgataactcttatccgattatgtgtccatccggtagcccaaagttccctcatgccagcatctaccaatgggtatcctgtcattccctgcctccaggacttgaaccgctcctcatctactttccaagggtagtgtttcaagttccccagcaatgacttttcatgtgtgaatgggaagttaaaacacaagtaccgtgaatattctcgaagaccaattgaccgcatgaagaagtgaatgctctcctcagcttcagatgttccctcattttcccacttgatttgttgcatccttacaagttgatatacttttcttacactcacctcaccaaaatgaagatatggtgatagcaatgatgtagtagctccctcaaccttcattccatgttttgagtattctaggagaccatgggagacaaattcttcaagcatcttttctgcattgcgccaaccaggagaccaggcc

SEQ ID NO: 3080 - DNA, 537 bp, Oryza sativa
  Clone ID: PAT_MRT4530_14488C.1
tatcgaatttgaccgtgatgatgagctatttgctactgctggagtctcaaagcgcatcaaagtctcgagttttctacaatctaaactcagctgccttagctggaacaagtactcaaaaaatgttatagcaagcagcgactatgagggtatagtaactgtttgggatgtccaaacccgccagagtgtgatggagtatgaagaacatgaaaagagagcatggagtgttgatttttctcgaacagaaccctcgatgctagtatctgggagtgatgattgcaaggtcaaagtgtggtgcacaaagcaagaagcaagtgccatcaatattgatatgaaggccaatatttgctctgtcaaatataatcctgggtcgagccactatgttgcagtgggttctgctgatcaccatattcattattttgatttgcgaaatccaagtgcgcctgtccatgtttttggtgggcacaagaaagctgtttcttatgtgaagttcctgtccaccaatgagcttgcgtctgcatcaactgatagcacattacg

SEQ ID NO: 3081 - DNA, 2628 bp, Oryza sativa
  UNSURE (1)..(2628): unsure at all n locations
  Clone ID: PAT_MRT4530_14490C.1
  unsure (1)..(2628): unsure at all n locations
tacagaacccaattcccctccctcctcctccacccgcccctccctcccacacacaccacaccaccaccaccaccaccctccgctcgtatgcaattattcacgcccagtcgccgcctccaccgccgccgcctgctcgactcaccaccgcagggcggcctcctcctgccgcatgggtgactcgacggtggccggcgcgctggtgccatcggtgccgaagcaggagcaggcgccgtcgggggacgcgtccacggcggcgttggcggtggcgggggagggggaggaggatgcgggggcgcgcgcctccgcggggggcaacggggaggccgcggccgacagggacctcctctgcccgatctgcatggcggtcatcaaggacgccttcctcaccgcctgcggccacagcttctgctacatgtgcatcgtcacgcatctcagccacaagagcgactgcccctgctgcggcaactacctcaccaaggcgcagctctaccccaacttcctcctcgacaaggtcttgaagaaaatgtcagctcgccaaattgcgaagacagcatcaccgatagaccaatttcgatatgcactgcaacagggaaacgatatggcggttaaagaactagatagtcttatgactttgatcgcggagaagaagcggcatatggaacagcaagagtcagaaacaaatatgcaaatattgctggtcttcttgcattgcctcagaaagcaaaagttggaagagctgaatgagattcaaactgacctacagtacatcaaagaagatataagtgctgtggagagacataggttagaattatatcgaacaaaagaaaggtactcaatgaagctccgcatgcttttggatgaacctgctgcatcaaagatgtggccctcacctatggataaacctagtggtctctttcctcccaactctcggggaccacttagtacatcaaatccagggggtttacagaataagaagcttgacttgaaaggtcaaattagtcatcaaggatttcaaaggagagatgttctcacttgctcggatcctcctagtgcccctattcaatcaggcaacgttattgctcggaagaggcgagttcaagctcagtttaacgagcttcaagaatactatcttcaaagacggcgtaccggagcacaatcacgtaggctggaggaaagagacatagtaacaataaataaagaaggttatcatgcaggacttgaggatttccagtctgtgctaacaacattcacacgatatagtcgcttgcgtgtaattgcggagctaagacatggagatctgtttcactctgcaaatatcgtatcaagtatcgaatttgaccgtgatgatgagctatttgctactgctggagtctcaaagcgcatcaaagtcttcgagttttctacagttgttaatgaaccatcagatgtgcattgtccagttgttgaaatggctactagatctaaactcagctgccttagctggaacaagtactcaaaaaatgttatagcaagcagcgactatgagggtatagtaactgtttgggatgtccaaacccgccagagtgtgatggagtatgaagaacatgaaaagagagcatggagtgttgatttttctcgaacagaaccctcgatgctagtatctgggagtgatgattgcaaggtcaaagtgtggtgcacaaagcaagaagcaagtgccatcaatattgatatgaaggccaatatttgctctgtcaaatataatcctgggtcgagccactatgttgcagtgggttctgctgatcaccatattcattattttgatttgcgaaatccaagtgcgcctgtccatgtttttggtgggcacaagaaagctgtttcttatgtgaagttcctgtccaccaatgagcttgcgtctgcatcaactgatagcacattacggttatgggatgtcaaagaaaattgccctgtaaggacattcagagggcacaagaatgaaaagaactttgttgggctgtctgtaaataacgagtacattgcctgcgggagtgaaacgaatgaggtttttgtttaccacaaggctatctcaaaacctgctgccaaccacagatttgtatcatctgatctcgatgatgcagatgatgatcctggctcttattttattagcgcagtctgctggaagagcgatagccctaccatgttaactgctaacagtcagggcaccattaaagttcttgtacttgctccttgatgaaatcagtggttttcatgagatccctagatagcttgtatatttgatgtatacagttgtttccttttcgtgccattataccccaaatgggagtggaggtattactgatctccaacatagggcgcaaagttttgaaggtaatcagctgacatagggtttcgagggctcgaaatgtgcatagtccagaattctcatgtataggtttaaagcagtcaagtaattgattatacatatgtaacgtgagaattgagaaatgaacatcaaataagcttgtttggttgcatataaaaaaaaaaaaaaaaaaaaaagggaagacaagctgtactgggctgatttcagcaacacaagccagtttgtcacacatctgctacctaacagaaatagttaaaaaaaaaanaaaa

SEQ ID NO: 3082 - DNA, 2974 bp, Oryza sativa
  Clone ID: PAT_MRT4530_14565C.1
catctttcccccctccgccgccgccgccgccttcttcccgggggcggggcggggagaggaggctcgggggagcagggatatagtatctttttttttttttttttttttttttttttttttttttttttttttgcacataaactgcagatgaaaaccatctggtcactttatacaagccgtacatcagctaaatgaagatttttactacctgtaactaacatgcaacaatcatcatctcattgttcaagagttcaaacattatcgtcgtcatcatgggacgaggaaaatttgccagacacgcaccagagatgggagaacatctggactctggtctcttctaagtgaagctaacagtaaggctaaggtaacaactcccaagaggccaaagataagacaacagcaatcctgaaacaacatgagacccaaaaagaaacggtgcgggcgattcccaagcacaacgtacactggcagtcgttattcgtgatgtccgtcgaagatttcagcgctgctgccaatggtattatgttcttagaaccacttgaacagcagaccaccgtgtgtggcgaagaaaggcgcaaacacaagggactcgacggccatgagcttgatgaggatgttgagcgacgggcctgatgtgtccttgagggggtctccaatggtgtcaccgatcacggcggccttgtggcagtctgatcccttgggccccagcgtccgagcatgctcactggcaccagcctcaatgtatttctttgcgttgtcccatgcgccaccagtgttggaggccgagatggcgatctgaactccggaaacgagggcgccagcgagaacgccagacagggtctccacaccaaagagggttccgacgatgaggggggtgagcatcaccaaagcaccagggggaatcatctccttgatggaagcatcagtggagatcttgacgcaggtggcatagtcaggcttgccagttccctccatcagcccaggaatggagttgaattgcctccgaacctcctcaaccatcttgagggcggcacttccaacactcttcatggtcatggcagagaaccagtacgggagcatggctccaacaatcaaaccgatgaagacctttggagacaggacatcaacaaccttcactccagctctgctgacgaaggcaccaaaaagtgcaagggacaccagagcagctgatccaatggcaaaaccctttccaatagcagcagttgtgttgccagcagcatcaagggcatcagttctctcacggattctgtggctcataccagccatctcggcaataccaccagcattgtcactgataggaccataagcatcaatggcaaggcctgttgcaatggtgcttagcatgccaagagcggcaacggctatgccgtacattgcagcaatagagaaactaacatatatgctgacagcaatagcaaaaattgggatgataactgatttgtatcccagagcaagaccaaatatgacattagtggcagcaccagttctgcaggaatctgcaacatcttgcacagggctgtatgcattgctagtgtagtactctgtcacaaaaccaatgatcagaccagcccacagaccaattgcaacgcagaagaacaagccccagttggtaacttccttctgagcaccaaaattgaagatggtgaactttgctggaagggccaaccagctgattattgcaataccaacagtcatcaaagcagtggagatgatgagctgcttcttcagagcaggttcaatttctttcactgccttgatctcaaagaagtcagttgcaaagagtgtggtgatcaaacaaacaatgatgcccacagagctgacaagcagtgggtagcacatcccagtgaaatcatggttgattccaaaagatgagatagatgcaacaacaagagcagcacaggatgattcggcgtatgacccaaagagatctgatcccattccagcaatatcaccaacattgtcaccgacattgtcagcaatcacagctgggttcctgggatcatcttcagggatgttcctctcaaccttgccaacaagatcagcacccacatcagcagccttagtgtaaatacctccaccaacccttccgaagagagccatggaagatccaccaagaccataaccagtgatagactcaaaaagaccttcccagtcatcaccataatacaacttaaatacattaatggcgatgtaaagaaccacaagaccacttgatgccagcaagaagcccataacagcaccagagcggaaagcaatgataaatgccttcccaacacccttccttgcttccagggtagttctggcattggcaaatgtggcgatcttcattccaaggtaaccagagaccaaagaggtgatcgctcccagcaagaaagatgcagtgctaaagagcgcgttgaaaagggcaggcttgcagtacttgtccttgctgtatgtgcaaggctggctctttgtactgaatccctcgactgaaccaaggaagaggaagatcacgacagcgaagattgacatgaagataccaacatattggtactccgtgaagagaaatgatgttgctccttcggagatggcggtctggatctcgtggcacttgacgacgacgtcgtggtcgttgagcccctcctcctcctcgatgaggtagtccccgtacccgtcgttcttgctcccccccacccactgcgcgatcgagaacccgatcgcgatgatcgccgcgagcgggaccagcagctaggtcgccacatccgacaggatcgccatggccgcaaaccctcctcgacctgctacctgctgcaggctctctctctctctctctctgtgtctctctctctataccgctgtactctatcacggttgcaacggaggcgaggcggcggcggcggcggcggggaggaggtgacgcgtctctaacgcacgtaactcgacacgtaacaagatgtgaattcggaactacagc

SEQ ID NO: 3083 - DNA, 2889 bp, Oryza sativa
  Clone ID: PAT_MRT4530_14624C.1
caagaaactccatcaaattccccagccaaaaacactcagataattttttttattagaaaaaaagaaaggagattagccagccagtctgctgctccatcctcagtgctcacgcactcactctgaggagtgaaatccaatccagcccactccggagttcctggaaaatcctcgcgaagtccgaagaaaaaaaatattaccactgccatttcttggtttcttgatagcttctcctagctgctgccgcccaatcatccgagagagcgagcaagtaagaaagattgattgattgcttgattgggagtgtcctttgggcgagctgtggtgggatttagcggcatgtcagcgtcgccgtcgtcgatgaagcggcgccggcgccggcgaggcgggggtgcggacggtggtgtggttcaggcgggacctgcgcgtggaggacaacccggcgctggcggcggcggcgcgggcggccggggaggttggtgccggtgtacgtgtgggcgccggaggaggacgggccgtactacccggggcgggtgtcccggtggtggctcagccagagcctcaagcacctggacgcctcgctccggcggctcggcgccagcaggctcgtcacccgccgctccgccgacgccgtcgtcgcgctcatcgagctcgtccgcagcatcggcgccacgcatctcttcttcaaccacctctacggatccattgatccagaattccagatagacccgctgtcgctggtgagggaccaccgggtgaaggcgctgctgacggccgagggcatcgccgtgcagtcgttcaacgccgacctgctgtacgagccatgggaggtggtcgacgacgacggctgcccgttcaccatgttcgcgccgttctgggacaggtgcctgtgcatgcccgacccggcggcgccgctgctgccgcccaagaggatcgcgcccggcgagctgccggcgaggaggtgcccctccgacgagctggtgttcgaggacgagtccgagcgggggagcaacgcgctgctggcgagggcgtggtcgcccgggtggcagaacgccgacaaggcgctggccgcgttcctcaacgggccactcatggactactcggtgaaccggaagaaggccgacagcgccagcacgtcactgctgtcgccgtacctgcacttcggcgagctcagcgtacgcaaggtgttccaccaggtgaggatgaagcagctcatgtggagcaacgaggggaaccacgccggcgacgagagctgcgtcctcttcctccggtccatcggcctcagggagtactcgaggtacctcacgttcaaccacccgtgcagcctggagaagccactcctggcgcacctcaggttcttcccctgggtggtcgacgaggtgtacttcaaggtgtggaggcaggggaggacagggtaccctctcgtcgacgccgggatgcgcgagctctgggccaccggctggctgcacgaccggatacgcgtcgtcgtctccagcttcttcgtcaaggtgctccagcttccatggcgctgggggatgaagtacttctgggacaccctgctcgacgccgacctcgagagcgacgcgctcggctggcagtacatctccggctctctccccgatggccgtgagctcgaccgcatcgacaaccctcagcttgaaggatacaagtttgatccgcacggggagtatgtccggcgatggctgccggagctggcaaggctgccgacggagtggatacaccacccatgggacgcaccggagtcggtgctccaggctgcagggattgagctaggctccaactatcctctccccatcgtggagctggacgcggcgaagaccaggctgcaggatgcactgtcagagatgtgggagctcgaggccgcgtcacgcgcagcgatggagaacggaatggaggagggcctcggcgactcctccgacgtgccgccgatcgccttcccaccggagctgcagatggaagttgaccgagcaccggcccagcctactgttcacggaccgacaacggctggccggcgacgagaggatcagatggttcccagcatgacctcctcgctggtcagagctgaaacagaactttcagcggattttgacaacagcatggacagtaggccggaggtgccgtcgcaggtgctcttccagcctcggatggaaagggaagaaacagtggacggcggcggtggcggcggaatggtcggcaggagcaacggcggcggccaccaaggccaacaccagcagcaacagcacaactttcagactacaattcaccgggcacggggcgttgcgccgtctacgtcagaggcatcaagcaactggactgggagagaaggcggcgtggtgcccgtctggtcgcctccggcagcgtcaggcccctcagatcactacgctgccgatgaagctgacattaccagtagaagttatttggacaggcatccacagtcgcatacgttgatgaactggagtcagctctcgcagtcattgtgagttcacacgcacggacaacaggctgggaagtggaaaattaatgctgattgtcagaattaatcattaggaaggtcgacattgagaagaattcatatgtaaattatcaccttttgtttgtctatagccttggtgtgcatgaatcaagtgatgaagcttccttgatgcaataatgattatgtaaagctagttttacagaacatttgtggtataggtttgctagttgtcaaaaggatatgtactatttgttagataagaggttattctagcattatgtcttagacttgtacattctccctttggttattgtaatcttggtggaatagtcatcccagagatctcagttagactcaaaaaaaaaaaaaaaaaaaaaaaaaaaaaaaaaaaaaaaaaa

SEQ ID NO: 3084 - DNA, 1354 bp, Oryza sativa
  Clone ID: PAT_MRT4530_14668C.1
ttttttttttttttttttttttgaaccacgtaaaaagggttggaatcattgaagccttttctgttgcagatgccatggaagtttgatggctgcagccgcgtagtgcaaccatgtgacctcggtactagcgtacaccgctttggcacaaagccatgtgaagcgccgtatcggtgtgcccgtgccgggtgtgggggtggtacacatgtagcgcatgtgatcatggcaatggtgacgcgatgcatgatacagtgaatgttgtaggagtatatgtgagctgctccagaagagctgtgaacctgctgggttttttttttttttgcacctacaaaagacattaattaataatactagtatttagcacaaatattccagcaatgtgaaaaatctaatggtacaaaacttagtcttacggactacatggggtctcaaagtcatacagtcgaccaaaacgctaggctcctgcttcaacaattgtatcagcagcggcggggtttttcccgaagggtacacaaatgcttccgaagaacatactcaatccctatagcttttcaagactccataacacaagcgcttacaaaaacacaccgagcccccctaacatttccagcaaattggaactaggcgggttacgcgttatttgcgtagggggactcctcgcggttggctggctgtgctggtgatctgctgtagcttcgctcacgaggaggtggaggtgatcggctgtagcttcgtgcacgagctggtggtggcgacctgctgtagctgcgcctctttggagaacgatcccgtgggccttctaccatagcttgggctcctccggtatcttgggctgcggctgcgactacgaccgcggtaccttggactccggctacggctgcggctgcggcgtcttccactgccaaggcctccagaaccaatccgtaagcggcattcacgtgcaaaatgaccaggttcgccacattcatagcacttcatgtcagaaccaccggaacgatctcggccacgaccactaccagctttggttgacagctcaaccctccatccattcttgccatctaaatcacgaattgcatcttctgcatccctgcggtcatcaaagtcaataaaggcaaaacctggtggttttctagcaacccatacactcctcagaaccccaaacacgcggaactcgtcctcgatctcccgcgccgtcacgcgcggatccaggttccccacgtacacgcgagccatgagcgcgctcgaccctttgcgggcgcgtccgccttgggggggatttgggtttcggggtaggcgaggaggaggaggaggagcggctctagggttttaagctcgagccgtcgagcccacgtgtccg

SEQ ID NO: 3085 - DNA, 1577 bp, Oryza sativa
  Clone ID: PAT_MRT4530_14815C.1
cccacgcgtccgctctccaccgcggcgtctctctctctctctcctcccccacccccaaccaccacttcctccatcaccaaagcgccgctccctcgccgtcgccgccacctccgccgccgccgccggtgccggtcgtcgaggcgggaggactcctccccgcgcgccgcgctcgatccgtccgctccccagtacgcccgagggcagtgatactctgctgcttagttgggtgcagtgtgcactacaagtctacaacaatggagcttgacagtctaagagaggcgtttgatcgagttattgaaaaacgtgcttcctcttctgctaaagctcaggaagttattgatcagatagtgagtgaagttgagcaggcaatcacgaagatgcagatgatgaatacagattccatgggtactgctgaccattcatccatcctggcagaattgaaagccaagttgaatgaattggcgccactaaatcaactagaaggttgtcaaaaggaattgaatgttgcacttagcaaatatctcaagctgctcgagaagtctttcagtccagacatatcgaaagcatatcgaaatgtggattttgaggccagtactataaacagcataatagcaaatcatttctaccgccagggcctttttgatcttggagactcatttgtccgtgagtgtggtgaatcagatggggcacacttgaaactacaattccaagagatgtattcaattcttgaagcaatgcaagttagaaacctccaacctgctctcagttgggctgccaagaaccatgatcagcttttgcagaatggttcaatgcttgagttgaaacttcatcagcttcagtttgttgagatactaacaaaaggaagtagagatgaggctttaaagtatgcaagaactcacttagtgccctttgcatccttgcacaaggcagagatccaaaagctaatggcctgccttctctgggctgataggcttgatcagtccccttatgccgaattcatgtcatcgactcattgggagaagctagcagaggagcttacccatcaattctgcagtcttttggggcaatctagtgagagcccacttggtgtggcagtatcagctggctttcaaggacttccaaccttgctgaagctaacgacagtgatggctgccaaaaaacaggagtggcaggcgatgaaacaactgccagtacccatagatatcggaccagaattccagtaccactctgtctttgtatgtccggtgctcagagagcagtcgagtgatgaaaaccctccaatgctgatgccctgcggacacgttgtgtcgaaacaatcgataatgaagctatcaaagagcagctccagacccttcaaatgcccatactgtccctcagaggctgttgcttctcagtgcaagcagctacatttctgaatgttctttccctgctcagatatgtttatacacgtgttaatttatgttcctgtggcacccatccaataactaccttgtaatataatcctgtatgttaatgaacattctagtgctgtctctggatgttaatctgtacagttgcaaattcctgttcgttttatc

SEQ ID NO: 3086 - DNA, 1069 bp, Oryza sativa
  Clone ID: PAT_MRT4530_14868C.1
ggtgtgtgtgtgtttgttttttttttttttttttttttttttttttgaagaaaaatttaacatatcttagatttatcttcttgaacagacacaaggttcgacgacaccactatagattaattcaacagcatcagcagactactaatagacacacatcccgtccaatatactcctgcttttcttgttatgcgttgccctactgtcttggattgttcgaaattaatccaaatcttaacaatattattacagggcagcatttaacaattcacagttcttttttttcttttttctgtgaagaaaaatttaacatctcttaaatttatcttcttgaacagacacaagcacagatcacaaggttcaacgacaccaccatagattaaatcaacagcattagactactaacagacacacatcccgtccaatctactccagctaaacaagcaaagcgaggcgccgacgcctaggccttcttgggggacttcccggcggccttcttgggcgacttggcctccttgccggcggcggcggccttctccgccgtcttcttgggcagcagcaccgggttgatgttgggcagcacgcctccgtgcgcgatggtcacgccggccagcagcttgccgagctcctcgtcgttcctgatcgccagcagcacgtggcgcgggatgatcctgttcttcttgttgtccctggccgcgttcccggcgagctccagcacctcggcagcgaggtactcgaggacggcggcgaggtagacgggggcgccggtgccgatgcgctgggcgtagcggcccttcttgaggtagcggccgatacggccgacggggaactggagcccggccttgacggagcgcgacaccgccttcttcctcggcccgccggccttcctcccggcggctcccttcttcaacttcccacccgctccggctccggcggcgtccatggctagcctagctaagctggttgctgctgctgtcgaaggcgaggaggatttttttttcccttttctttagtcgaatgcgatatgccgatcccggccgggcctcgaggaacccaatcgcccataggagtc

SEQ ID NO: 3087 - DNA, 1101 bp, Oryza sativa
  Clone ID: PAT_MRT4530_14871C.1
gaatacaatctcataatgtatgtaaagcaatcacattacatgatatcaagctaaaaagtgccactacataacatgagaaacagcatttccccaaccacccaagcaccccaaatggcaatgctattttcaataattacccaaacacaaacgaagaaccaaataacccaccaggaggcatatatgtgcatccactaccaaacacagatcaattgttcgaaattatccaaatcttaacaatattattacaggcagcatctaacaattcacagttcccccatccctctgcccagaccacactcctcgaccctacaccggtgttaacctacacgggtacaaactgattggcttgactgtccatctattcagaaaacaccacaaattacgtacaaacaaccgaaccgattcacgacaaatgatatagcatgcaacgaagacgatgatgatgacgattgacaacagataggagcgtttcagttcagacaagagggagagggaagcgggggacaccaccaccaagccggcattgcgtgtgccctaagcggccgccgccttctttggcgacttggtggtggccttcttgggcgacttgggggtcttaccctccttggcctccttggccgcggcggagccggtcttcttggggagcagcaccgggttgatgttgggcagcaccccgccgtgcgcgatggtgacgccggccagcagcttcccgagctcctcgtcgttgcggatcgccagcagcacgtgccgcgggatgatccggttcttcttgttgtcccgcgccgcgttccccgcaagctcgagcacctcggcggcgaggtactcgaggacggcggcgaggtagacgggggcgccggtgccgatgcgctgggagtagcggccttgcttgaggtagcggccgatacggccgacggggaactggagcccggccttgacggagcgggacaccggcttcttcttcggcccgccgccgccgcggcggccgccggcgccggccttcttgggcaccttcgctcccacctccatcgatcgcgacgagctcctcctccccaagctttctccctcttctgttttgttcgatttttttttcttcctattttt

SEQ ID NO: 3088 - DNA, 1356 bp, Oryza sativa
  Clone ID: PAT_MRT4530_14919C.1
atggagttcgtcgccaacggcaaggtcatcctcttcctcctcttcgtctccacatcggtgctcatcgtctcccccgcctcgccgccgcgcttccactacatcaaccctcacaacttcaccacgccggcgtcatcgtcgtcgtcggcgtcggcgtcggccgttcaccgtagccgcaacaacaacaacccttcgctctccttggtgcaccgcgacgcgatctccggcgccacgtacccgtcgcgccggcaccaagtcgtcggcctcgtcgcgcgcgacaatgcccgcgtcgagcacctggagaagcggctggtggcctcgacgtcgccgtacctccccgaggacctggtgtcggaggtggtgcccggcgtcgacgacggcagcggcgagtacttcgtccgcgtcggcgtcggctcgccgcccacggatcagtacctcgtcgtggactccggcagcgacgtcatctgggtgcagtgccgcccctgcgagcagtgctacgcgcagaccgacccgctgttcgacccggccgcctcgtcgtccttctccggcgtgtcgtgcggctccgccatctgccggacgctgtcgggcaccgggtgcggcggcggcggcgacgcggggaagtgcgactactcggtgacgtatggcgacgggtcgtacaccaagggggagctcgcgctcgagacgctcacgttaggcggcacggcggtgcagggcgtcgccatcggctgcggccaccgcaacagcggcctcttcgtcggggcggccgggctgctcggcctcggctggggcgccatgtcgctcgttggccagctcggcggcgcggcgggcggcgtgttcagctactgcctggcgagccgcggcgccggcggcgccgggtcgctcgcgtcgagcttctactacgtcgggctgacggggatcggcgtcggcggcgagaggctgccgctgcaggacagcctgttccagctcaccgaggacggcgccggcggcgtggtgatggacaccggcacggccgtgacgcgcctcccgcgggaggcgtacgccgcgctgcgcggcgcgttcgacggcgccatgggcgcgctcccgcgctcgccggccgtgtcgctgctcgacacgtgctacgacctgagcgggtacgcgagcgtgcgcgtgccgaccgtgtcgttctacttcgaccagggcgccgtgctgacgctgccggcgaggaacctgctggtggaggtcggcggcgccgtgttctgcctggcgttcgcgccgtcgtcgtcggggatctccatcctggggaacatacagcaggaagggatccagatcaccgtcgactcagccaacggatacgtcggcttcggacccaatacatgctag

SEQ ID NO: 3089 - DNA, 1422 bp, Oryza sativa
  Clone ID: PAT_MRT4530_14922C.1
atggagttcgtcgccaacggcaaggtcatcctcttcctcctcttcgtctccacatcggtgctcatcgtctcccccgcctcgccgccgcgcttccactacatcaaccctcacaacttcaccacgccggcgtcatcgtcgtcgtcggcgtcggcgtcggccgttcaccgtagccgcaacaacaacaacccttcgctctccttggtgcaccgcgacgcgatctccggcgccacgtacccgtcgcgccggcaccaagtcgtcggcctcgtcgcgcgcgacaatgcccgcgtcgagcacctggagaagcggctggtggcctcgacgtcgccgtacctccccgaggacctggtgtcggaggtggtgcccggcgtcgacgacggcagcggcgagtacttcgtccgcgtcggcgtcggctcgccgcccacggatcagtacctcgtcgtggactccggcagcgacgtcatctgggtgcagtgccgcccctgcgagcagtgctacgcgcagaccgacccgctgttcgacccggccgcctcgtcgtccttctccggcgtgtcgtgcggctccgccatctgccggacgctgtcgggcaccgggtgcggcggcggcggcgacgcggggaagtgcgactactcggtgacgtacggcgacgggtcgtacaccaagggggagctcgcgctcgagacgctcacgttaggcggcacggcggtgcagggcgtcgccatcggctgcggccaccgcaacagcggcctcttcgtcggggcggccgggctgctcggcctcggctggggcgccatgtcgctcgtcggccagctcggcggcgcggcgggcggcgtgttcagctactgcctggcgagccgcggcgccggcggcgccgggtcgctcgtcctcggccggaccgaggccgtccccgtgggcgccgtgtgggtgccgctcgtgcgcaacaaccaggcgtcgagcttctactacgtcgggctgacggggatcggcgtcggcggcgagaggctgccgctgcaggacggcctgttccagctcaccgaggacggcgccggcggcgtggtgatggacaccggcacggccgtgacgcgcctcccgcgggaggcgtacgccgcgctgcgcggcgcgttcgacggcgccatgggcgcgctcccgcgctcgccggccgtgtcgctgctcgacacgtgctacgacctgagcgggtacgcgagcgtgcgcgtgccgaccgtgtcgttctacttcgaccagggcgccgtgctgacgctgccggcgaggaacctgctggtggaggtcggcggcgccgtgttctgcctggcgttcgcgccgtcgtcgtcggggatctccatcctggggaacatacagcaggaagggatccagatcaccgtcgactcagccaacggatacgtcggcttcggacccaatacatgctag

SEQ ID NO: 3090 - DNA, 3261 bp, Oryza sativa
  UNSURE (1)..(3261): unsure at all n locations
  Clone ID: PAT_MRT4530_15007C.1
  unsure (1)..(3261): unsure at all n locations
atggccggagcgggagccgtgggggggagcaactgggaggagatggtgaggaggatgctcccaccggggaccaccatcccggaggcgccggccaacctcgactattcgattgcgctcgagtacgacggccctccggtgtcctacgagctccccaggatcgatcccgtcgacctgccggcgattcccaccgcgcagcccgtctccggcccgctggtgcccgggaggagcaacggcgtggtggctccggtcgtcaggccggtgtttatgccgccggtgcaccggaagcaggatgctcaccgtgccgagccaccgccggttgcggcacagggtaggaggaggagaagctcggaatcggtcgattcggcgccgcagaatgaggggttctctgatgatgatgactcatgctcggtgtcgcaagaatccgcgcacaatttccatgggcagagaggtggtaggacagctgctcaggagggaagaagagctcaggttgtcacatttggggtcactgaggacagcaggtatgagagcaaagagtttgatgatgtgtcggaacagtacgtggcggtgaccaagaaggagaagagagggaggacctgcagccgttgcggtaaaaggaagtgggagagcaaggaatcatgcattgtttgcgacgcgaggttttgcagctactgcgtgctcagggccatgggctcgatgccagaagggcgcaagtgcatcacttgcattggccagccaatcgatgagagcaagcggtcgaagctcgggaagggttcgaggatactatcacgtctgctcagcccgttggaagtaaggcaaatactgaaagctgagaaggaatgccaagcaaaccagctccggcctgagcaactcatcataaatggttttcctcttaatccagatgagatggccagcttgcttagttgccaacggcctcctcaaaagctcaagcctggaagatattggtacgacaaggagtcaggcttgtggggaaaggaaggagaaaagccagacagggttgtcagcactaacctaacctttaatggaaagcttcagcccaatgccagtaatggcaacactcaggtttatatgaatggaagggaaattaccaagattgaactgagagttctgaagattgcacaagttcagtgcccccgtgacactcacttttgggtttaccatgatggtggctatgaggaagaaggccaaaacaatatcaaagggaagatatgggaatcgcctgtgacacgttttgcatgtgccttgttttcactaccggttcctccagcaaactctgacgaaccaaaggacgaagctccttattcagcaagaactgttcctgattacttagatcagaaaagaatccaaaagcttcttattcttggatcgcctggagctggtacaagcaccatattcaagcaggcaaagttattatacgacactaggtttacccaagaagaacttgatagtatcaaacttatgatccaaagtaatatgttcaagtaccttgggatccttcttgagggccgtgagcgttttgaggaagaggctttggctggatcgaataacccaagctcagaggatgagaatacgcagcatgatggaaataaatcgaatggttcagattcttgcatatactcgataaatgcaaagctgaagaagttctcggattggcttttggatataatagcaatgggagacctcgatgcattcttccctgcagctacgcgtgaatatgctccaattgttgaggaaatgtggaaggatcctgccatacaagcaacatataaaagaaaagacgaattgcattttctccctgatgttgccgaatatttcttgagcagggccattgaagtatcaagtaatgagtatgaaccttcagagaaagatataatatatgctgaaggagtaacacaagggaatggattagccttcattgagtttactctggatgaccgtagccctatgtcagaaatgtacactgacaatcatgagcctcactctcagacactaaacaaatatcagctgattagagtaagtgccaagggaatgaatgagggatgcaagtgggtggaaatgtttgaggatgtcagcatggtaatattctcggtagcactcagtgactatgaccagctgggggccccttcaagtggtggcaacagtccccttgtgaataagatgatccaaagcagggacttgtttgaggctacaatcaggcaaccatgtttccgcgacatgccatttgttcttgtgctcaacaagttcgacctcttcgaggagaaaatcgggcgcgtcccgctctccacctgcgagtggttcagcgacttctgccctctccggactcaccacaacaatcagtcgcttgctcagccaggcgttctactatgtcgcgatgaaagttcaaggcgttgtacgccgcctgcacggatcgcaacctgttcgtgtgccaggcgcgagcccgcgacagactgaccgtcgacgaggccttcaagttcatcagggaggtgctcaaatgggaggatgagaaggatgggggtgggtactacccagatgagtccttctacagcaccacagagctcagctcctcacgtctgatcagacaagaatgatgcacattttgcccagaaagaaactggagattgttgctcttcttttttcagtagtattttttcccctgggtgatttgcaaccgatttcgttctgtgcaggcagagatctcgttactgattgtattgtatagtagtattgctgtattagtttgtcagatggagatgatgattattgtgtgttctttatagatcattaattaatacactttcatactaatttgccagtcaaatatatgcaaccccgcgaaatggttagcttgtcctttcgccgaattggtacagaaaacattggatatggttgtatattgattttacaggttatcctgatcgaaattgttgctgttcatcacctgaagagaataggatccgttggtcctgttgttgcgctagcctgtactaatttttttcgaaacaaatgtacaaagaaagaaagaaaaagttgtgtgatatgtttgtgatttgtaccaataaaaaggtaaaaagcaaaagtgtggatgatagtggccatattgtttggtgaactaaccttagctacactagctgtaaaatcatgtagcagttcagctgttctgtcgggttgagaaaaataaattgacatccacattcaagnctaaaaaaaaaaaaaaaaaaaaaaaaaaaaaaaaaaaaaaaaaaa

SEQ ID NO: 3091 - DNA, 2256 bp, Oryza sativa
  Clone ID: PAT_MRT4530_15014C.1
atgggcggagagaggccgccgccgatcagcggcggcggcgccttcgcgttcatctccaaggggtggcgcgaggtgcgggactcggcgagtgccgacctgaggcagatgcgggcgcgcgccgaccgggagctggagcacctcctcgcgtcggcgtcggcgctcgcgggcccgccgctgccgccggtcgcggcgggggcgcccatcgcggaggtggagttcgtgcggaagcggatccagcccaagatcatggagctgcggaggcagtactcgtcgacggtgcgcgacgcggggtgggcccccaaggccgccggggccagcctccgcgtcgacctctcggggattacggcgatccgcaacgccattgtggccgaggggggcggcggcggcggcggcggcgggaggtgggggctcgtgcggtggaagggccacgcggacgacgaggggaggaaggagtgggaggtggtgaggatgatacgcagcgggctgaaggagttcgagcgccggagcttgtcgagtgaggtgtttggtggatttcgtggccgcggcgagttcgtggagaaattcaagttgagcttgaaatctctgaacaaagagtcacaagaatccaaggaggttctcccactggatcttactgaaattctggcatatcttgtgcggcaatctggaccatttctggaccaacttggtattagaagagatttatgtgacaaaattgtggagacattgtacagtaaacacaatggccggctcatttatcattctctttcagctgatagatctttaattggaaatgagaacatgactgatgagcttgatctgagaatagcaagggtgctagaaagtactgggcatcacacagaggaaagtttttggaaggatcatgcaaagtacaagctctcggacaaccggcggcatgttgcaattgtcacaacagcaagtcttccatggatgactgggacagcaatcaatccattattccgtgctgcgtatctagcaagaagtacaaaacagaagttcaccagaagaacagaaaattacataaggaactggctacaggaaagacttggctttgaagcaaattttaagatatcattttatcctggcaagttttcgaaggagcgacgtagtattattcctgctggagatacttcacaattcatttcctcgagtgaagctgatatagcaattttggaagaaccagagcatctcaactggtatcatcatggaaagcgttggaccgacaagtttaaacatgtcattggtgtagttcacacaaattacctagagtatatcaagagagagaagaatggagctcttcaagctttccttgttaagcatatcaacaactgggtgactagagcatactgtcataaggttttacgtctttctgcagcaactcaagatctacctaggtctgttgtctgcaacgttcatggtgtaaatccaaagttcctcaaggttggtgaaaaaatagcagctgataaggagcatgggcagcagagctttacaaagggagcatatttccttgggaagatggtttgggctaaaggatatagagaacttatagatttgttatccaaacacaaaagtgacttggagggctttaatgtagatgtatatgggaatggtgaggactcacaagcagtgcagatggctgctaggaaattgaatttgagcctcaattttttcaaaggaagggaccatgcagattcttcgcttcatgggtataaggttttcattaatccaagtgtcagtgatgttctatgcacagcgacagctgaggctcttgcaatggggaaatttgttatctgtgcagatcatccatcaaacgaatttttcaagtcattccccaactgcttaacatacaaaacttccgaagaatttgttgcccgagtgaaagaggccatggctagtgaaccttcacctttgacccctgagcaaaggtacagtttgtcatgggaggcagcaactgaaagattcatggagtactcagagcttgacaaagttctgaataacaaaattggttattctggacaagatgggaagagaagtaaagtgagaaagatacctttacttcctagactttcagaagttgtggatgggggactggcctttgctcatcactgcttaactggcaatgagatcctcagattggcgacaggagcaattcccggtacacgtgactatgataaacagcaatgcatggatttgaatttattgcctccccaagttcaacaccctgtatatggctggtga

SEQ ID NO: 3092 - DNA, 3840 bp, Oryza sativa
  Clone ID: PAT_MRT4530_15016C.1
atgggcggagagaggccgccgccgatcagcggcggcggcgccttcgcgttcatctccaaggggtggcgcgaggtgcgggactcggcgagtgccgacctgaggcagatgcgggcgcgcgccgaccgggagctggagcacctcctcgcgtcggcgtcggcgctcgcgggcccgccgctgccgccggtcgcggcgggggcgcccatcgcggaggtggagttcgtgcggaagcggatccagcccaagatcatggagctgcggaggcagtactcgtcgacggtgcgcgacgcggggtgggcccccaaggccgccggggccagcctccgcgtcgacctctcggggattacggcgatccgcaacgccattgtggccgaggggggcggcggcggcggcggcggcgggaggtgggggctcgtgcggtggaagggccacgcggacgacgaggggaggaaggagtgggaggtggtgaggatgatacgcagcgggctgaaggagttcgagcgccggagcttgtcgagtgaggtgtttggtggatttcgtggccgcggcgagttcgtggagaaattcaagttgagcttgaaatctctgaacaaagagtcacaagaatccaaggaggttctcccactggatcttactgaaattctggcatatcttgtgcggcaatctggaccatttctggaccaacttggtattagaagagatttatgtgacaaaattgtggagacattgtacagtaaacacaatggccggctcatttatcattctctttcagctgatagatctttaattggaaatgagaacatgactgatgagcttgatctgagaatagcaagggtgctagaaagtactgggcatcacacagaggaaagtttttggaaggatcatgcaaagtacaagctctcggacaaccggcggcatgttgcaattgtcacaacagcaagtcttccatggatgactgggacagcaatcaatccattattccgtgctgcgtatctagcaagaagtacaaaacagaaggtgacactggtggttccttggctctgtaagtcagatcaagagctagtttaccccaataatatcaccttcagttcaccagaagaacaagaaaattacataaggaactggctacaggaaagacttggctttgaagcaaattttaagatatcattttatcctggcaagttttcgaaggagcgacgtagtattattcctgctggagatacttcacaattcatttcctcgagtgaagctgatatagcaattttggaagaaccagagcatctcaactggtatcatcatggaaagcgttggaccgacaagtttaaacatgtcattggtgtagttcacacaaattacctagagtatatcaagagagagaagaatggagctcttcaagctttccttgttaagcatatcaacaactgggtgactagagcatactgtcataaggttttacgtctttctgcagcaactcaagatctacctaggtctgttgtctgcaacgttcatggtgtaaatccaaagttcctcaaggttggtgaaaaaatagcagctgataaggagcatgggcagcagagctttacaaagggagcatatttccttgggaagatggtttgggctaaaggatatagagaacttatagatttgttatccaaacacaaaagtgacttggagggctttaatgtagatgtatatgggaatggtgaggactcacaagcagtgcagatggctgctaggaaattgaatttgagcctcaattttttcaaaggaagggaccatgcagattcttcgcttcatgggtataaggttttcattaatccaagtgtcagtgatgttctatgcacagcgacagctgaggctcttgcaatggggaaatttgttatctgtgcagatcatccatcaaacgaatttttcaagtcattccccaactgcttaacatacaaaacttccgaagaatttgttgcccgagtgaaagaggccatggctagtgaaccttcacctttgacccctgagcaaaggtacagtttgtcatgggaggcagcaactgaaagattcatggagtactcagagcttgacaaagttctgaataacaaaattggttattctggacaagatgggaagagaagtaaagtgagaaagatacctttacttcctagactttcagaagttgtggatgggggactggcctttgctcatcactgcttaactggcaatgagatcctcagattggcgacaggagcaattcccggtacacgtgactatgataaacagcaatgcatggatttgaatttattgcctccccaagttcaacaccctgtatatggctggtgaggagacggcgcgtcaactcatgatgttgatagccacttctttctgagatttttcagggactttgaagcaggcaagtcgtgccaggttatcgacagattctgcaattttctttacttgtgtaaccaagtctgaaagaagtgatgcagtaactgccacatgcatcacttgcagcagagctttatcctctgatagctcgctcctgagtgttttggcagctttgatggctgcagacatggaggttgtagatggtacggtcattgttcgaagtgctgccgagagctctctgagtgcctgagcagagtgtgagctcatctcactgcatgctgttcgtactttgaaggacagctcaggattggcttcaggatactgagattttgtgagtgtgatgacataggaagccatagcctccatggaagaagcgcactggcgagaaagagctccaatcttctggtattggctccatgggtgtttgaaactgaattttccatgaccaggctcccatctggcaaagttgcacagagagtcttcagtggccttcgaattaagtatgctcttgtacgcttggagaaaggctttgccctccaaactctcactcgtagcgctttctccaaagcattcggtttccattccttcaaggaagtcggccagcttgtcgaggttgccggcggcgagcttgtggaggtcctcgccggcccagacgggcatgacgaagatggtggtgcagaggcaggtggcgacgccgacgacgatggtggagaagcgctggtgcgcgagctggatgagctcctctacccggtagctcgacacggccaccaggctgaaggtcaggatgaagatggtcaccccgtagtcgtacctcgcctttatctccggtatgaaccgcgagaacgtcgccgccgacgctagtaggaagacgaagacggcgaggagtatgggctctccctgtgcgccgcaccggttagccacctgatgcgccccgacggcgatgaacccagccaccagcgtcgcgaaggccctgttcaaccctttgctcagcgtgccaccgacggtgtactccatgacgacgacgacggtgagcacggcccagagcgtggagaccccgaaccccttgaaaagcggcgtcacgtagtagagcacggacaccagcgtcagcgccagcccgaccttgagcgagtgcgccaccctcctcgggtcgtccgccgcgatcccgcccaccttcctcgccagcccgcccacccacctcccggccacctccaccgccgctcgcacccgcgcccagcatccatccacccaccccccgccgacgacgacgaccacttggccgccgttctccgccgccgccgccgccgccggcgtcgtctccacggcagcagattgcatgatcgccttgaagtacgatgataagttatcgatcgagctagctatagctagtgatcgatgtagctaattagtatataatagtagcgccgcgtacgtacgtctttgagctgggggcttgatagatggagtaga

SEQ ID NO: 3093 - DNA, 2262 bp, Oryza sativa
  Clone ID: PAT_MRT4530_15145C.1
atggctaccactagtacactgcatcaggcggttgcctacttattagccgtcatgctcgtctgcttggcgccggtgacaccggcatcggctcagccatggccgggctgccccgacaagtgcgggaacatcagcatctcctaccccttcggcattggcgccggctgcgcccgggacaaagacttccagctcgagtgcgacggcaacactccgcacttcaactacctggatgatcgtgagaaaaagctggtgagcctttccatcgccgacggcgaggtccgggtcttcgtcgacgcgggaagcaactgccacgacgaccgcttcaaagcaatcagtgggcactaccgcacgccggactacggccgcagcatcgcctaccggttctccacagcgaggaaccgccttgtcgtgctcgggtgccccgtccttggctacttggttgacgccgacgataactatacgtacgtcactggctgcacatccacgtgccggcggtcgcagtcgcagggtgacttgccgggccagtgcaccggcgagtcggggtgctgccagaacaccatgccccgcgctctcaacgtctacaagccttacatactcacgttgaataagacagaggaaccaacgcgaaacgtccccgaccaacaggagctcccgccgacggaacccgtcttccgccatctcgactcaacaaaatgccagtatgtgttcgtggcggaggacaagtggatcaacaccacctacagctatcgcgccttcatcaaccgaaccagcgacttcaccgtccccgtcgtgctcgactgggccatccggaacgccggcaactgcgacatcgccgtgcgcaacaggacggactacgcgtgccggagcgcgcacagcgagtgcttcaacgccagcgacggccaggggtaccggtgcaggtgctccaagggctacgagggcaacccctacctcgacggtggatgcaaagacatcgatgaatgccaacgcacaaaggaatacccatgcttcggaaaatgcacaaacacaatcggaagctacacctgcgaatgccgaccggggactagtggaaatgcaacccaggagaatggatgcctcccaacggacaagttcacgttagctctgaaagtcgttacaggggtcagcgtgaggaagctcatcagaacgaagcaaagattctttgagcagaacggtggcgtgcttctccagcaacagatgagttcctatggtggcaccagcggcggagcgggtgggttcaagattttctccaaggaagagctcgagaaggccaccaacagctttgccgccgaccgtgttcttggccgcggtggctacggcatcgtctacaaaggcgtcctggaggacaacatggtggtggccatcaagaagtcaaagatgatagaggaggcacagaccaaggaatttgcgaaggagatgtgcatcctctcccagatcaaccacaagaacgtcgtcaagttgctcggttgttgtcttgaagtcgaagttcccatgctagtttatgagtttgtctcaaacggcaccctcgaccactacatccatggcagcactctcaacactgtcatatccttggactctcgtcttcggatagcggcagagtcagcagaggcactctcctacatgcattcttcagcctcaccacccatcctccacggagatgtcaagacggcaaatatcctccttgatgacaaactcaccgcaaaagtttcagattttgggacatcaaaactggtgcctaatgatgagttcgagattgcaactctggtgcaagggacatgtgggtacctagaccctgagtacctcatgacatgtcagctgactaacaagagtgatgtgtacagttttggtgttgtcctcctggagcttctaaccaggaagaaggcactctacttcggcggatcagaggaagacaggagcctcgtgtcttgcttcatgacggctgtgagagatggccgccatgaggaacttattgacagccaggtgaggaatgagatgacagaggaggtgctccaagagattacacacctcgtgatgcgatgtgtgagcatgagtggtgaggaacgaccgatgatgaaggaggtcgctgagaagctggagatgctgaggagataccagctacacccctgggataaaggtgatgccaatccggaggagaagcagagcttgcttgacatggaacagagaaatgtggatcagaagttcagacaccaccatgactatgatcctgaaaatccagcttgcagatcctag

SEQ ID NO: 3094 - DNA, 1878 bp, Oryza sativa
  Clone ID: PAT_MRT4530_1519C.1
ctgctgcagtggggcgcccggaggcttcttcttcctcctctcccctctcgccgtgctggtggtgagtgaggcggcgagcggcgagctcctccggtgatccgaggctcgccggccggcgagagcttgcctgtttcgggaggttttcagggtgatctgagagcacagcgagccgatggcggcggcggcgaacggggcggcgtgctgcggtggcgcgacggggccagggtacgcgacgccgctggaggccatggagaagggcccgagggagaagctcctctacgtcacctgcgtctacaacggtactggaattaacaagccggattacctgggtacggtggacgtggaccccaattcccctacatactcccaagtgatccacaggctcccagtcacccatgtcggcgatgagctgcatcactctggatggaacgcttgcagttcttgccatggtgatccatcggctagccgccgtttcttgattctgccttcgttgctgtctggccgtgtgtatgtcgttgacacgctgaaggacccaagggcgcctgccttgcataaggtggtcgaggctgaggacattgctgagaagacagggcttggatttcctcatacatctcattgcctggcatctggggagataatgatttcttgccttggggataaggagggaaatgctgctggcaatggcttcctcctgctggattctgaattcaatgtcaaaggacgttgggaaaagccaggtcacagccccttgtttggctatgattattggtatcaacctcgtcacaagacaatgatcagttcatcatggggagcacctgcagctttcaggactggttttgatcttcagcatgtgcaggatggtctctatggaagacatctgcacgtgtatgactggcctggtggtgagctcaagcagacactagatttaggcagtacaggtcttcttccacttgaggtgaggtttttacatgatccatcaaaggatactgggtatgtgggctgtgctctgacaagcaacatggtcagatttttcaagactgcagatggatcatggagccatgaggttgctatatctataaaaccattgaaagtgcgcaactggattctgcctgaaatgccaggactgataactgattttgttatctctctggatgatcgctatctctacttggtcaactggcttcatggtgatatcaggcagtacaacatcgaggaccctgcgaagcctgtgttggctggacaagtatgggcaggaggccttcttcaaaagggcagtgaggttgtgtatgtaactgaggatgacaaagaagagcagtacagtgtgccccaggtcaagggtcatcgacttagaggtgggccacagatgattcagctgagcctggatgggaagaggatatatgtgaccaactctcttttcagccgatgggacgagcagttctatggccaagatcttgtcaagaagggctcccacatgttgcagattgacgtcgacactgagaaaggaggactatcgatcaaccctaacttctttgtagattttggtgctgagccagagggtccctccttggcccatgagatgagatatcctggtggagattgcacctctgatatatggatataaagatcttgaaggatttgcatacactcaggtgttgattcatcctgtgtattcactgtaactaagactctatgcttgctgtggtttatatgtaatttcgatggtaacaagtccccataatacctagaacattcactccatggctcatttggtaacattagcttaataaagagatgtatccaatggtgcactttctgctaaaaaaaaaaaaaaaaaaaatctgattaaaaaaaaaaaaaaaaaaaaaaaaacgcccggta

SEQ ID NO: 3095 - DNA, 2060 bp, Oryza sativa
  Clone ID: PAT_MRT4530_15363C.1
ctaccatggttgttgatacaaggaaacaaagggcctgtttggggagcttctagctgctgcagcttctcccataatcagaagctcccccaaacagtccagcttttggtccagattctgagaagctgtagttgtaaaatccaggaaatgaactagaagccagaagctggaaaacccagcttttccagattctgagaagctggctaccaaccagctgcttctcagaatcttaagctcccccaaactctggctatagttaggggatttgtaccatccccacggctcatcggaggcgtactccgtcacttgcttgacgcttaggtagttgtcaatggccccttcttcgagctcgcgtccaaagccgctgtcgcttgtccccgcccccatggagcttgggagaagcagggttgcgcagcagttcacccagataattgccggtatcgatcttctcagttaatctctggcacgctgcgcttgttcccgccccatggagcttggcagaagcagggttgcgagcagttcacccagataattccggcatcgatctcctcagttaatctctggcatcgctcgcggtcaccggaaagcacagcaccagccagaccataatgagtatcgttggccaattcaatggcttcttcttcagtgctaaattctttcacacagagcactggaccaaaaacttcttccctccaaatttgcattgatgtatcgacatcagtaatgattgtgggttcaatatagaaacctttctccagatgcttgggtctaaccccaccagtcagaatggtagcaccttggcttttggcggtagatacaaattgcttaatcttctcatactgtccttcactaacaacgggcccaagcctgcaaccctcttcaagtggatctgacaccttaatatttttggcccatgcaaccatcctttcttgaaattctttagcgatttttttatgaagaataagacgcgatgttgcactgcaaatctggccattggtccaaaagcaaccaaagagagtccactcaacagctttttcaacatcaacatcatcaaacaccactataggactttttccaccaagttccagtgaaacaggcttaaccataggagcagctgaagccataatctttttaccagtttcataactcccagtaaatgcaaccttgtctacaccagggtgtgatgacaaaggagcaccggcttcagaacctaatccagtcactatgtttagcacacctgaaggaagaccaacctctttacacacatcagcaagctccaaacaagtcacggaagccaattcagatggttttagtacagctgtacagccagcagccagggcaggagctaccttccatgttgccatcaggagaggatagttcatgagagccatgcttgggtcataaataaatataagcgcaggatgagagaaaaatgtgaaataccaaggtgtgatcaacccaactacaccgataggctctttccgaagatagcatttaaagttttccattggaagagagacaggtgcattttgccttttgtccaaggattctgcaagatctgcaaagtactcaaagcatccagcaacatcgtccatgtcccatgctgcttcatcaagaggcttcccacaatcaagcgtctctagtctagccagctcagatttcctctcgattatcttggccgcgattgcgcggaggtacttggcccggacggcgcccggcgcgcgcgcccagtcgcggccccggttcctcttcagcgcctcccgcgccgccgccaccgccgcgtccacgtcctccgccgtgcccgccgggatctcgccgatgggggactcggtggcggggttgacgacggggaggcggcggccgagcgcgggggcgcgccactcgccggcgacgaagagctgccgctgcgggatcgccgtggccatctcgccgatcgcgacggggatcgaggaggagctggagctgtgcgatttggggtcggtgagagatacggagatggatcgatgacgatggaggcagcccgcgtggtgtcaggtgtggagtggtggtgggagagaaagtgc

SEQ ID NO: 3096 - DNA, 1740 bp, Oryza sativa
  Clone ID: PAT_MRT4530_15416C.1
cccccggcccgcagcccccccccctgctgctttttttttttttttttttttttgcctgacttggaaagggacaaattcataatcagttgtgaaatacaaatgcaaaagttggtagctttctactacaaaaagaagttatacaacaagaagagaccgatccgaatggatgatgctttctggtaatataaacactacatcaacttaacacggtgagtcagagcacacgtcttgccaagacaacagattgcatttttccactggacattaggatatgatacagctgattgcctgattctatgctacaagaccaacaaactgatttccatagcccatcgagttggtcgtaattcttaacacaaggaacttacaacaacacaggaagaaaactgtccttcaaactattttccggtgtccgctgaaggcccaaatcttcaaattcttgtcccaacttcctgtacacaatgcactcccatcagaagaaagaccaaggcagcttatacgcccctcatgagagttttggaggtttcccaaattaagtaccacctcagcgagaagtgtgtcccacacataacagtcaccattggagtatccagcaaaaagaagccttcctgatatcgaaaatgcaatagatgtaacagttgggagttcattatcatttctatcaggttcccgactgtatacttgaagttggtgccctgttctcacgtcaaataatctacacgttccatcatctgaaccagtaccaaacctctggccatcagggaaaaacttgacactgttaatgtcaccctcatgaccatgatatgttctaactgcccggcttgcaattctgatatcccacagccttacagttgcatcacatgaacccgaaacaaacatattcgaatttgatgagtttatggacaagctcaaaacatctgccgtatgccctgatgggaattcaccgccaaatattgatatcctttggccagtagtaacatcccacaggacacatgtttgatcaccagagctagtaattaggcgggtttcctgatctgggacatactgacaggatgaaacatagcctttgtgtccggtaagtattcttgatactggtatattcccatctctgtctgcttgtgagttaagattgaagatagagcatgcgctgtcaagaccaccacaggcaacagattggccattgggtgcaaatgcacatgtcatcacccatgggcaatgtaactttatggcatgtgttttttgacttgttaatgcattccatacaattagccttccatcttgtgaggcactgactatccaattcttttcaggggtccaatccagagaatatacctttccgctgtggccttgaagcgtgcggcagcacaccagatccgtcgggttgaagctcaccggcgtccgcccctgcgtcctcgagtacctctccacgtcggtgtcgagcagcatctgccgcctctgacggagccgctcccgcagggagttcaccgacgccgtggccgccgcgtgcttctccttgagctccgccacggacgccatgccgccgccgcccgcacgccccccgcgacctcgcgctggttgagggaggggggatctactgggatccgggcatggaggcgaggaacgcaatggcctcggctggagctttccggagctcgcgaggaggaggaggatactaccacggcggcggcggcgagaaacggacgccgaaatggggtggaggaagagagggggggggggggc

SEQ ID NO: 3097 - DNA, 2607 bp, Oryza sativa
  Clone ID: PAT_MRT4530_15551C.1
atggcgtcgaggaggcagtggggagccggtgccggcgccgtcgatgttcctgctcaggaacgcaagggagaggctgccaagattgcgaggaggccaaagaccacgacggttgttgctcagcaaccgccaagaatccgtcgagccctcgccgacgtcagtaatctcgtcaatggccgggctgctctgcctgtcgtaaatcgccagaaggcagcagcagcagcagctgacaagtgcaggaaaccaatcaagcagcgcaacgagaacaacaaggcggccaagccagaagtcatcgtgatcagttcagactccgagaaacataagaaaaatccagcccagagagcagcctcccggagggcgccaatccaaacgctcacctcgattctgaccaagtgcagcagggcttctgacggtgtgatcagcccgaaaaaggagctgatatacgacatcgatgcatctgattctcacaacgagctggcagtggttgattacgtcgaagatatctacagattctacaggaacaccgagaacacctaccggcctctctgcacctacatggtgtcacagaccgagatcaacgagagaatgagagcaatcctgactgattggctcatcgaagtgcactacaggcttatgctgatgccagagacactgtacctcactgtctacataattgatcagtacctgtccctggagaatgtgcccaggaaggagctgcagcttgtcggtgtaagcgccatgttgatagcctgcaagtatgaggagacttgggctccattgcttgcacttgcttcttgtcttacagttgagctgccatttttgcaggttaaggacttccttgtcatatcagacaactccttcagcaggcagcaggtcctgagcacagagaagtccatacttaacaagctccagtggaacctgactgttccgacaatgtacatgttcatccttcgatacctgaaagctgcattgggtgacgaggagctggagcacatgactttcttctacgcagagctcgcactggttcagtactccatgctcttttttgcgccatcggtgatagcagccgctgccgtctacgctgctcggtgtacccttggcctgagcccactatggagcgatcttctggagtaccacaccggcttagctgagccgcaattgctggagtgtgcgaggcggctggtgagcctgcacgcggcggcgccggagagcaggcagaaggtggtgtacaagaagtttgtgttcttcagttcttggtttgttgttgttgttatgggcatatacaaaaggccattctttttggtttctgcatgcaggtttgtgttcttcagttcttggtttgttgttgttatggcatgtacaatgagtagcatggcatgccattcccttccagagagtggaagcaacttgtcagctgctgatgaactctttcagaaccaaaggtcagagcagggaatttactggacactctgggactccaggctatctgatgatctgaacacaacgaccgtatattcagacaatcatggcagcaacggtggcggcacgcaatctttcgacacctctgaacattgcagtacagtgccttcagattcagatgagcaacctggatatccatcacagtttgagcctctgcacatggagcaaacaaacgacatgttcttgagccagttttcagatgaggaggtgaggaggatggatgctccgttccaggcgctggacatgttcccggactccatgcacaggctcatgtcctacgaacacatactgaacggagctctggtgtccgattccaagaatcaggaggtgaacatggatcaagacgacatggacacctgcggtttccctctctacttcagccatggcctgcaagatgatggcggcttgccttcttttgccaaggggatggttgctgcagacacctcctccatggacaagacaaatcgatatatttgggtatttgcgaatgctggagcgagcgcgacggagagaggcgatccggggagttcgccgccgggattcgaagaagctgtgctcgaggagctcgaggaggtgatggtgcagatggcgaggacgacgcggatatgcctccgcgacgccttctaccggctggccgagggctcgaggtcgccgcgctccgccgccgccgccgcagacggcgccaccgtcgccgaggccaccaggtaccacgcgcaagccgccgtcgaccttagtcgatcgcttcttgaaatcctccagctcgtgatcctgatgctttctgtctcctcttctcctctcgccgcggcgaatcctctccagtgcgtcgacgacgcggccgcgccgtcgccgcgacgcgatcgacaggacggtggtgagcctcaccttcaggccgccgccgtgctcgccggaagcagaggcggcgatgatgcggcccacgcgtgcctgaggaggccgagctcgccgtcgccggatcaccggaggacaggaggagattcgcttggtttttctttccagtgcgatcttgctcgccgcattgcaagctcactggcttgcctgacgaaggatacactgtgtatgtgacctgcagctttgccatgagagctttctatgttcaagcatgtggaatttgat

SEQ ID NO: 3098 - DNA, 1056 bp, Oryza sativa
  Clone ID: PAT_MRT4530_1576C.1
atgaaattatcaaactttatgcagttaactggtaactagtgtccctgttgatccaaatagaaaatatttatcatatgttacaacaaacaggaggcagacaatgccaagagttgatactggataggatacatggccatggccttacaggtttacatgaattcctacctttctcctacttcgaaccagaagaaaacagaactgcgagaatagatagcccgcacatgttgcagcgccagtgttccattagtcctgacggccttcgcacccccctcaatgcgggtgcgaacaacagttacaccatgtccttgctccttgagtgatgagaacgaatcatactcaatcgctgtgctaattatagggaaggacaaataatccagaggattttgctcgcactggagcaagcactcctcaatagttaatctaccacttcgatgaagcaaacaacacccaagctctgttctaatagtgagatttgcaatcttgcaggtggaatggaactccaacgcattgtcagagccacgcgaacatgttaacactgtgtcgtcaggaagctcacccccgccaataatgcagagaggcttctttatttggatattacgtgcaacatgtgtgccaccagcagcaattagaatagtatccccaggcctagctgcagaaacagcagactcaagatttggatagactcctggctctattgtatttctgattggcctctcaacacgcaaccacagtcgaggatggcatgcaaggaagcgccatctgtggcaaacgagggcggtgttatacctatctgggattgggctgaggaagctgaagatgtgcatgaggcagccgtcgtccaggctgttgaccggcgcctcccccgacggccccgccgccgaccgctgccgcttcggaggcatctctccgaatccctctcccccccagtacggcgtgcggcgccggcggcgagcggcggcgcggtggcctgcggcgagcgcgaggtcggcaacggcagctgcacgcgcgcccacgcgtccgcccacgcgtccgcccacgcgtccgcccacgcgtccg

SEQ ID NO: 3099 - DNA, 2197 bp, Oryza sativa
  Clone ID: PAT_MRT4530_15828C.1
ttcaccacctcctcctcctcctcccatccagcacgcgcctcctctctcgcgcggctttccatttccatctccccctcctcctcctacgtctccgccgctcctcacttcctccactcgatttcctttcttggcctctcctcctctgacacaggggtgtgcaggtttgtgtttgtgcgtggcgcgtccgccatggctcgcggcagcggggccggaggaggcggcggcggtggtggcggggggctggagctgtcggtcggggtcggcggcggcggcggcgcgcgtggtgggggaggcggtgaggcggcggcggcggtggagacggcggcgccgatcagcctcgggaggctcatcctctccgggatggtcgccggcggcgtgcagtacgggtgggcgctccagctctccctcctcaccccctacgtccagacactcggactgtcgcatgctcttacttcattcatgtggctctgtggtcctattgctggcatggtggttcaaccatgcgtgggtctatacagtgataggtgcacctcaaaatggggaagacgaaggccatatattcttacaggatgtgtgttgatatgcttggctgtcgtagttattggattttcagctgacattggatacgccatgggtgatacaaaggaagactgcagtgtctaccatggatcacggtggcatgctgctattgtatatgtcctgggattctggcttcttgatttttccaacaacactgtgcagggtccagcacgtgctctaatggctgatttatcaggacgtcatggacctggcacagctaactccatcttctgttcttggatggcaatgggaaacatcctaggatactcctctggttccacaaacaattggcacaagtggtttccattccttaaaacaagagcttgctgtgaagcttgtgcaaatttgaaaggtgcatttctggtggctgtgattttcctgtccctgtgcttggttataactctgatatttgccaaggaagttccattcaaaggaaatgcagccctcccaacaaaatcaaacgagccagctgagcctgaaggcactggtccactagcagtgttgaaaggcttcaggaacttacctactgggatgccttctgtgcttattgtgactggccttacctggttgtcttggttcccattcatcctctacgacactgactggatgggccgtgagatctaccacggtgacccaaagggaactgatcctcagatcgaggctttcaaccagggtgtcagggcaggtgcatttggcctgctactgaattcgattgtgctaggattcagctcattcttgattgaaccaatgtgccggaaagtcgggccaagggtggtgtgggtgacgagcaatttcctcgtctgcatcgccatggctgcaactgcactgatcagcttctggtcactcaaggacttccatggaactgttcagaaagccatcactgcagacaagagcatcaaggctgtctgcctcgtcctctttgcgtttcttggagtccctctcgccgttctgtacagtgttcccttcgcagtgacggcgcaattagcggccactagagggggtggccaagggctctgcaccggcgtcctcaacatctccatcgtcatccctcaggtggtcatcgcgctgggagccgggccgtgggacgagctgttcgggaaggggaacatcccggcgttcggcctcgcctcgggattcgcgctcatcggcggcgtcgccggaatattcctgctgcccaagatctccaagcgccagttccggtcggtcagcatgggcggcggtcactgaccgccccgctctcgccgccggctgcggcggcggcggcggccggagcagcgccgccggaagtggtgagctttgtagttctcgtttgcaatggatcaaaggagccccctctttttttttacatagggtaattaattaattaaggctgttaattaggaaggggtgaggtggccctgcagctggggcccacgctttgttgccacctcggtagaagagaataagcagatcatgcagataatatggaactgtaaaactgttttgtgttgtgtgtgtgtgcagtgtgcttggtaattagtgtgtaatgaatggtcaggagaagtgcagtgaactaagtgaaagtgagcttccatcatcatcaaaaaaaaaaaaaaaaaaaaaaaaaaaaaaaaaaaaa

SEQ ID NO: 3100 - DNA, 1583 bp, Oryza sativa
  Clone ID: PAT_MRT4530_15830C.1
ccacggtactttttttttttttttttagaacaaccaaatgaactcattttatatattgaattattaaacatacacgttttgcaacgcaatcacaataacacaaatgatcaaacagccttgacgcattacaaccagctttacttatttaaacaaaacatgccactaccaccaccttgtaaaactcagcacacaagacaacctcagtggtagtagttgttgagcctcctgcagttcttcctgatctccccctgtgatccagtcagaggcgagatgttgcccatattcaccattgactgtgcgaagtgcttgaagaagaggttgacatcatcagcatacgccttcacgagcgccgctgtttcagcgctcttggtaagcaggacctgatcagagctgagaaggcccttgccagacaggatgttcttgaagtagaagttgtcgaactttgcggggctgacaaagtctagcgggaagaggttgttgtcaccaccagaacgggggcatccctgcctcagctgtgccgcgtaggacacatccagtgtgtagtcagccatgccattgccgctctgattgtagagcctctgacggaagctggtgcaccgagacatgccaatggtgtggccacctgagagggctacgacgtcgacgatgttaaggccctggcgcttgaacttggtgatgatggtggggagggtgttgttgggagctgggatgtcgttgttggagccctggatgctggcacccagtgagtccctccggccaagtggcacatcccagtacgggccaccaacgaggacagtggaatcgcgtgcagcgagggcgagtatgtcggcgcaggagacggtgccggggcaagctgcttcgagggcggccttgatctcgtcgacgacctcgaaacccctgagggagttcatgttagggtttgaccccttctcactgatgatggtggtgctgttgtccaggagcacagacgcgtcacaccccttgacaaagcagtcatgaaaatgcagcctgaccaaggatgccgccatcctggtctccctggccaccgcctgtgctacgatggactgcacgatctccttcgccttggggcacgagtggtcgtagaactgcgggaacaagccatacccatacccataccacgggttgccgtggacagaggtggcgaggaggaggggagaaaccaagcagagcatcaacaggcaacccatggaagtcgccaagtaaaccttcgctgcactgcactgcactgcactaggttgctaggtaggagaagagaattgctctctgtttgtttctacctctctggcccacgggtcccgagcggaggcgggcatggggtggcatatatagcacctgtgggggggtgcatgtaggaagggtggtttggagcagaggacagtgagatgagacgcggcagggcagcttgggttgttagggtgatgcgtataaaataagtcagctagctacgcattgtgctcaactgcttcagtaattccatcaattatcagctaaaaaaaaaacaaaaaaaaaaaaaaaaaaaaaaaaaaaaaaaaaaaaaaaaaaaaaaaaactcgagggggggc

SEQ ID NO: 3101 - DNA, 2164 bp, Oryza sativa
  Clone ID: PAT_MRT4530_16044C.1
atggagtcgctcgcgctcctccacgccaagcccggcggcctccctccccgcgcggggctccgcctcccgctcccgcgcgcgcgatccgcgcgcgtctccctcccctcctccccggcggcccccgtatcgctccagtccccgctcctcctcgcttcgagaagcggccctacctcgcgggacgccgtcgtggggttgggattggggtgcgggctcttgagacggaggagcggcgctagtggtggtggtggtggtggggtctcttgcggcgcgcagcctgccgcggcggcggcggcgggggcggtgccggcggcgcagccggaggggaagaagttcctcggcgtggaggtgaagacgctgaagaagatcgtgccgctcgggttgatgttcttctgcatcttgttcaactacacgatcctgcgggacaccaaggacgtgctggtggtgaccgccaaggggagcagcgcggagatcatcccgttcctcaagacgtgggtcaacctgcccatggccatcggcttcatgctcctctacaccaagctctccaatgtgctctccagggaggcgctcttctacaccgtcatcttccccttcatcgccttcttcggcgcctttgccttcgtgctctaccctctcaggaatgtgatccaccccaccgcgctcgccgacaagctccttgcggcgctcggcccgagctttcttggccccgtcgccattctgaggatttggagcttttgcttgttctatgtcatggccgaactgtggggcagcgtcgtcatctcggtcctcttctggggcttcgctaaccagattactacagttgaggaagcaaaagaattctaccctctatttggtcttggggctaatattgcgctcatcttttctgggcgtactgtgaagtatttctcaaatctgcgcaagacattgggtccaggtattgacggatgggaggtgtctttgaaaggaatgatgagcttagtggtgcttcttggacttgtcatcacttccatctattggggggtgaacaagtttgttttgaatgatccttctcttccgaagtctgaccgtaagaagaaaaaggataaacctaagcttggaatgaaagagagtcttaaagttctcctctcctcaagatatgtaagggaccttgctactttagtggttgcatatggcatcagtatcaaccttgtggaggtcacatggaaatcgaagctcaaggcacagttccctagtccaaatgagtattcatctttcatgggtgatttctcaaccgctactggcattgctactttcacaatgatgctgttaggccggatcatactccgaaaattcggctggggagtggctgcaatgatcacccccacagttttgttgctgactggcgtcggtttcttctccctgattctatttgggcagcctctcactcctatgcttgccacaatgggcatgacccctcttcttgcagcagtttatgtgggtgcacttcagaacatattcagcaagagtgcaaagtatagtttatttgatccatgcaaagaaatggcctacattcctttggatgaagatatgaaggtgaagggaaaggcagccattgatgttgtctgcaacccattggggaagtctggtggagctcttattcaacagttcatgatccttacatttggctctttagctaactccaccccctaccttggtggcatactgttggtgattgttctagcatggctaggcgcggcaagttcactagacaagcaattctctagcttggctaaggaagatctcaaaagggatatgtctgcaaaagagaaggtagatccttccctgctcaaggctcctgaggctgatgtattggtggagcacacaaacggcactatagagagcgaagctactgcaactgagagttcaccatcaaactcatctccaagtaattagattcatctttctttgacaaagtcaatcgataggtaggagaatgattgcagtgggtagaaataatggtgatgaaacaattcacggtttctcaagtttgtaacagtgcgcagaatcaagctgcctgtttattttgtttgtaacgtatgcaaattttgacaagtgcactgaacgccattgtggaaattcaaccgttctggcagggagaatgaatgaataggtttcccacgccttgccc

SEQ ID NO: 3102 - DNA, 411 bp, Oryza sativa
  Clone ID: PAT_MRT4530_16153C.1
agcttgacggcgctcgcacgcgacgtaggctcgtatacagcggacgggccgcccttttttttttttgattgaaaccagacggccattaatttgaactagaggatcacaaactccgtacatcgacaaagagcccgtgtcatggctctaagcattttcgcatggaaaaatggacgtccctagaaaccattacacttttaaacaacctaacacatgagctggatataaaacacaccaagcggtggcgacacatcactacagctttgacttatcatacgacgacagctccgacttgttcttgatgttggataatgcctactcttgaacctcggactgctggacctcctgttcctcttccacgggcgtgtaggggctcatgtcaaggctcttctgcaccgacctgtagatgctgga

SEQ ID NO: 3103 - DNA, 1031 bp, Oryza sativa
  UNSURE (1)..(1031): unsure at all n locations
  Clone ID: PAT_MRT4530_16438C.1
  unsure (1)..(1031): unsure at all n locations
tcactcctatgggcgatagcaccccgcggcgccggccgggactccgcctcgcctccactcctctcctctccgcatcctcctcatcgcctccgcttctgcttttttttttcttttttctcgttgatcggtttgttcgatcagatcggttctttggagagatggagcagtccttcatcatgatcaagcctgacggcgtccagagaggcctgattggagacatcatcagcaggttcgagaagaaaggattctacctgagggggatgaagttcatgaatgtggagaggtcctttgcacagcagcactatgccgacctttccgacaagcccttcttccctgggttggtggagtacatcatctctggccccgtcgttgcgatggtttgggaagggaaggatgttgttgccactggccgcaggatcattggggccaccaggccctgggaggcagcccccggcaccatccgtgctgactatgccgtggaagttggcaggaatgtcatccatgggagcgactccgtggacaacgggaagaaggagatcgctctctggttccctgaaggtttagctgagtggaggagcaaccttcacccttggatctatgagtcttagagcttcgcgcctataatcgatcacctcttggtggctagttctcgttaaatatttgagttttgtttcagagttgtcatctggctgcctcctgagtcaccattataattctgctgtgatacaatcacagttatatgttgcctgaacttatatggctttttaagtttctggattggatgtgatgggaaaataatactagcagtcagtttttgcttaaaaaaaaaaaaaaaaaaaaaaaaaaaaaaaaaaaaaggtacccaaatttccccctataagttgaattccttattaacaaattcactgggcccgtccgtttttacaaccttccttgaactggggaaaaaccccttggccgtttaccccaaactttaaatccccctttgcaaacaacattcccccttttccccccannctttgggcntttta

SEQ ID NO: 3104 - DNA, 1194 bp, Oryza sativa
  Clone ID: PAT_MRT4530_16528C.1
cgcctcgcatcccacgccttccccccccccattcgtcgcctcctgtcccgggggccgcgagcaaaacccccacccccaaatcgcagcctcgctcagctcgatctctctctcgtctcgccatggcccccagcgacgacctcgtctacatggccaagctcgccgagcaggccgagcgatacgacgagatggtggaggcaatgaatagtgtggcaaagttagacgaggggctgacaaaggaggagaggaacctcctctcagttggctacaagaatttgattggtgcaaagcgtgcggcaatgcgtatcattggatccattgagctaaaggaggagacaaagggcaaggagagtcatgtaaggcagactgctgagtatcgtcgcaaggtggaggctgagatggataaaatctgctgtgatgtcataaacattattgacaagtaccttatcccacattcctctggagctgagagctcagtcttctactacaaaatgaagggagattactaccggtaccttgcagagttcaagactgggactgagaagattgaagtgtctgaactgtcactcaatgcttatgagactgcttccaaaactgcgcagacagatctcactccaactgaccctatcagacttggtttagctctgaatatatctgtcttctactgtgagatcatgaactcacctgacaaagcttgccaacttgctaagaacgcctttgatgaagctgttgcggagcttccctccctcagtgaggagaattacaaagatagtacactgatcatgcaacttctgagggataatctagcactgtggaattctgatatggctgatgatgcagacgatattagggaacgaacagatacaactggtgctaaaggtgaccctgcagcgtgatggaggtgctaatagctggtagagtcgaagcataacaacaacaacaacaagggtgtggtggggtgcggaaggactaccatttactcactgttagtgttaggttctgtagtgtaggagttgagctgctgagtaaccctcgcttgtagtctgggcctgattcttcgacttcttgagcaacatcgtgtactaagcactcgctgatcgctcttttgcaagcattgtttttttttgggttactcttgatgatgattaggcaaaagttatctggttcatcaaaaaaaaaaaaaaaaaaaaaaaaaaa

SEQ ID NO: 3105 - DNA, 402 bp, Oryza sativa
  Clone ID: PAT_MRT4530_17049C.1
ggggggaaagtcaagggtcgataaatattgcttcacttggccaaaggccagataaaaatcccttggtccctgacacggggagggccctgcacaccacttttttggacccacagagggcaagggtgcagaaaaaatcaagccccccagggtgaactcacggccccacctgtcagcctttcactgggcggggccggagacttttgggaaaaacaggaaccccccccatgcagaagaagacaaattttttcccacacaaattgaccacccgggggccggggacgtacggggaggtcgtcgccgccgccggggaccttgggatgagggcccccagcccaagagggggggcttcttctcgccggggggctcctcggcgcttttggggcccttctttttctcgggggg

SEQ ID NO: 3106 - DNA, 3462 bp, Oryza sativa
  Clone ID: PAT_MRT4530_17346C.1
atggacgtggactcccgcatgacgacggagtcggactccgactccgacgccgccgccaccgccgccgcctccgcctcggttgctgcgcaaggaggcttagcgagcgagacctcgtcgtcgtcgtcggcctcggccccgtccacgccagggacgcccacggtagctccggctcctgcggccgcgggagccacggggcccaggccggcgccggggtacacggcggtcagcgctgtgatcgagaagaaggaggacgggccgggctgccgctgcgggcacacgctcacggcggtgccggccgtcggggaggaaggcacgccggggtacatcggcccacgcctcatcctcttcgggggcgccacggcgctcgagggcaactccgccacgccaccctcctcggccggcagtgctgggatccgtcttgccggtgccacagcagatgtccactgttatgatgtgttatcaaataagtggagcaggcttactccacaaggtgagcctccttcaccaagagccgcacatgtagcaactgcagttggaaccatggttgtcatccagggtggcattggccctgctggtttatctgccgaggatcttcatgttctagaccttacacaacaacgaccgcgatggcacagagtggtggttcaaggacctggtccaggtccacgatatgggcatgtcatggccttggttggacagaggtttttgttgacaattggtggaaatgatgggaaacggccgctggcagatgtatgggctctagatactgcagctaagccatacgaatggaggaaacttgaaccagaaggtgaaggaccgccaccatgcatgtatgccactgccagtgcacgctctgatggtcttcttttactttgtggtgggagggatgccaacagtgtgccgctggcaagtgcatatggtcttgcaaaacacagagatgggcgatgggagtgggcaatcgcccctggtgtttctccatcacccagatatcaacatgcagctgtttttgtgaatgcacgtctccatgtatcaggaggagctcttggaggtggtcggatggtagaagactcctcaagtgttgcagtgctagacacagctgctggagtctggtgcgacacaaagtcagttgtcacaactcccaggataggaagatatagtgcagatgcagcagggggtgatgctgctgttgaacttacacggcggtgcaggcatgcagctgctgctgttggtgatcaaatattcatttatggaggtctacgaggaggggtactgctagatgatcttcttgtagctgaagatcttgctgctgctgaaacgacaaccgctgctaatcatgcagcggcaagtgcagcagccactaatgtacaaagcggaagaacacccggaagatatgcttataatgatgagcgagcgagacaaacagctccagaatcagctcaggatggatctgtagttcttggaactccagttgcccctcctgtcaacggtgacatgtacactgatatcagccctgagaatgctgtgcttcagggacagaggagattaagcaaaggtgtcgattacttagttgaagcatcagcagcagaggcagaggctattagtgcaactttagctgcagtgaaggctaggcaggttaacggtgagatggagcaattgcctgacaaggagcaatctccagattccgcatcgaccagcaagcattcaagcctcatcaaaccagacagtattctctctaacaacatgacgcctccacctggggttcggttgcatcatagagctgttgtagtggctgcagaaactggaggtgccttaggtggcatggtcaggcagctgtcaattgaccaatttgaaaatgagggaagaagagtcagctatggcacccctgagaatgcaactgctgcaagaaagttgctagatcgacagatgtccattaatagtgttcctaaaaaggtgattgcatctctattgaaacctcgtggttggaagccccctgtgcgaagacagttcttcttggactgcaatgagattgcagatctatgtgatagtgctgagagaatattttcaagtgaaccaagtgttctgcaacttaaagctcctgttaagatatttggtgatttacatggtcaatttggtgacctcatgcgattgtttgatgagtatggtgctccttcaacagcaggagacattgcttacattgattatctcttcttgggtgattatgtggatcgtggccagcatagcttagaaacaatgactcttcttcttgcattgaaggttgagtatcctcagaatgtacatttgattcgtgggaatcatgaagctgcagatattaatgctttgtttggcttccgaatagagtgcatagagcgaatgggtgagagagatggtatttggacatggcaccgcatgaatagattatttaactggcttcctttggctgccctaatagagaagaaaataatatgtatgcatggtggtattggccggtctatcaaccatgttgaacaaattgagaatcttcaaagaccaattaccatggaagcaggctcggttgtccttatggatcttctatggtctgatccaaccgaaaatgacagtgttgaaggattgagaccaaatgctcgaggccctggccttgttacgtttgggcctgatcgtgttatggagttttgcaacaataatgatcttcaactaattgtgcgagcgcatgagtgtgtgatggatggctttgagcgctttgctcaaggtcacctgatcactcttttctctgcaacaaactattgtggtactgcaaataatgccggtgctatcttagttttgggcagagatcttgtggtcgttccaaaactgattcatcctttgcccccggcaatcacatcacctgagacctctccggagcatcatattgaggacacatggatgcagagtaaagtgatttgtgtttgcgagacagtggcccacagccatgccaaaagtgtgcaagctaatgatattggtttggatatcgtagaagctacactattgattcttatgggctatttgacacgtttcattgaaggcgtacacatgattgctccatttctttgtgaaaaagcgcacgatctgaaacaattactctgacacttcacctgtatatactcggctgctggtggataggcagttgtatgtggtttttgcatccaattggaatggcaaaaaggaatagtgttattgtactagctattctttcctctctttttttttttcctttctttttgggatcttgagttctgattttgcaaggtgcttctgaaactgctggagagagaccgatggctggtgttcgtggtccagtcgtgtataatagccttccctcctgctactttcgtcgcagcataccccttgtaatttcagtctgatgatgctgatgtacaattttgtgttccaagttttgggtggcgaatggagtttgatttggtttac

SEQ ID NO: 3107 - DNA, 1170 bp, Oryza sativa
  Clone ID: PAT_MRT4530_17523C.1
atggccgccgcagccacgacatcctcccacctgctcctgctctcccgccagcaggcggcggcctcgctccaatgcggcctctccttccggaggcagcccggcaggctcgccggtgggtcgtcggccccgagcgtgcggtgcatggcggccgtcgacacggcctcggcgcccgccgcgacggaggctagcaagaagagcagctacgagatcaccacgctgacgacgtggctgctgaagcaggagcaggccgggaccatcgacggcgagatgaccatcgtgctggccagcatctccacggcgtgcaagcagatcgcctcgctggtgcagcgcgcgcccatctccaacctcaccggcgtccagggcgccgtgttctccaactgcctcaaatcgagcgggcgcaccggcgtgatcgcgtcggaggaggaggacgtgccggtggccgtggaggagagctactcgggcaactacatcgtggtgttcgacccgctcgacggctcctccaacatcgacgccgccgtctccaccggctccatcttcggcatctacagccccaacgacgagtgcctagccgacatcgccgacgaccaaaatcttgaccaggtggagcagaggtgcatcgtgagcgtgtgccagccggggagcaacctgctcgccgccggctactgcatgtactcgagctcggtcatcttcgtgctcaccatcgggacaggggtgtacgtgttcacgctggacccgatgtacggcgagttcgtgctgacgcaggagaaggtgcagatccccaaggcaggcaagatctatgccttcaacgagggcaactacgcgctctgggacgacaagctcaagagctacatggacagcctcaaggagcccgggccgtccgggaagccatactccgcgcgctacatcggcagcctcgtcggcgacttccaccgcacgctgctctacggcggcatctacggctaccccagggaccagaagagcaagaacggcaagctgcggctgctgtacgagtgcgcgccgatgagcttcatcgtcgagcaggccggcggcaagggctccgatggccaccagaggatacttgacatcatgcctacggagatccatcagagagtgccgctgtacatcgggagcgtggaggaagtggagaaggtcgagaagttcttggcttga

SEQ ID NO: 3108 - DNA, 828 bp, Oryza sativa
  Clone ID: PAT_MRT4530_17623C.1
cgaaaggataaaccggccgccgacattcacaggctcgattccatgtcctggaaagctcagaaaagcaatcaaaagcgagcactggtcttaatatggtaccacagcttaaggcacaatagagagagaaccgctgaatacaataatagcaagttgatatgtgaccctcagaacattaatatgaaggatcttatgccaagcagtaccctctctacaaatcatccaaacacaatccctgtatgggacaagtacgcacgataaacgtccagcgatagatgtaaggcatcaaaagaagctaacgatggagctgttcggcagatgatacggcttgtgtttgtagcgcagccgtggcaacaaacaagcgcagacagcaggtggtgtctagtgcccatacacctgaaatcccacttcactgttatctaacgggcacacttggcgagtcttgagccacctgctgatgcaatggaagtgaaaagcatgattacagacaccccaagcgacagtgcactcctcactggtggcgctggcctggttcgcctggcactcgatgcatagatccatgatgtggttgcggcagatggcgcagttgtcgacgacgatatcccatgcccagagcgcgacggcgttccacttcttgatctcgaagcgcttgttgggcttgcgggaggaggggccggcggcagaggaggatccctcgccggcgccggcgggggcgggggcggggggcggcggcgcgttgatgtcggtctccatggccgacatcgtgagctctcgatcgacccggattcaggaatccaccagaccaggttgggattggaagatcccggccgg

SEQ ID NO: 3109 - DNA, 2795 bp, Oryza sativa
  Clone ID: PAT_MRT4530_18010C.1
cccgacccggaactacagtcccgacccacgcgaccggtttttattttttatgctcgccacctgcacagccaaaagagagtgtcagagggccagagatacgaggaccagcatctagcaagccggcgggcgccatggtgctctcgcacgcgagctccggccggcacgacgccttgcgctgcacccccccgccttcctcctcctcctcgcgcttcgatttggtttggtttgattcggtttgcgagatgaaggatggtggtggaggggagggagggggcagcagcagtggccttgcgactactgcggggaggcggcgtcggacgccttggtgggcggacgcgtggacacacacacccccacgctttcggcacattctcctcgcggaggggggaggaggagggggggcacgagtcgcgcacctccccccaccaggcgtagcacaaccaggccagcgcctatcaaaccccctcccccctgctcgctaaatcccgtgcgacgcgtagacaccggctcagcccctgtctgctccaaagcccaagctaatccccctcctcttcctcgtcgccggcgagagctcttcgtcttctccaactcgaccggaagcaagcgcgcttccgatccgccatggtgctctcccacggcgtgtcgggctccgatgagtccgtccactccacgttcgcctcccgctacgtccgcacctccctccccaggttccggatgccggagcagtcgatccccaaggaggcggcgtaccagatcatcaacgacgagctgatgctggacggcaacccgcggctgaacctcgcgtcgttcgtcaccacgtggatggagcccgagtgcgacaagctcatccaggcctccgtcaacaagaactacgtcgacatggacgagtaccccgtcaccaccgaactccagaaccgatgtgtgaacatgattgcacacctcttcaatgctcctctaggggactctgaaacggccgtcggagtcggcactgtcggctcgtctgaggccatcatgctcgccggtttggccttcaagaggaggtggcagaacaagatgaaggcagccggcaagccatgcgacaagcctaacattgtcaccggcgccaatgtccaagtttgctgggagaagttcgcgcgatacttcgaggttgagctcaaggaagtgaagctgagtgacggctactacgtcatggacccagctaaggccgtggatatggtcgacgagaacaccatctgcgtcgcggcgatcctcgggtcgacgctgaacggggagttcgaggacgtgaagctgctcaacgatctgctcaccaagaagaacgctgaaacaggctgggacacgccgatccacgtggacgcggcgagcggcgggttcatcgcgccgttcctgtacccggagctggagtgggacttccggctgccgctggtgaagagcatcaacgtgagcgggcacaagtacggcctcgtctacgccgggatcgggtggtgcatctggaggagcaaggaggatctgcctgaggagctcatcttccacatcaactacctcggcgccgaccagcccaccttcaccctcaacttctccaagggttccagccaggtcattgcacagtattaccaactaatccgcctaggctttgaggggtacaagaacatcatggagaactgccaggagaacgcgatggtgctgaagcaggggctggagaagacggggcggttcaacatcgtgtccaaggacaacggcgtgccgctggtggccttctccctcaaggacagcgcccggcacaacgagttcgagatctccgacttcctccgccgcttcggctggatcgtgccggcctacaccatgccccccgacgcgcagcacgtcaccgtgctccgcgtcgtcatccgcgaggacttcagccgcacgctcgccgagcgcctcgtgctcgacgtcgagaaggtgctgcacgagctcgacgcgctccccgcccgcgtcgtcgccaacggcggcgacgccgccgccgcgtcggcgagcgagagggagatggagaagcagcgcgaggtgatctccctctggaagagggccgtgctggccaagaagaagaccaacggcgtctgctaaagcaagtcagctgcgcagcggggatcgtatactattattatggtccacttcgtaattgcgacttcttaatttttaccgtgtcgatcggtttaccgtctcaagtctgctctcatccgattttcggattgatgctgcttaattatgtaccaagttaattaattcttagaggacggaatagttccgactcaatacgaagcattgcctgtataagtcgaacacgggatcatgcattttacgttgggtgtgtagcagtgaattgatcagtgatgctccatctctactctgaacgtgctacctccattccaaaaaagaaaaaaaaaacttttatgaacgaatttgtgtatgaaaattaccatctccgtctcgtaatataatgaattttggttttagcgtgcgtgcggggaaaccctgggttacaaattaattcgctgggagaaacccctttcgcgttgggtaaagcaaaagcccaccaaccgcgttcaaattggcacgaagggtatgggcgcctatatgcggtaagcgcggttggggtccccggggcgttcattggggctaagccatttgattttctattttggatggcggtttcgagtaagtgggtttagggtatatgttgtgaccaccaaagcagtggtgtagcagttaattggtcaaaaaaaaaaaaaaaaaaacacaaaaaaaaaaaaaaacaaaaa

SEQ ID NO: 3110 - DNA, 931 bp, Oryza sativa
  Clone ID: PAT_MRT4530_18379C.1
ccggccggggatttgctgaagctgaagagctgaacgcggtgaggcggccgtaggccttcttcccctctccgtctcgtgtcccacgcacgcacacctttccccccctctctccctccctcctccgccatccctagcagccgccccgcacccgcgcccgcaccatgacgagctcctcctccccttcccgcaaggtgctgagcaagatcgcgtgcaaccggctgcagaaggagctcgcggagtggcaggtcaaccctccctccggcttcaagcacaaggtcaccgacaatctccagaggtgggtcatcgaggtcgcgggggctgcgggcacgctctatgccggagagacataccaattgcaggtggacttccctgagcattaccccatggaggctccccaggtcatatttcttcatccagcgccaatgcatccgcacatttacagcaatgggcatatctgtttagatatattgtatgactcgtggtcaccggcgatgaccgttagttctgtttgtatcagtatcttgtccatgttgtcaagctcaccagcaaagcaacgtcctgccgacaatgatcgctatgtcaggaactgccgcaatgggaggtcgccgaaggagaccaggtggtggtttcatgatgacaaagtgtgattggttccaacttccggttggcttctcctcagcaacccttttacccgccaccctacctttacatggcgtcctccatgggagatgatttaggcatatttttaagcgatctatttgaccgcaaattaacatgcctttgtggtttgtaaatgaatgtgaacctgtatcgaatcctagacttattaattactataccttggatatatagaataattacatgtgtatcttgcttattgcccaaaatagaggcatcaaatgcagtcaaaactttggttttctgggtaaaa

SEQ ID NO: 3111 - DNA, 2556 bp, Oryza sativa
  Clone ID: PAT_MRT4530_18548C.1
atggcggacaatcctccattgatcatgctcctcgcgttcttgttctctgctcttcttcttctttctccggctcatggcggcagccgccttcaaagaggtgaatcgctctccgtggaacgcgcctccgacatcctcgtgtcctccaatggcgtcttcgcgttcggcttctacaacctctcctccaccgtcttcaccgtctccatctggttcgccgcctccgccggccggaccgtcgcctggacggccaaccgcgaccggccggtgcacggcgcggggtcgaagctcacgctgcggcgagacggccgcctcgtgctcgccgactacgacggcacgccggtgtggcagaccaactcgagctccggcgccgccgccgccgcggagctgacggactccggcaacctcgtcgtgacaagccatggcggggacgtgttgtggcagagcttcgactacccgaccgacacgctgctgccggggcagccggtgacggcgacggcgaggctgtccacgacggacgtgctccacccgacgagccactacgcgctccggttcgacgaccgctacctcctctcgctggcgtacgacggcccggacatctccaacatctactggccggaccccgacgccagcagctgggccaacggcaggatctcctacaacgccagccgccggggcgtgctcgacgacgccggcaggttcctcgccagcgacaacaccacgttcgtcgcgtccgacacgggcgccgccgccggcggcgtcacgtggcggcggctgacgctggaccacgacggcaacctccggctgtacagcctgcgcgacgccgacggggggtggtcggtttcttggatggccttctcccagccgtgcggcatccatggcctctgcggctggaacggcctctgcgtgtacacgccgcggccggcatgctcgtgccctccaggctacgttcccgccgacgccggcgaccgcggcaagggctgccggccgacgttcaacctcacctgcggcggcggcggtggccggccggagatgggcttcgcgcggctgccgcaaacagacttctggggctccgacctcaacctcttctcctccatctccgtcgacggatgcaaggcggcgtgcctcgagctctgcaactgcgtggcgttcgagtacaaggatgacgtcagcgactgctacctcaagtcggcgctcttcaacggcaagacctaccccggctaccccggcacggtgtacctcaagcttccggcgaacttggtggcggagtcagacacctacaccgccgccccggccgccgccgccgccgttaatctcgcctgcgacgccgcgcgaacagaggaggttctcctctccttctcggccgcctccccggacacgtcgtcgtggcgctactactacgggttcctctcggcgttcttcgccgtggagctctgcttcatcgccttcgggtggtggttcacggcgaggagccggccggcgacgtcggagcaatgggcggcggaggaagggtacagggtggtcaccgaccatttccggcggttcacctacggcgagctcaggaaggcaaccaagaacttcaaggacgtgatcggtcatggccggtacggctccgtgtacaggggcgtcctcgccggcgccggcgacgaccgcgccgtggccgtcaagaagctcaaggccgcgacgccgcagcgtggggacgacgagttcgagaccgaggtgagcgtcatcggccggatcaaccacatgaacctggtgagaatccgcggcgtctgctcggagcgccaccgccggcggcggctgcttgtgtacgagtacgtggacaacgggtcgctcgccacgtggctgtttggcgccaaggagactctcaattggaaccaaaggtacaacattgccgttggtgtggccaaaggtttggcctatctccaccatgagtgcctcgactggatcatccactgcgacgttaagccagagaacatacttctcgacgaggatttcgagcccaagatcagcgatttcgggctcgcgaagatgcaacagaggagggatctcgatgatcccgcctcgtttagcatcagagggaccagagggtacatggctccggaatgggtttcgagtcttccgataaccgaaaaggttgacgtgtacagctacggtgtcgtgcttctggagctggttagaggggccagaatggcggatttggccacggatagcgttggtgatgcggagattgcgatgagacagttggtgtggaagatcagggaagggttgaagattggtgatcggacatgggtaatcagcttggtggatcgtaggttgaatggtagcttcgtttactcacaggtggcgttgatgctggaggtggctacgtcgtgtttggagaaagaaaggaaccaaagaccaagtatgaatgatgtagttaagaagttttacacatcagacaaaaaggttgaattcattggggaaatgtcaagctagcaagcaatctgagggcaatgttgtagttgtaaacctccggtacaaacttcaactatactcgaaaaggaattcttttttgataaa

SEQ ID NO: 3112 - DNA, 2427 bp, Oryza sativa
  Clone ID: PAT_MRT4530_18601C.1
gggcgaagccaatgcgcccgcgggcttacgtggcccggcaccaccggccgagccgtgcggggaaacaagtaaacgctcgctcgctgcgtctccgatgcccccgtccccgcctggccgctgctgctctctcgctcttctccctccaataattcgcttgccctctggtggctcaaagcccagggaaattgatggagaagaattggggtagccccatgccacctggttcgggctagatctccggcgagacggccgctgggagcagccgatccggccccgatccgatgggtggcgaggtgccggagccgcggcggctcaaccgggcgctcagcttcgacgactgggtccccgacgaggcgctgcacctcgtgatgggccacgtcgaggacccgcgggacagggaggcggcgtcgcgggtgtgccgccgctggcaccgcatcgacgcgctcacgcgcaagcacgtcaccgtcgccttctgctacgccgcgcgccccgcgcgcctccgggagcggttcccgcggctcgagtcgctctcgctcaagggcaagccccgcgccgccatgtacgggctcatccccgacgactggggcgcctacgccgcgccatggatcgacgagctcgccgcgccgctcgagtgcctcaaggcgctccacctccgccgcatgaccgtcaccgacgccgacatcgccgcccttgtccgcgcccgcggacacatgctgcaggagctcaagctcgacaagtgcatcggcttctccactgacgccctccgcctcgtcgcccgctcgtgcagatccctgagaactttatttctggaagagtgccatattactgataagggtggtgaatggcttcatgaacttgctgtcaacaattctgttctggtgacactgaacttctacatgactgaactcaaagtggcgccagctgatctagagcttcttgcaaagaattgcaagtcattgatttcattgaagatgagtgagtgtgatctttcagatctgattagtttttttcaaacagccaatgcgctgcaagactttgctggaggagcattctacgaggtaggagagctcaccaagtatgaaaaagttaagttcccacccagattatgcttcttggggcttacctacatgggaacaaatgagatgcctgttatcttccctttttcgatgaaactcaagaaactggacttgcaatacacttttctcacaacagaagatcattgtcagattattgcaaaatgtcccaatctactaattcttgaggtgaggaacgtgataggagatagagggctagaagttgttggtgatacatgcaagaagctacgaagactccgaattgagcggggtgatgatgatccaggtctgcaggaagagcaaggaggagtttctcagctaggcttgacagccgttgctgttggttgccgtgaattggagtacatagctgcctatgtatcggatatcaccaatggggccctggagtctattgggactttctgcaaaaatctatacgactttcggcttgtgctacttgacagagaaagacaggtaacagatctgccacttgacaatggtgtctgtgctctgttaagaaattgcacaaagcttcggaggtttgctctctaccttagaccaggagggctttcagatgatggccttagctacatcggacagtacagtggaaatatccaatacatgctactgggcaatgttggtgaatctgaccatggattgatccgtttcgcagtgggctgcaccaaccttcagaagcttgaattgagaagctgctgcttcagcgagcgagctttgtccctcgctgtactgcagatgccctccctgagatacatatgggtgcaaggatacagagcatctcaaacaggccttgacctcctgctcatggccaggcctttctggaacatcgagtttacacctccgagccctgagagttttaatcatatgacagaagatggagaaccctgtgtggatagccatgctcaggttcttgcctactattcccttgctggaaggaggtctgactgccctcagtgggtgatccccttgcatcctgcgtgattgtaaatatgtcaagctgtgtataccttcctatctatccctggggcataagcatggccttgtatggttattgtaagaaccttagcttgccacctttgtgattgtgcccgaataagctactactagtactttagctggggtctatagtgcaataagttgttgtcacttgttctacgtatctaatcctaggaagatgtatactaagttcctctgtaactgtaagagtgatctgtgctttggttgcgagatgtacattgtaagtatcagaaatcatgtgttactggtttttttgccataatatatgcctatataagccgggggtttggtgcaaaaaaaaaaaaaaaaaaaaaaaaaaaaa

SEQ ID NO: 3113 - DNA, 3393 bp, Oryza sativa
  Clone ID: PAT_MRT4530_18725C.1
atggcgcaagcggcaagctcctcgattccaagtgaactcccttctaggaccaaccatgatgtggagtttagcgttgtggattatcatcagtgcacattggagagcttggaaaaggatcttgcagcaagggtaaaatggggcagcagccaacatgttgtgataagtggctacgacatgagcactggtgaggaaacactgtttaaggataatatggatgtagcccatgcattgtttgttaggaagagtgatagaaagttgattttgtttgttaatgtggaggacaagatctcagaaaagataaaatgtgacttcatcaccaacaatctagcagagtcatggaacaaatgggtcaaggatatgaaggatcgtcctattgcagatcttgcagaaggcatcagagcaaagacaatggatctatttgcgagacggaggaagataggtgagaaactagatggtgtgatgctccctattgtagttcgtcaactgaatgcaatgactagagatttgggtcacttgaaggtagtgcaaggtaatagggaccaagcagaaatggcggagattactcctgaacatgatattagtaggcatgctgtcaatcttacagaacatacatgcacttgtagagagtggcaagtttctggcaaatcatgcccacatgcattagctctcataatatcagctagaaacccaagaatggctgattacctggatccttgttattcagtggaaaagtataagctggcatatgcaggagttattcatccacttccagataagtcccaatggccaaaagtaaatattggtttcaagttgctgccacctctcactatgagggacgtagggaggcaaagaaagaataggatagttgggtgccttgagaaaggaagcaaacctaggaccaaaggaaggtggcagattcaatgtaagaggtgtcttaacatgggccataggcaaacatcctcaaaatgtcctttaaatggtaccaagaaaaaaaggaaaaatcgtgccaaacaaggaagaccactaggttcaactagtgatgcagcgggttctagcacacccaaaagacaaaaggttgcaatcaatgattccagcaatatgagtcctgggcttgtcactagaagcatatcgaacccaactatggactgctactacaagctcccagttgaaaaactagcaatgcgtctgctgctgttcataggcctcgtgatctccctacagttcatggcagacggcgcatcattgccggacgataggtgcctaaagaagtgtggtgatgttgacattctatacccatttgggattggcgaaggctgtgccattgaaggctttgtgcttagctgcagcaagacagaggatggacgtggggatgtggcattatatggcaccacgccggtgctgaatatatcgctgcgctatggtcaggttcggatgaaatcaacgtacatatcctcgatgtgctacaacctctcaaccaagaatatggactacaagaactggctcctgaacctcacaacctctccgttcaccatctcgcagaaggagaacatattcatagtcatcggtgccaacacggccgcaaacatgtttggttacagccgctactctaccatgctaaatatgatcgggtgcttgtctcagtgctcaccgtataatagcttcacagctcaagatgggtcgtgtgtcggcatcggctgctgccaggccgtactcagcaacaacatttcctaccacgaagtgcaattcaaccccttatacaacaccacaacgtcttacaacaacagaagcatcacggacagggcaagctactgtggctacgctgtggtgatggaggctgctgcattcaggttccgaacagcatacctgaactcaacggccttttgggacgagcacaatggcagtgtcccggtggtcttgaactgggttgtgggtaatgagacatgtcaggttgccaagcaaatgggagatagatacgcatgccgtagcaaaaacagcatgtgcatcgattcatccagtggccctacaggttacctctgcaactgcactgaaggctaccgtggcaatccgtaccttcccgatggatgccaagatattaatgaatgtgatgttaacaatccacctccatgccctggccgttgcaagaacatacctggcagttttacttgttcaagcccctcacaatccagaacggtgatactagctgttagcctaagtgttggaattgttgccatggcaatgatcgtcacctgctcatacttggtccgtgaacggaagaaactggccaatatcaagaagaagtatttccaacagcacggtggcatgcttctgctgcaggagataggcttaaagcaagggcagagcactgccttcacaatcttcactgaagcagaactcatagaagcgacgaacaagttcgaggacaagaacgtccttggccgcggtggccatggcactgtctacaggggcatgctcaaggacagccgtctgattgccatcaaacgatgcatgtcgatgattgacgacaggcaaaagaaggagtttggcaaggagatgctcatcctgtcccagatcaaccacaagaacatcgtcaagctcctgggctgctgcctcgaagtggaggtcccaatgctagtctatgagtttatccccaatgggaccttgtttcacttcattcatggcggcaatgactgccgcaacatccccttttctactcgagtgcgaattgcccatgaatcagcccaagcactagattaccttcattcatcagcatcgcctccaatcattcacggtgatgtcaagacctccaacatactactggacgagaactataccgcaaagatatcggactttggagcctcaatactagtgccgactgatgaggcccagtttgtcaccttggtgcaaggaacctgtgggtacctagatcccgagtacatgcagacgtgccaattgacagataagagcgatgtgtacagctttggcgtcgttctactggagctgctcaccggcaaaatggccttcaaccttgaaggtcctgaaaatgagaagagcctttcattgagcttcttgtgtgccatgaaggagggaagactcatggacattatagatcatcacattcagactgatgagaatgctggggtgctcgaggaggttgctgacctcgcgagccagtgcctggagatgatcggcgataaccgaccgtcgatgagagatgtcgccgacaagcttggccggctgaggaaggtcatgcagcacccatgggcgcagcatgacccggaggagatggagagcttactcggggagtcgtcggtggctggtttggagatggttagcaccgggaatttcagcatggagggtggagctgtgcaaggcattctggagtctgggcgttga

SEQ ID NO: 3114 - DNA, 1375 bp, Oryza sativa
  Clone ID: PAT_MRT4530_18794C.1
ttttttttttttttttttttactaccaccgtaccttttttttatttttttttaatacaaaaggatggcagcagttacaataaaacagttattgctgtacaaaagctggccacaactgttcatcatgttctttgacacaaagaagtacagagaaattcaggaatggtacaaacacctggaacctacccaggatatatctctcgattccattgcattccagggatgatgaactcactaaagttcacttttatgttcacctagcatactgaaacagcacattggtacatgaaagataacagatagcatcgagcaggataaatacatagaacccccttcttccgactgctacaaagacgagaggcgaacgtcgcgccgtgcttaacaattcgatcctaatccttcttcaagatatcttctggctctcgaagggtgccgaacatccagtccatccacacggtgtagtggccatagttgtgacggtatgttgtatggtgaatggtgtgatagccagcacccatgaccggccaaaccttgccgtgaatgcagtcatggatgttagttgtccacacggcctctatgaacaagagagcaatgtgtgtcctgaagtgtgttgggataaggtagagcgcaaacacatgcggtatggcttgcaaaatcccatccagtggatggaatgctagtcctgcaaatggtgatagggtattctccttgttgtaaatatggtggtatgtgtgcaggtacttgtacaatggctttatgtcatgcaactctctgtgcatccagtaaattccaaactcaacaaagataagatataaagccagataaaccaggtacattggccaaccaacttcactgatattaacataacactgtgtccatccattctcaaccatgtactcagataaggttggaagggcacaatagagaggcatagcctttgatgcaacaattatttgcttcttcatagcttcgattgtaggtatagaatctttggggatgtaggcgtggcgcttccagtagtagatgacgaagcaccagaggaagccgcaggcgaagtagatgaggtagccgccgaggccgttgcggagccacgactggagcgggtgggggagggcgcgccaccagtcgcccgggaccacatggctgaggaagatctcgttgtaccaggccgtctcctcgacgaactggcgcaggtactcgccgccgccgcccgccattgccggccgcggcgccgccctgggattgtggtggtggactggtggtggtgcgggggttgagttgtaaagcgtggagagagagagtagggacccgcaaccttcgtttgtgggttttaaaggagagacagacagtagtgcgtggggagttgccccggccgg

SEQ ID NO: 3115 - DNA, 2080 bp, Oryza sativa
  Clone ID: PAT_MRT4530_18872C.1
cctcggggcccactaccccgctcttcctcccccccgctcacttcctcaaatcctccaacacctcgatccattcgcagtagctgcgaggtgtctgacatggcgtcggggcagaaggtggtgaagccgatggaggtgtcggtggaggccgggaacgccggggaggcggcgtggctggacgacgacgggcgggcgcggcggacgggcacgttctggacggcgagcgcgcacatcatcaccgccgtcatcggctccggcgtgctgtcgctggcgtgggcgatcgcgcagctgggctgggtggccggccccgccgtgatgctcctcttcgccttcgtcatctactacacctccaccctcctcgccgagtgctaccgcaccggcgaccctgccaccggcaagcgcaactacacctacatggacgccgtgcgcgccaacctcggcggcgccaaggtcaccttctgcggcgtcatccagtacgccaacctcgtcggcgtcgccatcggctacaccatcgcgtcgtccatcagcatgcgcgccatcaggagggccggctgcttccaccacaacggccatggtgacccgtgccgcagctccagcaacccttacatgatcctcttcggcgccgtgcagatcgtcttctcgcagatccctgacttcgaccagatttggtggctgtccatcgtcgccgccgtcatgtccttcacctactccggcatcggcctctccctcggcatcgtccagacaatctccaatggcgggatccagggcagcctcaccggaatcagcatcggcgtcggcgtcagctcaacgcagaaggtgtggcgcagcctgcaggcattcggcgacatcgccttcgcatactccttctccaacatcctcatcgagatccaagacacgatcaaggcgccgccgccgtcggaggcgaaggtgatgaagagcgcgacgaggctgagcgtggcgacgaccacggtgttctacatgctgtgcgggtgcatgggctacgcggcgttcggcgacgcggcgcccgacaacctcctcacgggcttcggcttctacgagcccttctggctgctcgacgtcgccaacgtcgccatcgtcgtgcacctcgtcggcgcctaccaggtgttcgtccagccaatcttcgccttcgtcgagcgctgggcctcccgccggtggccggacagcgcgttcatcgccaaggagctccgcgtggggcccttcgcgctcagcctcttccgcctgacgtggcgctcggcgttcgtctgcctcaccaccgtcgtcgccatgctcctccccttcttcggcaacgtggtgggtctcctcggcgccgtctccttctggccgctcaccgtctacttccccgtcgagatgtacatcgcgcagcgcggcgtgccacgtggcagcgcgaggtgggtctcactcaagacgctcagcgcgtgctgcctcgtcgtctccatcgccgccgccgcgggctccattgctgacgtcatcgacgcgctcaaggtgtacaggccgttcagcggatgattcttctgattctctcttgctgctttgagcagagcatccactggtaaaaagtggacagtaattttctttttttacagtctatggacgtagtacagtaaaaaagtgtgtacaactgtacaagggagcagtagaatccttgcaggggtaaaatactgagatgtaactactgagcattttgtagcgctcaaacaggtacagaggggaaaaaattgaacccagattgtatggaggttggcgtaatataattgagccgcagccaaaaaatgaaattcagaatttactggttactgaagctccacctactaattcatcgagcacctcgcgtgcatgcacataccgtacgttattacgcgtggtcgagatgaagtacagatgattgtatcctaattaatcaattaatcaaccaaaattaattaactaattactatttagttattattgtcacacgtgtggtgaaaaaaaaagtgaaaagaggaatttgagacaggttgcatagagtgttgtttatgctattgttgcttgtatactgcctgtattaattccaaccgatgctact

SEQ ID NO: 3116 - DNA, 1494 bp, Oryza sativa
  Clone ID: PAT_MRT4530_19048C.1
ggccccaaaaaaaaaacttaactacttaatttcccctgtataatcagatagcaaatccatcaactttcatccacgaataatccatttataacactgcctaaggacgcgacctcgcccctttcgctaatcaaaccgtacgcgccaatttgacggatggaaaaaaaatttctttttttaataaaaggtttagcataatcgaaagtccaaagcttgcacttctaaagtaacatttgcagcagtacatccaccataaatggtggtcttttcgatccagtggcatctcatgttggtccatactagtggtacagtttaacaatagactgttgtataaacacagcagtatctgggacgatactcgagtaatacataaattctattctacatatatatctccatgccaagtattttcgaagactggcatagcgggcagaagctcagcttgctttcgcactccttgcaaaggcaaagatgccgacaaggcaacaatagcatgcaagcctcgcttgacttgcagactctacatgcggtcaaatctttggagtgtctgttctccttcggcattagttgcaaattggcggcaccaccattgcaacaggatgccgtgtcatccacctcgctatcaccacaaccttctttgaaatccttgctttgatgggcacatacctgttccaagttgtacttcagtgcgtttatcatgctctcattgtacttggccctttgctgccacgcaccaacttccactgccaactgtttaatctggtcctcaagttcagagttccttttgttaatgttctccacttctgcctctttatcccgtatttttctaagtatcttatcctcaacagaggccagcgcctcaaattgctttgcctgaactttctccaatatggactgcctaagccgctcactctgggccttgatgaagcggtccatatctgcatcgagccgctgaacctcgcgagagatgtcatcatccaacatcgggagcaggagcaacggcgaatcgccggaggagttcccagccccagcgccgctgccaccgccatggcgtctgtcctccagagagagcgccagcccagtggacaccgcggagcccgtctgcaggaaatcgatggacgacatctgggagttctctcctagcagctcctgctccctaggctgcctccaccctagccccgccgcggccgtaagccccatcgcgtccaccagtggtggctgcgcgggctggtcctggaaggccggcggcgggttgaagaagggaagaggcgccgggatctgcccatctaccggcaccggcagcgcgttcctgaaggaagggggcaccggttgctgctgctgctgcggcggcggcggcggcggagcctgaggatgcggctgctggaggtggtgatgggagaagaacgccatggccgaggacggggaggaagtcgggggaaggagggagagaggggaaagggaaggtcgaggccggagaggagagagaagcccggccgg

SEQ ID NO: 3117 - DNA, 483 bp, Oryza sativa
  Clone ID: PAT_MRT4530_19282C.1
ctcactcctctccccctccacgatctcgccgggatctccacggcggcggcggcggcatggcgggcaacgacaactggataaacagctacctcgacgccatcctcgacgccggcaaggcggcaatcggcggcgaccgcccctcgctcctcctccgggagcgcggccacttctccccggcgcgctacttcgtcgaggaggtcatcaccgggtacgacgagaccgacctctacaagacatggctccgcgcaaacgcgatgcggagcccgcaggagaggaacacgcggctggagaacatgacgtggaggatctggaacctcgcgaggaagaagaaggagttcgagaaagaagaagcctgtcgtctgttgaaacgccaaccagaagctgagaaattacgaactgatactaatgcagatatgtctgaagatctatttgaaggagaaaagggagaagatgctggtgatccctcagttgcgtatggtgaca

SEQ ID NO: 3118 - DNA, 545 bp, Oryza sativa
  UNSURE (1)..(545): unsure at all n locations
  Clone ID: PAT_MRT4530_19435C.1
  unsure (1)..(545): unsure at all n locations
atttctgtgaaattgtgtgcagcaatcatgtctggtcgcggtaaaggaggtaaaggtctcggcaaaggaggcgctaaacgtcatcgtaaagttctccgagacaacatccaaggaatcaccaagcctgccatccgacgtctggctcgccgaggaggtgtgaaacgtatttcgggtctgatctacgaagagacccgaggcgtgttgaaagacttcctggaaaacgtgatccgtgatgccgtgacgtacaccgagcacgcgaagcgaacgaccgagactgctatggaccgtcttctacgcgctaaaacgactagggtcgcaccctctacgggttcggcgggtgagcgtcgaagacttaaaaccaaagaagcccacgcggaagcggcaattctccgttcgttcttaatctcaacaactcaacaacgcgaaccgtcatcgggacggtattgcccgatccagtgtatagacataatcgtcaatctctctttgtgcgatatgattgactcaatcttncttgtgcaccgatcatttcgaagctcttaatcata

SEQ ID NO: 3119 - DNA, 6074 bp, Oryza sativa
  Clone ID: PAT_MRT4530_19802C.1
tttttttttttttttatctcaaaatatgagcttcaattttttctcatttaatttcatatactttcctaaaatccgggtctactctaaaaatcactatattttgaaacgaatagagtaataaaaaggagctctacactgaaacatctgctggtatatcctatatgattctgtcttttttataactacacatgacacaaatatattttattcagcgctgatgcggctgctaccccaaaattacaaaatttattacacaaaagacattgcggaaagctttgtacagtttcactacatgctctcgatcatctggatagggtaagacttttgctaccaagcgtctaagctaagtaattaagcgatacctttcttccaaaatatggcgactcccaaaaagagatctaccgggacctttagctgacagaagtgcaaattgactgctgggaatagagaccatgtatgggatgcacaaagtgctgcttgcttcttctacgttttgaaactactgtaaatccttctgtatccttctcactcttaggtaccacggtggccttctgctgtttgtcaagctctttgcgacctgacggactcttgtttatgttgttgctgctctgtgcattaccagattcgtctggtccacttggttttctgtccgattcagctccagtggaacctaagctatcatgtactgacttgacgatgaaactgaacaaaatctgccttgccagctctgttttgcatgagtttctcaaggcatctttcgctctgttttcctttcctttgcatgggctggtgctctcaccttgaattgcttgttctgctgcaggcataccagcctttacttcatctgatgtctgtggtgccaacagttgatctgctgaatcagttacagaaacatctgcactaggctctctgttagccacatcaggttgttgcgaagtttttccaggcacaaactcggcagcatgaggattcatggttgggggggagttgctacccctcagaatggtgctctggctgtgtgcgtaaccctgttttctttggaaggtatgcccagtacggtagtacaatgtggaccgaggaccacggggtaccctagtatcaatggcgtgagggagaatctccattggttgacttggtattggctgaagaacgacgctagcatcatatattgccactgtactgtaagggtgcgacatcgataagagtgatccaggattgaatggaggcgctgaagctgaaagcttgcttccaccttttttcttagattcagttgggctttcatcactgttgctgtccggagctttttcatcattgccgatttcctctggttcacttgaaagaacctctttgctgctgtcatgacttggcttttccttttcttcatcttcatctgttaacttcttatcttcctcctcagatgacactattagatcagtattttgtgcattatccttctcctttgcttccttctgctccaaagccggctgctccactgcgccgcggcgggtcaccgcgtcgcctgtggatcatcccaactcgcctgctatgccaatatctttcacctgtattggaagtgtttttacgtctagtatgatacttggattggcatcccaattcatctctagttccatgatgtcagtttttagaaagctgccaaaggagagctggctagaagagtttataacatcttctttatctcctttcatgtgttgttgtacaccagccctataagcagaacctgtacggccatcttccaagcgatcaaccattaatttagtgagagcaggccttctgcgactgcttttcttccgtacatttgcagatcgtccacgcaaattagctgcttgccacccttcatcagaatattcttcaggtgataaaggatcaacttgcttcagctcatcatggatagcataattttcttctgatattgctggagggtgtgccttcaattttacttgttgaaactcctctttgtttgcttcatgaggagatcctatgtcgtgctcaaagctctccttttcttcaactaattcaccttgatgggctctgatattattctttgcacgcctgccctttctttgtgtatccctctcttttctttcctgatccgggcttatgtagtcaagtagatctgatagatgtcctttgcttgcaatagatgagtcaggttttgggatgccccttcgggcggcctcttgttgttctaatgcttttgactcaaaatactcaagccatgcagcagcatcctgagttcgaaggtcatcttgtcctagtttctcctgaagtatctgtaaggtggtctgttcatgctgaacactcaaggagtatgcatccatcattgagagggctatggctatggcatgatagctcgcagcagtctggaaggtgatcagctgcctgaacaggctctgtgttgcacttgcagggcttgcatgcaagtactttagagccatttcgatgtgctggagacggtagtagaagacagataaatccccgtaactcttcatagtttctgggtggtcaagacctagctctctttcattgatatcaagtgccttctgctgatatatagttgcctgattaaaatctccagtatggtaaagaactacagcaagaagactgtacgcattagcagtcagccgatggtatggaccacaaactgctacaattttggacaacgcctttgttccgaagttgacggcatcatcaagttttcctttatccaaagccatctttgatgattctaataagtttcgaccatcaatagaagagtacaccacatgcttgcatacaggaataatgttaactatgtcagatttgtcaaatggatttgggctattcatatcataatctctcgcaaccaactcaagtccaaccagctttggaagcgcagtatcatcatagaatttatgggccatcatagtgagctcttcaagggacttttgatgaagtccagctcccagatccttaaggcgacagaaatcatcctctgacatcagcttgctaatatcagtctccttggtgttttcagattcttccatgccatttatgacagagcagttactgtcagagtcttccttctcagacatagcaccttcaacatggcattctttctttttaattttctttagctgttcaaagtgcttaccaagacctttgatagttgtctctttttcaacatgtcctgcatttttcttgtcctcagatgccggcgaatcctttttcttgttgtgatccagaaaagctttcatcagtgcatcatatgcattggcaaatgcactgctgagctgttgcaacagatccaccaaggagtggctcacggtgtgcggcttccctgccgaatagaagcccttgacggaagcaacgatgtgcaggagcttcccattgcaaactttcacctcgatttcgaagtagtcgccttcctgagaagcgccattgctctccttcctcctgataaagtggacgggcggggtgaggtgggcgaaggagaggaagtcgtagaactcgcccagcctgggcggcggacggatggccgccatgtcgtgcgcctccgatatcggcggcgcctgggcggcgccggcgccatgggcgtcgggggaggcggcgagcgcgggcggtgacggcggcgtcgccgggcgcgcgtgcttggacgacttgtgcttggcgccgtcgcggggcttgttcacgaacgcggtggtgcaggcgacgatgtccagcagccgccggacttgcgccgccgccgccgcctccgtcgcgtactcctcttccacgatggtgagagagcatggtttcagcgacacgatttccacgccgtcctccagccgctgccctcgcgtcacgtgcgagagcgagtagtttgtcaggtggcacgtctccacattcgagcccagcagcttcctcacgtccagaacacggtccgtagatatccccttgagtgtaacctgggattcatagggagtgacaaccgtgacgtctatggcactcggcacaactttctcttccttcttcctcttgtcgcctttgccgccgccgccgccgcccctgcccttgccacggccggcgcccttgggggccattgcgcctgaagctccaaacccaacagccacaaatggagcgtcggcccggagccctgaggggtttaagcagcagcagcagcagtaggagaaggaggaggaggagacggacgcctcgacgacggcttcgctcgttggaaagtgaagcgcgaggttggggttggggaggagagggagaggatataggatgtgcggcgtgcgagggcgctcatctgaaacccacggattttcgtgcgatcccggcctctcgttctcctggatggattgaaaacgtggaccgtggggctcggagcttggttttattgggcgctggatgaagcacacgatgatgctctgttggtatcgtccaaacctgaagcgaatctgcccaaggtaggaaaccccgggatgctcgtgcggctcgtgtcctgacctagaaatctttactcctaaatccccaaaaatccccaaacctaaatgccctctgtccacttcccagggagagagggcgacctcgacgactccgggagaggcggcgcggagctgggctccacgaggggcgtcgacgcggcgggggcggcggggctccgggataggcggcgcgccgcgcgcctccgcgaggggcgtcggcgcggcgggggcggcagggctctggttcgtggcggcgtggcgctgggctccgcgaggcgcgtcgacggggctgtgtttgtcatgtacatcttcgacaacaaaatcaaaagtttggttccaaactggattcaagctttcgctcacaacccttgtcttgtacttggtttttgatttcttgagtgaaagtacaacatatgggtcagactttccattcatatccattgctggcagatcttccccagatatcacagttactgacaaaactccccgcataatgatttcttttttcttcctggaagacaacctgttaaaaccattgctccctgacccattttccatgctcgtcattgtcctctccaaggatgtcatagaaaactgctgtctaaaaggatttggagtctcctccttcatgtcaaatgggcagtagagtagctcaagatgcacctgaccccgatctttccggtccctttgaatctccaagtcttttacaagcttcaaccagacatccttcactttgcctggctgtagatccttcagagtaacttgagcacagccaatcaattcagattcctgaataccatcatcatcataaatcttcactgtcacagtctgagtatctgcatcttcaacaataaactcaaagtgttcattccagatagggttcaagtcgttgttctgtaaatttgaagcacataaacagctgtagtccccaggtattataggaatgactttccttacaggccatgttattgagtcttctatagcattttttattgtgtcctcaagagcatccgaaatcccaggtatagcagaaatttcaccaccaatgaccttcagtctgaaatccagctttttcttctttcgtagagaaaagcaaactgctccaaagcagggcaactgatcaacaagtggcttgaagatcaagcggaaaactcttggattggcatcccaattcatctctagttccatgacaatgcctgattcgtcattctcaatgatcgaaacaccagtaaactgtggtgcaacagtaccaagagtgagttttgagaacttgagagaagctaagattattggtcgatattgttcaagaacaggctccacggaggttttgatcagttctgatgctgccgcgttcacaaatggccatatttttatcagctcttgattgagccattttaacttttgctgtgttgagaaaacaacccaggaagggtacaggtcagctgggagtaacttccgtgaatcttcaatagtcatcttggagaaactagcaattgtggcagccagctgccggcggcgggcggcgcgggagttctcggcgcgggcgaagcccactatgagagccacgcccgccgcgatccccagcaccaaccccaccaggaaccccat

SEQ ID NO: 3120 - DNA, 4399 bp, Oryza sativa
  Clone ID: PAT_MRT4530_19805C.1
cttttttcttagattcagttgggctttcatcactgttgctgtccggagctttttcatcattgccgatttcctctggttcacttgaaagaacctctttgctgctgtcatgacttggcttttccttttcttcatcttcatctgttaacttcttatcttcctcctcagatgacactattagatcagtattttgtgcattatccttctcctttgcttccttctgctccaaaatcggtttcaagactgtgccagggggtgacactgctacatctttgtatgataccaacttggaagctatagtagcaggtctgttaattcctgaaagctttatgcctcgttctggtttagatatagcattgaaaaccttattttcaatattgctggaattcccattcaccttgtcagtttttagaaagctgccaaaggagagctggctagaagagtttataacatcttctttatctcctttcatgtgttgttgtacaccagccctataagcagaacctgtgcggccatcttccaagcgatcaaccattaatttagtgagagcgggccttctgcgactgcttttcttccgtacatttgcagatcgtccacgcaaattagctgcttgccacccttcatcagaatattcttcaggtgataaaggatcaacttgcttcagctcatcatggatagcataattttcttctgatattgctggagggtgtgccttcaattttacttgttgaaactcctctttgtttgcttcatgaggagatcctatgtcgtgctcaaagctctccttttcttcaactaattcaccttgatgggctctgatattattctttgcacgcctgccctttctttgtgtatccctctcttttctttcctgatccgggcttatgtagtcaagtagatctgatacactaagatgtcctttgcttgcaatagatgagtcaggttttgggatgccccttcgggcggcctcttgttgttctaatgcttttgactcaaaatactcaagccatgcagcagcatcctgagttcgaaggtcatcttgtcctagtttctcctgaagtatctgtaaggtggtctgttcatgctgaacactcaaggagtatgcatccatcattgagagggctatggctatggcatgatagctcgcagcagtctgaatgtgatcagctcctagcagtctcttgttgcacttcagtgcttcatgcaagtacctgagagcgacatgaacatttcccataccttcttccatcatagccacatttatgtatgtggcagctgaatttggatgtgaaagcccacaagaaaattggagtagatatagtgcacggttgacatactttagagccatttcgatgtgctggagacggtagtagaagacagataaatccccgtaactcttcatagtttctgggtggtcaagacctagctctctttcattgatatcaagtgccttctgctgatatatagttgcctgattaaaatctccagtatggtaaagaactacagcaagaagactgtacgcattagcagtcagccgatggtatggaccacaaactgctacaattttggacaacgcctttgttccgaagttgacggcatcatcaagttttcctttatccaaagccatctttgatgattctaataagtttcgaccatcaatagaagagtacaccacatgcttgcatacaggaataatgttaactatgtcagatttgtcaaatggatttgggctattcatatcataatctctcgcaaccaactcaagtccaaccttactgcaaagacctctcagaatgataaatttccgcaagtgtgcaaattcatctttcaatttccaattgtaccttttagaaaggaacctctctacccatctaaatctcaaattatgttcactatgtgcatctgtttcagtgtcactttcaagtcttgggcatccaagtaaaatgtttaaagtctcagcaatagcggcagacatattttgcatgtcatcaacagctgcaataacagctcgaacaatgtgcttaaaggacctaatgaccatttcatggatgcaaattgactggatatgtggaagcttctccgcgagctctaccacacggcctaaggagcacatattaagaccccttgtgtgcatgaaatcagtcatggttcttccatccacaggagaaagttcaagggaagcaaaatcagccaccagctttggaagcgcagtatcatcatagaatttatgggccatcatagtgagctcttcaagggacttttgatgaagtccagctcccagatcctttaggcgacagaaatcatcctctgacatcagcttgctaatatcagtctccttggtgttttcagattcttccatgccatttatgacagagcagttactgtcagagtcttccttctcagacatagcaccttcaacatggcattctttctttttaattttctttagctgttcaaagtgcttaccaagacctttgatagttgtctctttttcaacatgtcctgcatttttcttgtcctcagatgccggcgaatcctttttctgcaagttttgcagccaggatgacccaagttcccatctgatggttttaggattattggcaggcatgttctccagcttcatcaagctatcttcaagtattttgcgcactagtttccttgcatgattatcaacatgagactgcggagtaggacactgagtactagcgatgtctgagttgacaatttttggcagtgatattcttagactgttaatgttcaaggcattagaacctccatctggcaaatcatctacatcaacattcgaaattccatcgagatgatcacagatatcactggtttgtttgccaccatttccgtcctttgtgcgccctgaaaccttcactgttgctgtatatccacaatgtttaacaataaccactccgagtgttgaggtgtccttaacaacgacactttcatcagaagttaaaccttttagaagatttctttgtgatatatccatagaaccggtttgatagagtgcaactccatcaactttatcctccagctttaaactagcatcagcctgatccctctttacagttataagcaagtcaccaacacgttcctcgattgctaaagaaccatctgggccagcttgttgactagttgagttcccagacagatcaatgagtctctgtattgttgatgcagctctaaaaattgctgtatctacaaagagattgtgtaaaagaaaagccttccggtctctgatcaccctcccttcctcagttttgcatggcattctagccaaagtagaaaattcttttgcccatcgtcttctgtcatactttccatctcgcccattgccacccccgtttccaccccaattctcatcctcaactggtaatgctgggcactttgtagcagaatccaagtatataggaggaataagccatgtgtttgcacgaaatccgtatggtagattcccaaacttgttgtgatccagaaaagctttcatcagtgcatcatatgcattggcaaatgcactgctgagctgttgcaacagatccaccaaggagtggctcacggtgtgcggcttccctgccgaatagaagcccttgacggaagcaacgatgtgcaggagcttcccattgcaaactttcacctcgatttcgaagtagtcgccttcctgagaagcgccattgctctccttcctcctgataaagtggacgggcggggtgaggtgggcgaaggagaggaagtcgtagaactcgcccagcctgggcggcggacggatggccgccatgtcgtgcgcctccgatatcggcggcgcctgggcggcgccggcgccatgggcgtcgggggaggcggcgagcgcgggcggtgacggcggcgtcgccgggcgcgcgtgcttggacgacttgtgcttggcgccgtcgcggggcttgttcacgaacgcggtggtgcaggcgacgatgtccagcagccgccggacttgcgccgccgccgccgcctccgtcgcgtactccttgtactgaccagtatgagtcagtgaccaccttccacgatggtgagagagcatggtttcagcgacacgatttccacgccgtcctccagccgctgccctcgcgtctgcgtcatacatcacacgcttcacaaattcagacttcaccgaacacagcacgtgcgagagcgagtagtttgtcaggtggcacgtctccacattcgagcccagcagcttcctcacgtccagaacacggtccgtagatatccccttgagtgtaacctgggattcatagggagtgacaaccgtgacgtctatggcactcggcacaactttctcttccttcttcctcttgtcgcctttgccgccgccgccgccgcccctgcccttgccacggccggcgcccttgggggccat

SEQ ID NO: 3121 - DNA, 1938 bp, Oryza sativa
  Clone ID: PAT_MRT4530_2005C.1
tagtggatcccccgggctgcaggctctcccacacaatccccacccggcctagcgagcgagagagagggaagggttgcgacttgcgactcgcgagcggcgagatggcgaaggacgtggagatggcggtgcggaacggagacggcggcggcggcggcggctactacgccacccacccgcacggcggcgccggcggcgaggacgtcgacgacgacggcaagcagcggcgaaccggtaacgtatggacggcgagcgcgcacatcatcacggcggtgatcggctccggcgtgctctctctcgcatgggcaacggcgcagctcggctgggtggtcgggccggtgactctgatgctcttcgccctcatcacgtactacacctctgggctcctcgccgactgctaccgcactggcgatccggtcagcggcaagcgcaactacacctacatggatgccgttgcggcctacttaggtggctggcaagtctggtcctgtggtgttttccaatatgtcaacctggttgggacagcaattgggtacacaatcacagcatccatcagcgcagcggctgtgcacaaggccaactgctaccacaagaacggccacgatgccgattgcggtgtctacgacaccacgtacatgatcgtctttggagtcgtccagatcttcttctccatgctgcccaacttcagtgacctctcatggctttccatcctcgccgcggtcatgtcattctcatactcgaccattgccgttggcctctcgcttgcgcgaacaatatcaggtgctactggtaagactactctgactggcgttgaggttggagttgacgtcacttcagcccagaagatctggctcgcgttccaagcgctcggtgacatcgcgttcgcctactcctactccatgatccttatagaaattcaggacacggtgaagtctccaccggcggagaacaagacgatgaagaaggcaacgctgctgggggtgtcgaccacgacggcgttctacatgctgtgcgggtgcctggggtacgcggcgttcgggaacgcggcgccggggaacatgctcaccgggttcggcttctacgagccctactggctgatcgacttcgccaacgtctgcatcgtggtccacctggtcggcgcctaccaggtgttctgccagcccatcttcgccgccgtcgagacgttcgccgccaggcggtggccgggctcggagttcatcacccgggagcgccccgtcgtggccggcaggtcgttcagcgtcaacatgttcaggctgacgtggcggacggcgttcgtggtcgtcagcacggtgctcgccatcgtgatgcccttcttcaacgacatcctgggcttcctcggcgccgtcgggttctggccgctgacggtgtactacccggtggagatgtacatccggcagcggcggatacagcggtacacgtccaggtgggtggcgctgcagacgctcagcctcctctgcttcctcgtctcgctcgcctccgccgtcgcctccatcgagggcgtcagcgagtcgctcaagcactacgtccccttcaagaccaagtcgtgatcccgatcacgacggccttttttttttgcttttgcatcctgatgaaaaaagatttcagaaacatatgcacaacaaatgccggaagttagccaagagtttggtcaccagctcggtgcgttggtcggtcaggaggaggagggttcaacttgtgtaggttaagaaatgctagagagtatggagaccatcttcgattgctgctcatgtatagaaaaaagaggaagcttcgtattcatgtaatgaatcggaatgtttaacaaacaaggcttgttctgaactcttctcagggacaggcatggataacagattaaagataaatgaatgtgttagacaagggcagattagaagcggctcttaagcttcacacaaaaaaaaa

SEQ ID NO: 3122 - DNA, 2313 bp, Oryza sativa
  Clone ID: PAT_MRT4530_2013C.1
atggcgctcatcggcacggtggcggccgaggtgctcatcccgctcgcggcggtgatcggcatcctcttcgccgtgctccagtggtacatggtgtccagggtggccgtcccgccgcacgacggcgtcggcggcgccgggaaggtggagagggagagcgacggcggcgacggcgacggcgacggcgtcgacgacgaggaggacggcgtggactaccggggcgtggaggcgaggtgcgcggagatccagcacgccatctccgtgggcgcgacgtcgttcctgatgacggagtacaagtacctgggcgcgttcatggcggcgttcgcggcggtcatcttcgtctcgctgggctccgtggggcggttctccacgtcgacggagccgtgcccgtacgacgcggcgaggcggtgccgcccggcgctggcgaacgcggcgttcaccgcggcggcgttcctcctcggcgccaccacctcggtggtctccggctacctcgggatgcgggtggcgacgttcgcgaacgcgaggacggcgctggaggctcgccgcgggatcgggcgggcgttcgcggtggcgttcaggtcgggcgccgccatggggttcctgctggcgtcgagcgcgctgctggtgctgttcgccgccgtgaacgcgttcgggctctactacggcgacgactggggcgggctgtacgaggcgatcaccgggtacgggctcggggggtcgtccatggcgctgttcggccgcgtcggcggcgggatctacaccaaggcggccgacgtcggcgccgacctcgtcggcaaggtggagcgcaacatccccgaggatgacccccgcaaccccgcggtgatcgccgacaacgtgggcgacaacgtgggcgacatcgccgggatggggtccgacctgttcgggtcgtacgcggagtcgtcgtgcgcggcgctgttcgtggcgtccatctcctccttcggcgccgaccacgacttcgcggcgatgatgtacccgctgctggtgagcgccgccggcatcgtggcctgcgccgccaccacgctcgtcgccaccgacgccggcgagctcggcgccgccgacgaggtcgcgcccgcgctcaagcgccagatcctcatctccaccgtgctcatgaccgccgccgtcgccgccgtcaccttcctctccctcccccgctccttcaccctcttcgacttcggcgaacgcaagctcgtcaaaaattggcacctgttcatctgcgtctcagctggtctgtgggcgggattggtgataggctacgtcaccgagtacttcacgagcaatgcttacgggccggtgcagacggtggcgcagtcgtgccggacgggggcggcgacgaacgtgatcttcggcctcgccgtggggtacaagtcggtgatcgtgccgatcttcgccatcgccggcgccatctacgccagcttccggctcgccgccatgtacggcatcgcgctggctgcgctggggatgctgagcaccatcgccacggggctcaccatcgacgcctatggccccatcagcgacaacgccggcggcatcgcggagatggccggcatgccgcggcgcgtgcgcgagcgcacggacgcgctcgacgccgccgggaacacgacggcggcgatcgggaaggggttcgcgatcgggtcggcggcgctggtgtcgctggcgctgttcggcgcgtacgtgagccgggcggggatccggacggtgaacgtggtgagccccagggtgttcgtcgggctcctcgccggcgccatgctcccctactggttctcggcgatgacgatgcggagcgtggggagcgcggcgctgcggatggtggaggaggtgcggcgccagttcgacgagatcccggggctcgccgaggggctcgccgcgccggactacgccacctgcgtgaggatctccaccgacgcgtcgctgcgggagatggtggcgccgggggcgctggtgatggcgagcccgctcgtcgccgggacgctgttcggggtggaggcgctggcggggctgctcgccggcgcgctggtgtccggggtgcaggtggcgatctcggcgtcgaacagcggcggcgcgtgggacaacgccaagaagtacatcgaggccggggcgacggaggaggcgaggtcgctggggcccaagggctccgaggcgcacaaggcggcggtgatcggggacaccatcggcgacccgctcaaggacacctcggggccatcgctcaacatcctcgtcaagctcatggccgtcgaggcgctcgtcttcgcccccttcttcgccgcgcatggcggcatcgtcttcaaccacctctga

SEQ ID NO: 3123 - DNA, 1295 bp, Oryza sativa
  Clone ID: PAT_MRT4530_20264C.1
ctctctcaagcagcttagctcctgcctccttctctgatcattcttgcaaaccaatcgagtcttgaacgaggtcaatgggcaaggaggtggacgtgtccactctcgaggccggcggcgcccgggactacatcgacccgccgccggcgccgctcgtcgacgtcgacgagctgggcaagtggtcgctgtaccgcgcgctgatcgccgagttcgtcgccacgctgctcttcctctacgtcacggtggccacggtgatcgggtacaagcaccagacggacgccgccgtgaacggcgccgacgcggcgtgcggcggtgtgggcgtcctcggcatcgcgtgggcgttcggcggcatgatcttcatcctcgtctactgcaccgccggcgtgtccggcggccacatcaacccggcggtgacgttcgggctcttcctggcgcgcaaggtgtcgctggtgcgcgcggtgctctacatcgtagcgcagagcctcggcgccatctgcggcgtcgggctcgtcaaggggttccagagcgccttctacgtgcgctatggcggcggcgccaacgagctcagcgacggctactccaagggcaccggcctcgccgccgagatcatcggcaccttcgtgctcgtctacaccgtcttctccgccaccgaccccaagcgcaacgcccgcgactcccacgtccccgtgcttgctcctcttccaattgggttcgcggtgttcatggttcacttggccacgatcccgatcaccggcaccggcatcaacccggcaaggagcttgggagctgcggtgatctacaaccagcacaaggcatggcatgaccactggatcttctgggtggggcccctcatcggcgccgccatcgccgccgcctaccaccagtacgtcctgagggccagcgccgccaagctcggctcttcctcctccttccgcggctagacgccgccgccgctggatgcatgaccggaggcattgaagtgtagatatatcgatatcagagagggcctccggtcagctcgctgttaatgatcagctagctgttcgtttgcctgccagagctagtttatcctcggtttctggctttctgcgtcagctagcttcttgatcatcttcagcttctgtaattcctgagctatgctgcataattgtttgctcaatgtttcttccaggtgtgcttttcatgttaactttgtatgtgtctgtatgtatatatgcgagctgtgtgcatatggtaccaaaaaaactgtatgcactctatatgaaaaagtacttcgatgttttcctcctaggttcttc

SEQ ID NO: 3124 - DNA, 183 bp, Oryza sativa
  Clone ID: PAT_MRT4530_20333C.1
ggcccataacaataaaccccaataaaagggctaacagaaaaacaggaagtgcccccaagcatttcaagaggttcccccacccccaaccaggcctggtttcacagacccccacctgttttgttacgagtagcttaaaggggagactgtaaaaccattgttggcaaccttacatacgggggagcc

SEQ ID NO: 3125 - DNA, 1746 bp, Oryza sativa
  UNSURE (1)..(1746): unsure at all n locations
  Clone ID: PAT_MRT4530_2073C.1
  unsure (1)..(1746): unsure at all n locations
atggccgcggagttggcctcccttccacgtggcctgcacttttttcggctgagtggatgtgtggttagccacgcaactttccctggatcgaaagcgatgggccgttggattgggccccagcgcgaagcggacggcgatcgcggaccgcggaccaaagaggaagccgccccgaagcgcttcgtccacacgcccatcccgccctccatcctctccgacccaaccctcgccgctgccgccaccggcctcctcccggcggcgtacaacttcgagctccccaagacggcgcaccgcatccgctcctccggcgcccgccgcaccgcgctgcagcttccggagggtttgctcctcttctccctcccgctttcccacctcctcgcgcccttcctcgagccggacccctccaacgacgtcctcatcctcgccgatcccacctacggcgcgtgctgcctcgccgaccgccccgccaaggcgctcgccgccgacgtgctcgtccactacggccattcctgcctcgtccccgtcacctcctccctcctccccgtgctctacgtcttcgtcgagatccgtgtcgacgcccaacgcctcgccgacgctgtccgcgccgccttcccggaccccgccgatgcgccccgcctcgccatcgccggcaccgtgcagttcatttcggcagttcacgcagcgcgtgagatcctcagtcacgatggttaccagggcatcgtcgtgccacaggcaaagccgctgtccgccggcgaggttcttgggtgcacagcacctgccctgaaaaggtccgagggggtcggagcggtggtgttcgtcgcagacgggagattccacctcgaggcattcatgattgccaatcccggggtcaaggcctaccgctttgatccattcctgggtgtgcttgtgctggaggagtatgaccatgtcgggatgaagcaagcgaggaaggaggcggtgctggcagcaaggaaggccaagagttggggagttatactaggcacccttgggcggcagggaagcgtaaaagttctcgacagggtggtggagcatttggaggagaaagggctggaacacacagtagtgctcatgtcggagctgtccccggcaaggatggagctgtttggggattcggtggatgcgtgggtgcagattgcatgcccacgtttgtcgattgactggggtgaaggattcaagaagccaatgctgacgacattcgagtttgatgttgcactgggctatgttcctggatggtgggagaaggggagtagggaatgtggcagtggagatgccaccggttgttgttcaggatcaggaacttccacagattgtggttgcagcaatggtggttgtgctgacaaggactttgggggggagtacccaatggattactactctcaggatggaggtgattggaacagctgctacatgaagaagaagccctctactggagagagaaagctgcgagttcggattggtaattactcaaattcataggggtttacacccggcctttttgcctggcctcgtgcccccctctgcccggccgcatggctcgtctgacgcttgcgtcccccacgtgtcgatttgtccggctgatctttgcccttccgctaccgagtgctgtgatatctgtatctgtacccagatgtaaactactcgatccngcgcccccctgtaatcctgtgatgttggtcttcccataaaggtgaaatggattctaagtttatggagccccaaacaaaaaaa

SEQ ID NO: 3126 - DNA, 2109 bp, Oryza sativa
  Clone ID: PAT_MRT4530_20929C.1
cccacgcgtccgcccacgcgtccgcccacgcgtccgctagcagaaacaaacccctctcactcccagatacctgctgctgccactagcccactaccatggatccttgcaagttccggccgtcgagctcgttcgacacgaagacgacgacgacgaacgcgggagctccggtgtggaacgacaacgaggcgctgacagtggggcccagggggccgatcctcctcgaggactaccacctgatcgagaaggtggcgcacttcgcccgggagcgcatcccggagcgcgtggtccacgcccgcggcgcctccgccaagggcttcttcgagtgcacccacgacgtcaccgacatcacctgcgccgacttcctccggtccccgggcgcccagacccccgtcatcgtccgcttctccaccgtcatccacgagcgcggcagcccggagacgatccgcgacccgcgcgggttcgccgtcaagttctacacccgcgagggcaactgggacctcctcggcaacaacttccccgtcttcttcatccgcgacggcatcaagttccccgacgtcatccacgccttcaagcccaacccgcgctcccatgtccaggagtactggagggtcttcgacttcttgtcccaccaccccgagagcctccacaccttcttcttcctcttcgacgacgtcggcatccccaccgattaccgccacatggacggcttcggcgtcaacacctacaccttcgtcacccgcgacgccaaggccaggtacgtcaagttccactggaagcccacctgcggcgtcagctgcttgatggacgacgaggccacgctcgtcggcggcaagaaccacagccacgccacccaggacctctacgactccatcgccgccggcaacttccccgagtggaagctgttcgtccaggtgatcgacccggaggaggaggagaggttcgacttcgacccgctggatgacaccaagacatggccggaggacgaggtgccgctccggcccgtggggcgcctcgttctcaaccgcaacgtcgacaacttcttcaacgagaacgagcagctggcgttcgggccggggctggtggtgccggggatctactactccgacgacaagatgctgcagtgcagggtgttcgcgtacgccgacacgcagcgctacaggctggggccaaactacctgatgctgccggtgaacgcgcccaagtgcgcccaccacaacaaccactacgacggcgccatgaacttcatgcaccgggacgaggaggtggactactacccatcgcgccacgcgccgctccgccacgcgccgccgacgcccatcacgccgcgccccgtggtggggaggaggcagaaggcgacgatacacaagcagaacgacttcaagcagcccggggagaggtacaggtcgtgggcgccggatagacaggagaggttcatccgccgcttcgccggcgagctcgcgcaccccaaggtctcccctgagctccgcgccatctgggtcaactacctctcccagtgtgatgagtcgttgggggtgaagattgcgaataggctcaacgtgaagccaagcatgtgaagaaactaaggcacaagaatgcatcatctcttgttaattaattggagtactaccaaccaaataaggccagacaatgtcagatgcacgcatcttctgttgtcgttgggccatcttttgtatgcatcctattgttaattactagtacatgatatccaagtgatcatcagcaaggctacagaaattctgtaatacgataaattaaaagaaaccaaaatggagcctgcatatgtgtaacttaattaatgtactggcgtattaatgccactgctgcatgttgtaatactccatcaaagagtctattactattaagtatttaaattatcacttcaaaaaaaaaaaaaaaaaactcgagactagttctctctctattttgtgaaggtactgcagcttttacttaattaatcttgaacctcgatgtatacaacagtgaacagttaaattaatcatcattccctaatgcctcttaaaaaaaaaaaaaaaaaaaaaaaaaaaaaaaaaaaaaaaaaaaactcgagactagttctctccctcgtgc

SEQ ID NO: 3127 - DNA, 1807 bp, Oryza sativa
  Clone ID: PAT_MRT4530_20985C.1
ggtaagagcaaccttctacacgacggcggcggcggcggccgcctcggcctccggcgccgccctcttctcgaggaacccgacgtagaggtccgactgctcggtgtcgcagctgggcagcgccgcccgctcgccgccgtcggccatggccctgacgaacgacacgaactggcgccagttgtcgccgtcgaacagcttcttgttcatgcgcaggtacgtgaacgcgcccagcccggcgctcgccgcggtggccaccacctgcgcgaacgccgcctcgtcgtaccgctccagcgcgttctcgccggcgagccccacgcgcgccgcgcgcgccgcggaccgcacctgccgcaccagctgctccggcgagcacccggcgtgctccggctgctgctcgtcccgcatctccatgcacgtgaagttgagcaccgcgccgcgccgcgccagcatcgccgcgacgggcgcgtacccgtcgcggcgccgcgtgttgtagtaccccgccgtgagctccgcggcgtgcgaccgcgtccggtagtgccagtggatgccggcgaccttggccgagagcgcggcgccggtgccgcggaagacggcctcggcggcggccaggacgcggtcgccgtgctccagcagcatcccggagtaccacccgaggaagaagtcgccgtactcggtgcaccacgtgccgtctcgccggaagaaccccgtctcctccgggaactgcttgtactcgccggcgtcgtgcggcccgcccctcccccactcctcgtgccccgccgccgccgccgcctgctgcagcgacgccctcatgtacttgtcatagcattggaactcgccgatgccagggaaacgccatgttccattggcctcaggatacgaaggatacctcagctcaccacaaggccccaatcctacttggatctccacgatggtgttgccgaggtagccgcagaatgtgtcgcggaagctgcgcatgtagtcggagtagacctggatgggcgtcctgcccttgagcaccggcagcgtgtcgcagccgagcgagatgtactccggattccgacgacccgacctgtccgtgtacacgatgtccgggttcgacttcatctcctccaacacccatcccggcaacgggatattgcaggagtcgccgacgttgccgccgcactggtggaaggacatgaccatctggaggcggaggccggcgcgctccaccatgcggacgagctcgccgtagccctcccagtcgtaccgccggggcccctcccgctccaccaccccccaccacacgtccaccatcaccccctccaccccgccgctccgcagcgccgccaggctcgccgccagcgcccgcgcccgcgccaccttcccccccgcccccaccgtctccagcggcagcatcacgtacaccgccgtccccttcccccgccgctgcccctgcccgcccccgcccccgtggtgcagcagcgtcgccgcctccggtgacgccatctcctccatcgtcgcgtgctccaccggcgccgccctggcgagccgcagcctgccgccgctccccggcgccggcatggggacgacgcagcacggcggcgcgtcctcgcgcttggaggacgggtcgagcggcgacaggaacgacgtggatgaacgcagcgtcaacgccatggacttgatctcgagctcgagcttctccggagaggaagataattaagtagataagaggtgcttaacaactaaccaagattgattcgatcggagatgagccactgaattgaattaaattcacccagagaagctttgatttctttcttgcttggaaaga

SEQ ID NO: 3128 - DNA, 267 bp, Oryza sativa
  UNSURE (1)..(267): unsure at all n locations
  Clone ID: PAT_MRT4530_21046C.1
  unsure (1)..(267): unsure at all n locations
ccaccnctccggccccttcccttcccttcccctcttctctcctctactagctatagtataggccgcccccgtcgttttgttaattttcacgccgaaatttccacccacaccacgcgccgcctgcctacctgcgcctgcgcgagctgcagatcgatcgacgagaggccgcgtctcggtcgcggggggtggagttgatcgancgatcctggaggggtatgatgaggaggtttctgccggtggggggaggaggaggaggaggggcggagc

SEQ ID NO: 3129 - DNA, 3795 bp, Oryza sativa
  Clone ID: PAT_MRT4530_21231C.1
tttttttttttttttttttgggagggtggtctaccacgtaaactgatcctggaacaaaatgaacaacaattacaagcctcaacccttgacagttacaggcatcgcgccattgtacattctcaaaagctaacttctgtgagcgcccatcaaagctatgtctactacaaatatatttcaattacagggggagaacataattgaagtgggaaaatctactagtacatcatcatcatcaccaagcacacaacctagagttccaagaatggcatgtcatgaatcgaaaacagaaacgctagaaataacctattcagtagccctctgcaattgtcatgtagtgaagaaagaccatagctttttcccaattgattggttccgcctttcggagtcatcgtcctcctcatcatcctgttcagctccaagttcacttcctgatggtgtcataggcatcgcatctggtgctgcatctataccatccacaatatctaccccctctgcactagtgacctctacagggccatgtgtgtcaccagcttcagcctgcgagtactcgggtaattgagatgcatcatcagctgattgggaggcccctttgctcccagtggcaggttcctcagcctttgaggttccttctgtgtcatctgcggtagcctctactgtctgtttacttccctttttcgcagctttctttttgttggtttgggctgcagttgccgcatttgcaactgtggtgcgcctgaggttgtagcgtttttctcctggggcttgcgtaactgctgcagctgtttggcgcctcttgcggcgctgccctccaagtgaaacactttcagaatgagcttcactgtcctcatcttgctcactgattgtggctccagcaaagcgccgcttccgtgtaccacccacagtaactgaatctccctggccatcatccttttttacttctaaattctcaccaagtatttctttagcatcttcaactaccgcaagaacagaccgtgtccgttttacaccaccttttgctctacccttcctgttttgttggcgccgtccttgttttgatgtttcaggctccaaatctacaacgggaagcactgccgagtccttcccgttttggtcaacatccacaatagttgtgtccaccaccatgtccgtgttgccatcaaatgattgagttccatgaatatctacacaattatctgcaactccaagagaagactccatctggacgtcatctgctatatcttgcctttcagattcttcattctcaaatgccccactctcagatgggagatcctcagcatcaaatgagttataggctacctgatagacaggagttggctcataatcatcatcgctctgcgatgcttcctctagtcttgcaccaaagtctgtgttcttcactgcttgctgttcagatgattgctcagccttcttcctaggagaaaacttgaaaatccttgaacacttctgcaacaatgataaacggccacctgaattaacaagtgctccggtctcttgggctaaggtgtcaggattgggggaacgatcatccgcctcaacagcaagactaggatattctatatcagtgctatctttaagagctagggcatccaagccctcaaaaataataaccccgcaatttttgcacaccttgtacttttcaaatatatcgatgaggttattcctgtccctgttatatgcttctctacgctctttcagactcttgctgagagtgttcagactatcaatgtcccttctgatatctgccttgtcagtttccagtttttgcctatcctccacaagaacttccttttccttctgcagctgttttttctccaatagtatcttctgaatctttgattcattcaattcggctgcacgtttgagctcattttctacaaagtccatcttcctatttaactcattttccttctcttcaagttctctctctttgctcgcttgttttttctccatctccatctccaattcatgccgatggagctgcaaatttcgttgaagatcagcacgctctctctttagcaattcctcattttccaaacgctgatggtctatattatcgatcaaggatttttccttaagtgcgagattttccccctgctccttgtattttatgtccaactcatcctctctatcctttagccttttttcttcattgtcatgccacctttctagattcttcttttcattgttcagtttcttggcttcctcttccaagtgagttcttttttcatccagctgctcccactcttcttcaaatttctgacgctgcttcctcaaatcttcagtttcctcagaaagagagttgcttcgcattctgtattcatcaatctctttcttcagttgtgctgtaagcatgatgtgctcttgcctctcttcctctgtaagtttcaaattgttctgctcttgcaatattttctccttttcagcaaccactgtggctttcaaactctcaagctccaatttgtacatctcagcctgctttctttcattttcaatctgcagcttttgttccgataactgtttctcatcattttgtagtgattcctcccacttcttcagagcattcgattttgtatcaagatcattttgccattcttccaattttttcttactttcatttaatacttgttcttttttcgaaagcttctcctccgaagatctgacatctttttccctctgcaccaaatcagcttccttctgtaccaacattgcatcaaatgatttcttctcattctccagttgtaaatcaaaatctcgtcttttggattcaagcttcacattatgatcttcaagaagcttctgaagcccaactttttcccttgcactgactttttcttccctttcagctatttttttctctctttcttctaatttcctgttctttgattcagcttccttttcttgtaaatgtaattcagctagtcgtttgttaatgtcgtcctctttaattttgagtgtagctttagtatgctccagagctttttttgcttcctccaactcttcttgctttatcttgaaaagtttgtcattctcgtttgctctctcctctcgatcatttagggatctctgcaaatcaagaattctattctgactttccttaagctttttgtcccagtcacgtaatgaatcctcctgacgcttgatccggtcctcccctgccttcctctcattttcaaaatatagcttctccttctccagcctacgctgacgagcttctacctcctctaaatccctgtcagcctgtgttggcgtcccgtttgcctccgcaagcttcgcatctgcagcatgaagcttaccctcgatctccaaccttttttcctccaaactagcctcaagggattgagcatcagttatctttttctcagacataaacttaacctcggctatctctccacgaatttcacgcagtgccttttcgagatctgttacgcattgcttctcaacacccaatgctttccgcatgctttcctcccgcctttcgtattctgatatggcattcaaatgggcagcttgttcccgctttaaaatctcttctttctgtgtcagcgcttgattgatttcatcaagtttggctgtccactcttttttctcaatcaaaagcagccccatattgtactgatattcatgtaactcttgttccagttcggcgacccgcagagtagtccctttccccttgccaaggggcgccgacgcggcgggagcgccgccaccgctccgctggttcgccggagccggcgtcgaccacccggtccaccccttcccctgcggagtaaacat

SEQ ID NO: 3130 - DNA, 1644 bp, Oryza sativa
  Clone ID: PAT_MRT4530_21267C.1
aggaatcggggaagctgtcccttctcctcttctcctcctcggctgcggccacggcgacgacgacgacgacgaattcgagcgaggcgatcggcgatggaggcggtggcgatctgatccgctcttcccgtctcggcctcgcgctcctctccctccctcgcggtgtctcgggtaggaaatggcgatcatggtggatcctccaaatgggatgggtaaccaagggaagtattactactcgatgtggcaaactttgtttgagatagacactaagtatgtgccaatcaagcccatcgggcgaggagcttatgggattgtttgttcatccataaatcgtgagaccaacgagaaagtagcaataaagaagatacacaatgtttttgacaaccgtgttgatgcactaaggactttgcgggagctgaaacttctccggcatctccgccatgagaatgttattgctttgaaggatataatgatgccagtacacaggaggagttttaaagatgtgtacttagtttatgaactcatggatactgacctgcatcagataatcaagtcacctcagggtctttccaatgatcactgccaatattttctttttcagttgcttcgaggactgaaatatctccattcagcagagatactccacagagacctgaaacctggaaatctactggttaatgcaaactgtgatctcaagatatgtgattttggtcttgcacgcacaaacagtagtaaaggtcagtttatgactgagtatgttgtcacccgctggtatagagctcctgagttgctcctttgctgtgacaactatggcacttccattgatgtttggtctgttggttgcatcttcgctgagctacttggtcggaaacctattttcccaggaactgagtgcctaaatcagctcaagctcattgtcaatgttcttggcaccatgagcgagtctgacttggagttcattgacaacccaaaagctcgcagatatatcaaatccctcccctacactcccggtgtgcccctcgcgagtatgtatccgcatgcacaccctcttgccattgatcttttacagaagatgctcatatttgatcctaccaaaagaatcagtgtcaccgaggctcttgagcacccttacatgtcccctctgtatgatccaagtgcaaatcctcccgcgcaagtgcctatcgatctggacatagacgagaacatcagtgcagatatgatcagggaaatgatgtggcacgagatgctccactaccaccctgaagttgttgcagcaatgagtgcccgatgatcttcaactgtccccaggaactttgcaggctcacttttttttcttcttctaaaagcctacggcgattatcgcacctattaagtaaccaagacgtgcaagacttatttcatgtatatatgagcgaaataagaacgttgttgtatccatatagttcatgttatggaccattacttggtgtatgcatttcacatttccactggacagttatgttgttgtactagttcatgatgagaagtgctattaaagtgaattcagtaaaaaaaaaaaaaaaaaaaaatggattatgttataattttttgcggttactgcttctttagtggtgatctgctgcaaaaaaaaaaaaaaaaaaaaaaaaa

SEQ ID NO: 3131 - DNA, 423 bp, Oryza sativa
  Clone ID: PAT_MRT4530_21361C.1
atgcaaatgctgatgagtgtcttcgtcattatcattggttgctacactgctattgactggatcaccgacatcgtcatcttcatcataggagttagtacaatgcatcttaaaaggtgtcaaacagtaaagctttatatagctgcctcgctgacttttttatatagtcaaggcactgtttgggtttatcaagcaattgattggatacaatatcgttgctttttgccacccctccacagtcttcatatttggtaaaagtactcgggagaccatggcaaagatgattgaagcacttggctttggagtaatctggttcgagagaagattatcttttcgtctgttaaggtgcatctgtgcggtatttcacaccgcatatggtgcactctcagtacaatctgctctgatgccgcatagttaagccagccc

SEQ ID NO: 3132 - DNA, 2349 bp, Oryza sativa
  Clone ID: PAT_MRT4530_21504C.1
atggcgccgacgctggcgttcctcctcgtcctcctcctgctgctcgccggcggcggcggcggcggcgcgttcttggcggcggccgcgtcgacggacaccgttgtcccggggaaggggatggccgggaaccagacgctcgtctccaagaacgggcggttcgagctcgggttcttcaccccgggctccggcatccactacttcctcggcgtccggctgaggaacatggcggagtacagccccacgttctggatcggggacagggtcggcgtcatcgacctccccggcgtgtcgctcgaggtgttcggcgacaagctgtacatcaaggaggacggggtcagcctctggtggtccagcgtcgctgggaacggctcctcctcctcctcggacggcggcgccgtcgccgtcctcctcgacaccggcgacctggtggtgagggaccaagggaacccctccggcgtcctgtggcggagcttcgactaccccggcgactcgctgctccccggcggcaggctcgggctcgacgcggccaccgggacgaacgtctccctcacattcaaaggcttttcccacaatggcagcctccaggtcgacgcgagcaggaggaacgggttcgtgctcaccaccgatggcatcgacagccgcggcgccttcccggactggatggtgacctcccaagacaacggcagctcgctggtgctcaaccaccctgacgccccgaactccaccgagttcttgcagttcaatcttgggctgatcagcctgatgcggtggtcggattccaccgccggctgggtggctcgctggacgttcccctccgactgcaagtccggcgccttcttctgcggcgacttcggcgcctgcacggccggcggcggcggcggatgcgagtgcgtcgacgggttcacgccgtcgtacccggacgagtggcggctcggctacttcgtcaccggctgctcgaggtctctcccgctgagctgcgaggccaacggtcagaccgagcacgacgactccttcgccattcttgacaatctccgaggcctcccttacaatgctcaggatgaaccagtgaccactgatgaagattgcagagctgcttgcctgaacaaatgctactgtgttgcatactcgaatgaatctggatgcaagctgtggtaccacaacctgtacaatctgagctcagctgataaacctccatacagcaagatctatgtccgtttgggttccaagctcaagagcaacagggggttggccacaagatggattgtgctcttggttgttggatcattagctgtaacttcggtaatgttgggactggtgcttctatgcagatacaggagagacttgtttgcatccagtaagtttgaagtagaaggctctcttattgtctacacttatgcacagatcaggaaggctacggggaatttctctgataaacttggtgagggaggttttggaagtgttttcagggggacattgcctggatcaaccactgttgttgctgtgaagaatctgaaaggtgttgggcaagcagagaagcagttcagaacagaagtacagactgttggaatgattcgacacactaatcttgtccgtctcttgggattttgcgtcaacgggaatagaaggttgctggtttatgagtatatgtcaaatggatccttggatgctcacatcttttcagaaaaatctagtttgctgagttggcatgtccgataccaaattgcacttggtattgcaaggggtctagcctatctgcatgaagaatgtgaggactgcatcatacattgtgatattaaacctgaaaacatactacttgattatgaattttgccccaaaatctgtgattttggtatggcgaagcttcttggacgagaatttaactctgcattgaccaccgtccgagggacaatgggctatcttgcaccagagtggatatatgggcaacctattacaaaaaaggcagatgtttatagctttggcattgtgctttttgaaataatctcagggagaaggtctacggagacagtgaaatttgggagccatcgctattttcctacgtatgcagcggtacaaatgaatgaaggagatgttttgtgcttactagatagcaggctggaaggaaatgctaacgtgaaggagcttgacatcacctgtagagtggcctgttggtgcatccaggatgaagagaatgacagaccgtcgatggggcaagtcgttcgcatgttggaaggcgttgtcgatatggagatgccaccaattccagcttcatttcagaacctcatggagagtgaagacagtggtatatactctgaagaaagctggaatttcaggacccgagatcagttctag

SEQ ID NO: 3133 - DNA, 3194 bp, Oryza sativa
  Clone ID: PAT_MRT4530_21919C.1
cccactcgtccgcccacgcgtccgggcgcaccagaggcagagagacacgagcagcgaggaggagctcccacgtgagccgtggacggtggagaaggacgtccacctcctcaacaacttagccgcgcatggcggcgagttccaacgcgagccgtgggtggagaaggacgacgccgcgtcgtggacggtggagaaagacgacgtcccgctcgtcaacaacatcgtcgcgcacggcgatcccgagggcagttcgaactcgctcgcccgatcaggaggacatttggccaatgtccacgagggagccggcatgttttatcagcccaacttcaagtacattttctgtgatatggatggcacactgctggatagtagcggtctagttccagaaaccaacgctgaggccattagggtggccaggtcaagaggggtacaaacaatcattgcgacaggaaagtcccgccctgctgttattgaagttcttggcaaggttaatttagctggcacaggtggtatcgtttcagaatcgtctccaggagtatttcttcagggtttgttagtttacggcgaggggggccaaaagttatatcaacagaatttagatatagaagtgtgcagagaggcgcttctatactctctgaagcacagagttgccctggtggccttcagccaggacgactgctacacaacgcttgatgatcatcctctggtggactttttccatgttatgtaccacgaaccaaagaaaaatttgttacgatcttttgcgcacgaagcagcggtagcctttgcgctgagcaaagctccttgtggtggcgtgagtcccttgcagcagctccagcctcgagactacgagcacgacggcgcagataccttgtgtggggatcctgaccaccagggtcgagaggctagagcgcagggacagcagatcccgacgcatcaggttgtggagcatggcgtgcaggcccaaggtgacgtgcctcaagctctgtggcttggccccgccgatccgatagcaaagataatatcagatgttgaccattttctgagtaccattgacatacagaagtttgtgttcctagaaactcctgaagtgatctcttctgtgctgaggccacactgggcgaggagggttgatggaaaggcacaggtcgttcaggcacagggtgatgtgcttgaagttgtaccgctcgggacttccaaaggaaatggggtaaaaattctgttggaatcactttgtgctagtccagatgaggtcatggcactaggcgatggaaaaaacgataaagagatgctccaacttgccggccttggtgtcgccctctgcaacggctgtgaggtgacaaaggtggtagccgacgtcatcggcgcgagcaacgacgaaagcggcgtggcacaggccatttacaaatacctctagaaaatgattccacctagctggcttagcatttctactgtggtgtggtagggcctaatatatcttgcttgcagcatccatttgcaagcgtaccatatttaaacttcaataattgtacgtggaagttggaagtactattcgctggtggattaatatcatatttgctgcttacagctaagatatcacattttaaaataatagccaaaaaaatcaaaaaaagcaacaacgaaaacggggtggcccaggcccttttcaaatacctttagaaaatgattccccccagctggcttagcatttttactggggggggggagggcctaatatattttgcttgcagcatccatttgcaaggggcccatatttaaacttcaataattggacgtggaagttggaaggactattcgcggggggcccccgggcggcacgcccgcgcattcctctcgcttttgtctttttttttttttttttttttttttttgtttttttccatttattttttttttttttttttggggggaaaatccatataatataacccgaaaagcatgcggattaacataatttgatacagtgagacaacctaggatcacagaattaacagtacaaaaacagatacagttgctcggcaattacagcgagattcaagctcacatgttctcacatcaacagaccgcaataatttcgggccacaatgttctctccctaaaaactaggtaaaaacaagcagcagcttaccgtacaagtttgtcatgactgcttgtgaagtttgaagccaaaaacttttggaacatactgctgagatggcttttgtggcttcaagtgtggatatgtcatcaggaagagatgtgggaatgttgtcccaaagtacgctccgtcaatgttgccttggtacttggatcttggataatgtaaatcttcacattttggacagtatatcttcactgtgctagacctaggaatatctgattgccctgcaggaagacagggttggccacaacagtatacccgggggcatcttccaaagtcatagttcttgaacttctccaacattgcagccagacccttgctggttaagatatatcttgcatgaattaatccatacagcatctctgcagatgactcaattaattcattttgctcctcagtgaacacatcaccattagaagactcgatgtctaagataagatcaagtgcatagtcataatatggcacctgattgctcagaccacaaaggttgaaatcatcctgtatataatcatcatcgatctcacagaagaactcattgccgcgcaaactgcagaaccatgaaatccaagatgtgtcctctccctcagaaccactgacatctgaatcttcactgtcagtttcaaattcttctgcaccatcggagaccttcccggccttgccgagcggcgcgggcagcttcccccctgcggcggcgaggcggtccctctccttggccaccgccgcccccctggatgtggacggggacgacctgtccaggtgcttctcgagcacgtccttgatgcgcttccggtccatctccgccgccgcgccgccgaacccccgatccctgtacgcgccgctcataccctacctacggcggcgcgcccctgccacagcctccgctctctcgcaaccccctgagggcgagccggcgagggcggcgctcgcgggcggggctagggtttggcgcaggatcgaggtgaagagatcggagtggtgacgaggcggggaagaggaggacagcgagagcgagagagggagcccgtgtgcgtgcgtg

SEQ ID NO: 3134 - DNA, 2542 bp, Oryza sativa
  Clone ID: PAT_MRT4530_21965C.1
tttgcccttccccccccttgctactactagttgcttgcctcttcccacctcacctcgcattgcaatctcgcatcgcctcttccttctcttcttccccttcttctccccttctcatccaacctcgcttcccaaccctggatccaaatcccaacctatcccaaagccgaaaccgaggagaggaaaaaggttacgcgcaattattactagctatagctaggtaggtttgggggaggcgagatcatgaagcgcgagtaccaagaagccggcgggagcagcggcggcgggagcagcgccgatatggggtcgtgcaaggacaaggtgatggcgggggcggcgggggaggaggaggacgtcgacgagctgctggcggcgctcgggtacaaggtgcggtcgtccgacatggccgacgtcgcgcagaagctggagcagctggagatggccatggggatgggcggcgtgagcgcccccggcgccgcggatgacgggttcgtgtcgcacctggccacggacaccgtgcactacaacccctcggacctctcctcctgggtcgagagcatgctttccgagctcaacgcgccgctgccccctatcccgccagcgccgccggctgcccgccatgcttccacctcgtccactgtcaccggcggcggtggtagcggcttctttgaactcccagccgctgccgactcgtcgagtagcacctacgccctcaggccgatctccttaccggtggtggcgacggctgacccgtcggctgctgactcggcgagggacaccaagcggatgcgcactggcggcggcagcacgtcgtcgtcctcatcgtcgtcttcctctctgggcggtggggcctcgcggggctctgtggtggaggctgctccgccggcgacgcaaggggccgcggcggcgaatgcgcccgccgtgccggttgtggtggttgacacgcaggaggctgggatccggctggtgcacgcgttgctggcgtgcgcggaggccgtgcagcaggagaacttcgcggccgcggaggcgctggtcaagcagatccccacgctggccgcgtcccagggcggcgccatgcgcaaggtcgctgcctacttcggcgaggccctcgcccgccgcgtgtaccgcttccgccccgcggacagcaccctcctcgacgccgccttcgccgaccttctgcacgcccacttctacgagtcctgcccctacctcaagttcgcccacttcaccgcaaatcaagccatcctcgaggctttcgccggctgccaccgcgtccacgtcgtcgacttcggcatcaagcaggggatgcaatggccagctctcctccaggccctcgcccttcgtcccggcggccccccatcgttccgcctcaccggcgtcggccccccgcagccggacgagaccgacgccttgcagcaggtgggttggaagcttgcccagttcgcgcacaccattcgcgtcgacttccagtaccggggactcgtcgccgccactctcgcggacttggagccgttcatgctgcagccggagggcgaggcggacgcgaacgaggagcctgaggtgatcgccgtcaactcggtgttcgagctgcaccggctgctcgcgcagcccggcgcgctggagaaggtcctgggcacggtgcacgcggtgcggccaaggatcgtcaccgtggtagagcaggaggccaaccacaactccggctcattcctcgaccggttcaccgagtcgctgcactactactccaccatgttcgattccctcgagggcggcagctccggccaggccgagctctctccgccggctgccgggggcggcggtggcacggaccaggtcatgtccgaggtgtacctcggccggcagatctgcaacgtcgtggcgtgcgagggcgcggagcgcacggagcgccacgagacgctggggcagtggcgcaaccgcctcggccgcgccggcttcgagcccgtgcacctgggctccaatgcctacaaacaggcgagcacgctcctcgcgcttttcgccggcggcgacggctaccgggtggaggagaaggagggctgcctcacgctgggctggcacacgcgcccgctcatcgccacctcggcatggcgcgtcgccgcggcgtgatcgcaaagtttttgggacgctgcaccacgtgtttgccgccgatcacggcgcgacccccccccccccccctctctctctccccggctcaccggcggcacaattgaagcttgacgtcaacgaacgctcaattgcagcgaccgatcgggcttacggttctcgccggcgtgaagagatcgacgactggactccgaccagaccgacggcttgttcgttctcctttcccaattaccccgttccttggtcctcctagcccatctattatgtttaaatgtcaattattatgtgtaatttctccaatcgctcatattaaataaggacgaaccgaactggatttcattagctccaatgagaattttgtatacaaggcaccgatctaaaaattgagctatatgttcatgagtttaaaaaaaaaaaaaccccaccc

SEQ ID NO: 3135 - DNA, 1566 bp, Oryza sativa
  Clone ID: PAT_MRT4530_22107C.1
atggcgacagccgggaaggtgatcaagtgcaaagcggcggtggcatgggaggccgggaagccgctgtcgatcgaggaggtggaggttgcgccgccgcaggccatggaggtccgcgtcaagatcctctacaccgccctctgccacaccgacgtctacttctgggaggccaaggggcaaacacctgttttccctaggatcttgggccatgaagctggaggcattgtggagagtgtgggagagggtgtgaccgaactcgcgccgggcgaccatgtcctcccggtgttcaccggcgagtgcaaggagtgtgatcactgcaaatcggaggagagcaacatgtgtgacctcctcaggatcaacgtcgaccgcggcgtcatgatcggcgacggcaagtcccgattcaccatcaaggggaagcccatcttccactttgttggcacatccaccttcagcgagtacaccgtcatccatgtcggctgcctcgcgaagatcaacccggaggcgcctctcgacaaggtctgcattctcagctgcggtttctctaccggttttggtgcaacagtgaatgtcgcgaaaccgaaaaagggccagaccgtggctattttcggtcttggagctgttggtcttgctgctatggaaggtgccaggctgtctggagcatcgaggatcattggtgtggacctgaaccctgcgaaattcgaacaagctaagaagtttggctgcactgacttcgtaaaccccaaggaccacagcaagccagtgcacgagggatggggcgttgcggtgctggtcggcgtgccgaccaaggatgatgtgttcaagacccacccgatgaacttcctcaacgagaagacgctcaaggggacgttcttcggtaactacaagccgcgcaccgacctgcccaacgtcgtcgagctgtacatgaagaaggagctggagctggagaagttcatcacgcacagcgtgccgttctcggagatcaacacggcgttcgatctcatgctcaagggggagagtctccgctgcgtcatgaggatggactgagtaaaaataatgatgatctatctctctctctctctctcggacagtttcagtgcatccaagaacccaaaaatgaaagcaaaaaatggatgagaagtttgaggttttccatttaagtttaataatggtcgtgagacagggcttgtgtggagtcagctctgtttactcccccctttcatggcttgatcttgtttattgtcagcattgtggcttagcaaattttcaccagttttaccctgtaaattagtaccattctgaaatcgtaataaactactagcagtgtgaggtactattgctggaacaaaaatgattgtgcagtccacccaagccaaaatccctcctccaaagaatctcactcactcactcaaatctcacagatcaaatcaaaaacggtgaggaggctagatgaaccatccccgtctatatatagctcctcctcctcgaaggaagaaaggagaggatggaggatggagggtgaggtttcgccacttccttcttcctgtcctcttgggtaagccaaccccggac

SEQ ID NO: 3136 - DNA, 2331 bp, Oryza sativa
  Clone ID: PAT_MRT4530_2230C.1
cgaccagatcgcgacaccgccaccgccgatccgaaggtcggcgacgacgaccaccaccgccgccgccctcgtcctcgccgccggcggccatggcgttcggcgaccgcatcaccaccttcgaggactccgagaaggagagcgagtacggctacgtccgcaaggtctctggacctgtggttgtggctgatggaatgggaggtgctgccatgtatgaactcgtccgtgttgggcacgataatcttattggagaaattattcgtcttgagggggattcagctacaattcaagtttatgaggaaactgctggactgatggttaacgaccctgttttgagaacacgaaaggttatgcctgcacagcccctgtcggttgagttgggacctggtattcttgggaacatttttgatgggatccagcgccctctgaaaactattgctattaaatctggagatgtgtacattccgcgtggtgtctcagttcctgcccttgacaaagatgctttgtggcattttaagccagaaaaactaggtgttggagatattatcacgggtggagatctatatgctattgtcaatgaaaatactttgatgcaacacaaggttgctcttccacctggcgctatggggaaaataagttacatcgccccagctggtcaatatagcctgcaggatacagtgctagaattggaatttcagggtatcaaaaaggaatttaccatgctccagacatggcctgtgcgttcaccaaggcctgttatggaaaaacttgctgcagatacacctcttcttacaggacagcgtgtacttgatgcattgttcccctcagttcttggaggaacatgtgccattcctggagcttttggttgtggaaagactgtcattagtcaggcactttccaagtattccaactcccaagctgtggtttatgtcggatgtggcgaaagaggaaatgagatggctgaggttctcatggactttccccaattgacaatgacgacagaggatggacgtgaagagtctgtgatgaagagaacaacactggtggctaacacatccaacatgcctgtcgctgctcgtgaagcttccatttatacaggaattacgatagctgagtattaccgtgacatgggttacaatgtcagcatgatggctgattccacctcacgatgggctgaggcattgcgtgaaatttctgggcgtttggctgaaatgcctgcagatagtggttaccctgcttatttggctgcaagactggcatctttctatgaacgtgctggtaaagtaaggtgtcttggaagtccaaaacgggacggaagtgttacaattgtaggggctgtctctccacctggtggtgatttttcagatcctgttacctctgcaacccttagtattgttcaggtcttctggggattagataaaaagcttgcccagaggaagcatttcccatcagtgaattggctcatatcttattcgaaatattctaagattccaactgcgcttgagccgcactatgagagggaagatccagatttcattgatattagaacaaaggcacgtgaggtgttgcagagggaagatgatttaaatgaaatagtgcagcttgttggtaaagacgcactggcagaatctgacaagattacactggagacagcaaaacttctgagagaagattatttggcacaaaatgcattcaccccatatgataagtattgcccattctacaaatctgtttggatgatgcgcaacattattcatttcaacacattggcaacccaggcggtggagcgggcagctggtgctgatggacagaagattacatacagtgtcataaagcatcgcatgggcgatctattctaccgcctagtgtcgcaaaaattcgaggatcccgcagagggcaaagaagttttgattgcgaaatttcagaagctgtacgatgaccttaccgccgggttccgcaatctagaagacgaagcacggtgaataattattgtagattctgtgtaaacaataaggatatatcaccaaatgttctataaaaaaaacatggaagcattccatttgctgctaccgaggctctaggtcgagatcatgtagaaattttcctgcaactatacgcgccgtcgtcgttttgtcaggttttgatcccaagtgctcgatggacacgccattatttctactctatgtatcatttatttatcatcttcattcacatcattgtaataaacatgggcatgtttatagtcgaataaatacgatgtccatctgtttaaaagtcaacgttgaaggtcaaaaaaacaaaaaaaaagaaacaacccctaaaaatacgaataaa

SEQ ID NO: 3137 - DNA, 1506 bp, Oryza sativa
  Clone ID: PAT_MRT4530_22368C.1
ggaacgcatacaagtacacggcacatcaaattatttattatggaggaatgccacagggtatccatcagaattttttttccgccgggccagcagcaaagaaatgccccgaccgaatttatccatcagaattttctcatttatatttcaggaagatgtcaatgcatcacagccgatggtccaaacgttccatcctagttagctaactgtatatattgacctatccgatattcccaacccatgactggagcaagcaagcagttcaactcagctaagcacgaagagggaggagctctcaagccagtatgctacctccctcttcgtgattcggggaatcagttccactatagaaggaggcctcacttgaggcgtccgaaccgccaccattagcctccttgtcagcggatacatgtgaatggtcctgaggcagggtgatgccgtttgatttgaatgaagaacccatcttaatgtcatcggctctcatacgctcagcatagctattgtattcgaaggtagctggattccttcctccgaatgctgagtcgagcttgtccaagtcaaagacgtcagccattatcttctggctctctttatcgctggagtacacaaatttcaccttcttgtaggtctcatggtccaaaaatggcttcactatctcaacattagggaggtaccaaaacaatacactagcaagtgtggttgaacggtaaaaatccttccagaaggactcaaatatcctaggaggattgtaaaggattgctaacccaagcctctcagggtaacagtcttgcaagacgttcacagtctctcgggtcactttcagcggtgtgctccccaatgtccaactctggaagtctgtcagccagaccatcttctcttgatcttccgtcaggctcataattgctttctccagacagtaaacaagatatttgatctgtccctttcctgaagtagtgttctctaagcctggcctcaggacaagaacagttcttccatgtttgtccttgtagtcagccctatatatctttcctgtctctgcttcatgtgcaacatcatcccagttaatcttttgtggcatatatgacacccgccactttacagctgacttcatcattttacttgctttctgcacgttccagtttcttgctcgaagaaatctcaggcacgaggcatctgaaaggaaatcttgtatttcttctgatgagtgttcaccaagctccttacgcaagtcatttatcttctcctgctgctcttctagggtcaagtttttctctgttgtagcaccattgcttgacttgaatagaaaggacattttagtacctcgacagagaagggtccactagatacggaactggatcgatgcacccccagcccccaacaaccggggaggctcgcggatcagggcccgccgcctgggcacgacggcgagggctggggtggggaggtggcgccggccgaggtgggagagtggtggtggtgggggtggggtgggcgtggggggggcgtgcc

SEQ ID NO: 3138 - DNA, 1732 bp, Oryza sativa
  Clone ID: PAT_MRT4530_22543C.1
caacgagtcaaatttgaaggcttcactgagcctttgacaatggcgccgcagctgccgctcgaggtggcctctgctcccaagctcgacgacgacggccacccacaacgcaccgggaatctatggacgtgcgtagcgcacattatcaccgcggtgatcgggtgcggcgtgctggcgctgtcgtggagcgtcgcgcagctcggctgggtggccggccccatcgccatggtgtgcttcgccttcgtcacctacatctcggccttcctgctgtcgcactgctacaggtctcctggctcggagaagatgcagaggaactactcctacatggacgccgtcagagttcacttagggaggaagcacacttggttatgtgggttgctgcagtacctgaacttgtacgggataggaattgcttacacaatcactacggcaacttgtatgagggcaattaagagggcgaactgctaccacagcgaaggccgtgacgctccctgcgactcgaacggtgaacacttctacatgctgctcttcggagcagcccagctgctgctgtccttcatacccaatttccacaagatggcgtggctgtccgtcgtcgcggcgatcatgtccttcgcctactccaccatcggcctcggcctcggcctcgccaagaccattggtgatggaactgtcaaagggaacattgccggtgttgcgatggccaccccaatgcagaaagtttggcgagtggctcaagcaattggcgacatcgcattcgcctacccgtacaccatcgttctcctggagatacaggacacgctgagatcgccaccgccggagagcgagacgatgcagaagggcaacgtgatcgcggtcctcgccaccaccttcttctacctctgcgtcggctgcttcggctactccgccttcggcaacgccgcgccgggcaacctcctcaccggcttcggcttctacgagccctactggctcatagacttcgccaatgcctgcatcgtgctccacctcctcggcggctaccagatgtttagccagcagatattcacgttcgccgaccggtgcttcgcggcgagcttcccgaacagcgcgttcgtgaacaggtcgtactccgtcaagatcctcccgtggcggcgcggcggcggcggcggcggcgcggggaggtacgaggtgaacctgcagcgggtgtgcttcaggacggtgtacgtggcgagcacgacggggctggcgctggtgttcccctacttcaacgaggtgctgggcgtgctcggcgcgctcgtgttctggccgctcgccatctacctccccgtcgagatgtactgcgtgcagcggcggatctcgccgtggacgccgcggtgggccgcgctgcaggcgttcagcgtcgtctgcttcgtcgtcggcacgttcgcgttcgtcggctcggtggaaggcgtcatcagaaagaggcttggctagctagctagctagtagcgagtaatttagcctggtcatcgagaacgaaatgtaaagctagctcagtgtgccatttcatctgaagtaaaaaggcgcggtgaactgtacaatacatatgcagaaaaaatgataaacataagatgttggttattttcagtgcctttcctcctgtgctgcagagaaactgctcctatatatgtacagaatgtcgtcatattattgccatgatacttggaacggtgaaaggaacctgctcttgaatgatgtataaaaaaaaaaaaaaaaa

SEQ ID NO: 3139 - DNA, 1966 bp, Oryza sativa
  UNSURE (1)..(1966): unsure at all n locations
  Clone ID: PAT_MRT4530_22702C.1
  unsure (1)..(1966): unsure at all n locations
atgggaagctccgtcaaggacgccggcggcggcaaggaggagcagcagcagcagctggagagcccgctgctggaggcggcggtgtcgtcgggcggcggcgatggcgggggagggcacggggtgagcggggagctggagagcatcctgggcgacgagacggtgccgtgggcgcggcggatgtgggcggcgacgggggtggagatgcggctgatgctgcggttggcggcgccggccgtgctggtgtacatgatcaactacctcatgtccatgtccacgcagatcttctccggccacctcggcacgctcgagctcgccgccgcctccctcggcaacaccggcatccaggtcttcgcctacggcctcatggtgtttagctggctgctggcatggcatgcaatgcatgggctgctggctaatgggagctacgttgtgcaaatgcagctagggatggggagcgcggtggagacgctgtgcgggcaggcgtacggcgcgcacaagtacgacatgctcggcgtctatctgcagcgatccaccgtgctgctgatggccaccggcgtcccgctcgccgtcatctacgccttctcccgccccatccttgtcctcctcggcgagtccccggagatcgccagcgccgccgccgtcttcgtctacggcctcgtcccgcagatcttcgcctacgccgccaacttccccatccagaagttcatgcaggcgcagagcatcatggcacccagcgcctacatctccgccgccacgctcgccttccacctcgtcctcagctacctcgtcgtctaccagttcggtcttggccttcttggcgcctcgctaatgctcagcatcagctggtgggtcatcgtcgtcgcgcagttcatctacatcgtcaccagccgccggtgcaggctcacttggaccggcttctccatgctggccttctccggcttgcccgacttcttcaagctgtccctcgcctccgccgtcatgctctgcctcgagacctggtacttccagatcctcgtcctcatcgccggcctcctcaaggaccctgagatggcacttgcctcgctctctgtctgcatgacaatttctggatgggtgttcatgatctcagtcggattcaacgcagcagccagcgtgagggtgagcaatgagctcggtgctgggaaccccaagtcggcggcattctcggtggtggtggtgacggtgctgtcgttctttctgtcggtggtaatctcgcttgtcatcctgctgtgccgggactacatcagctacatcttcaccgacggcgaggacgtggcgacggcggtgtccaagctcacgccgctgctggcgctcaccctcatcctcaacggcatccagcccgtcctgtcaggtgtggccgtgggctgcggatggcaagcgttcgtggcctacgtcaacgtaggctgctactacatcgtcggtatccccctcggctgcctcctcggcttctacttcgacctcggcgctgcgggtatttggagcggtatgataggaggtacactgatgcagaccttgatccttatgtgggtcaccttcaggaccaactggaacagagaggtggaagaagccatgaaaaggttgaacaagtgggaagataagacacctctgttgtcagaataagaacaaaacaaaagaaaaggctattgtggttattacactgagagcctacatgcctagaagaaatgggattatgtgggaagttcataaaaggagatttttcatcgtggaattcatcattgagccacaatgctctgttacttctcgtttctactagcgtactagtattatttcgtttttgatgatcctgttttacagttatgatgatggagataatttgatcatttattgaactacacgtgaattattggttatttctcataagcttaaatttttgggggtgaaaaaaaaaaaaaaaaaaaaaaanaaaaataaaaaaaaaaaaacacac

SEQ ID NO: 3140 - DNA, 3752 bp, Oryza sativa
  Clone ID: PAT_MRT4530_23251C.1
tttttgtgtgtgtgtttttgacgagcaacctaggcggattttgattttgcgccaaagaaaattcaacatttatatatgtacatacacagctcttactgcgacgcgacgggaaaaacaaacagggagacgaagaaagctgcgaaaaaagaaagaagaaaagatctactcctataggtacataacaacttcgactgatcaacctacagctggaaaattcttatcttgtagcaccatcagaagcgattgctaagcttgtgtggagagttcaaaatggcatccatctgattctgaatgactgttgtttctacgggcatttcgccgccgactggcctcgttggtggcactcaccgccggctgtttctcctgtgtgtcggtggttgttgtttctaatccttctcctccttggcttccctgaggggcatgtcaaggaccccatagcctccctcatcgatcgagcccgctgccgccgacgaggtcttcgagtcgaccgtcgacccagcttggatctccttgaacattgccatcaccttcagcatcgtcggccgcctcgacggccggtcatccaagcacgcacaggcgattttcaaatgctccagcagctcaagctcgacggatggatcctccttgagtagctcagggtcgaagacatccgtgatcttcaatttggtgtgctgcttgacccaccccacaaggttattgtcctcgccaaagtctgccgagtccgtcggcggtttcccggtgagcagctccagcaacacaacaccatagctataaacatcacccttggtggtgcatctgaagctctggtagtactccggtggtacataccctggcgttccagcaagagtggacacgctaaggtgtgtatccaccacgctcatcagcctcgccataccgaaatcagatacccttgcttccagttgttcatcgataagcacattgctcgacttcatgtctcggtgaatgatgtgaggaatgcaattgtggtggaggaatgccaaaccccttgctgctccaacagcgattttccgtcttgcctcccaattcagctttttaccgatctttttgcggtcatgcaacacatcctccaagctgccaaacttcatgtaatcatacaccaacaaccgctcctcaccagccttgcaatagccaagaagtggaacaaggttacggtgtttgatcttgccaatggtctccatttctgcagtgaactcccggtcaccctgcccgctcacatgtattagcttcttgattgcaacaaccttcccatccttgagctgtgccttgtagacatcaccaaacccaccagacccaatttggcatgcgatgtggaagccatttgtggcctcaacaagatcagccagggtgagattctgcaatggcttctcgaatgcagccaggttgatgctaagaagatttgtaccggagagattttgcctccaatcagaattcatagttgcagaatgtgacctgctatcaatatatatatcacgagaggtactcgcctcctcattcttcagcctccgccgcttgctcccaatggctatgatgatcacaattatacagaacagtgagaataacagtcccatagcgatactgcttgccatcgatgcctgcctccggtgggattggtggtcattggaagatcttggggaactatggtcacatggtggcagtgggaagccacataaaccagtgttattctcatactggctcttcggaaatgtggcaagggaaccaagctctggaattgttccattcagctgattatttgacagattgatctccgacaaggaaagtgccgagaaagagttgggtattggcccttccaactggttatacgacaggtcaagcaccgcaagcttcttggcctctgctagccgcgatgggatggtacctgacagtaggttgtgcccaagattcatgatcatgaggtagaacatgtcccccagctcgccaggaatcgccgagtccagctgattatatgacaaatcgagaaatatcatcgaaccattcttgttgaaggtgtactccgtgctccccacatacattcttgtgaagttgcacagcttcttgctcggcatccgactgaggtcatcaggtcggatgctggtaaactccagcaagctccccttgccacggcactcgctgctcagctcgtcgttgcgaagataaacgtaaggccgtccaactatgaggccaacattcatcttcccagactgtttggccagctctttgggtattgatccattcagctgattgctattcaggtccagccacaccaagctctggcagtcaccgagctctggcggtataggccccgagaaggaattgttgctgagcttcaagatagccaagtagctgagcttcccaagccatgaagggattggcccggacagccggttgctcgccaaagaaatccagttcagcttggtgcacttggctagctccggcgggatgctacccgtgagcccgttgtagtcgaggatgagatgctcgaggccctgaatgcgcgacagggacgccggtatctcgccctccagctcgttctgccacaggatgaggtcctgcaggttgccaaggtcgccgagggatgccgggatggacccattgatgtagttgaggctgaggtcgagggagacgaggctggtgcagttggagacggcgtctgggatgccgccggtgaggtagttgttctgaaggtacagcagatggagcttggagttgggatcttggcagagggacgacgggatggtgccggagaaggtgttggagctgaggtcgagctgctggagctccggcagcgaggctacggtgtccgggatggagccgttgaagtggttgaaggagagggagagcgccgtaagctgctgcagctttgcgaaagcctcgccggggagctcgccggagaagttgttgttggagaggttgagggcgttgagcgacgtgaggccggcgatgtccggagggaacacgccggcgaggtggttgaaggagaggttgagcactttcagaccgcggcagtcggaaagtgccccgccgggcacctcaccgacgatgaggttgccggagaggtcaaggtactgaagcccggagcagttggtgaactccgggacaccggagatcctgttcagggcaaggtccaaccaccgtactgccccgactccggcatccaccatccaccggaggtcgctatcgtcggtgatcttgttgttggacaaatcaagcgagtccagcccggcaaagcccgggccaccaccgccaccgaccttcgccgcaccaaccgcatcgccggagagattcagcgtcttgaggccgccgcaggcgctggccagggccgccacgtcggcgacggagccccggagcgcggcattcccggacaaatcgagcgcctgcagcttgctcccgcacctcgcgccgccagccgccgagagcgcgccgctgacgttggcgccgcggaggctcagcacctcgacgctgccgagctgcagcagggtggccgcgacggcgcggaactcggcattgagcggcacgccggcgagcgacagcgacgtgagcctcccgttccggcacccggcccccgggaacctgcacgcgccgtcgccgccgctccaccccttgagcgccgcctggttcggcaccgcctgcctgaactcctcgagcagctgggcgtcgtcggccgccgccgcccccctcaccaccaccgccgccgccacaaacagtgccgctatcgctgcccacaaggaatccat

SEQ ID NO: 3141 - DNA, 1047 bp, Oryza sativa
  Clone ID: PAT_MRT4530_23285C.1
tggcacggcgcgcggcttcttccctggatccaaatcgaaaatttctctccccctgttcacaccacgcctcactcccatggcgaccgaggaggacgcgtcgaccatggcggcggccgaggcggaccccaagcccgccgccaccccgtcttacccggagatgatactggcggcgatcgaggcgctggacgacaggaacgggtcgaacaagacggcgatctcgcagcacatcgaggggaagtacgaggggctcctcccccccgcgcacccgtcgctcctcacagcgcacctcgcccgcatgaagcagaccggcgagctcgccttctccaagaacaactacttccgcggcgacgacccgtccctcccgcccaagcgcggccgcgggcaggccgcccaagcccaaggacgccgccgccgccgccgcccgcaccggcgcccgcgcccgcggcgccggcggcctcctcgccgcgcccccgtggccgcccgcctaagcccaaggaccccctcgccgaggcggtcgcgaaggccaccagtggcatgccccgcgcgcgcggccgcccgcccaagaaggccaaggtcgaacaggaagaccccattggcgctcccgccgcagcttcggctcccgccgcggcggctgaggccgcgccgcctgtcaagcgcggccgtgggcgcccgcccaaggtgagacccgccgcgccggtcggggagccagccgctgcttgattagctccgattctccgcatcgccgcgatggcgacgatggtaagctcctttaggttgtaacgtagtcttcagattatgtctcgtactgattggaggcgcggctcgggttgctgcttattgtaagttaatcggatggtgggaggtttaggtgtgctggatggatcatccgttgctgagagttgtgattgaattcgtgttatcgcgtgctgattattatggtaatgttggtgactttcgtgtcgtttgtgttaattctagattggtggctgcatttagtgttaaaaaaaaaaaaaaaaaaaaaaaaaaaaaaaagggggggcctcgtgc

SEQ ID NO: 3142 - DNA, 990 bp, Oryza sativa
  Clone ID: PAT_MRT4530_23712C.1
atggatcccggggcgggaggccccctgacggagagcgagaaggccgacctggacgccatcgccgccatcaaggagtcggcggcggcagagtacaaggagaagggcaaccggctcgtcaagatgggccggagccactacgccgacgccgtcgactgctacaccaaggccattgcccagatggagccgctgccgccgccgccggtgccatcccccgacgcctccgtcctcttcgccaaccgcgcccacgtcaacctcctcctcggcaaccaccgccgcgccctcgacgacgccgcccgtgccgtccagctctctccctccaacgtcaaggcgtactaccgggcggcgaaagcggcgattgctctcggcttgctgccggaggcggcggccttctgccggcgggggatcgagcaggaccctgctaatgaggagctcaagaaattgctcgcacaagtggacgcccaacagagtgagcaagatcgtcatagggccaaggttgcgcaggccgtgtccgctgcgaaggatattgttgccgctatagagaagagggggttgaagcttgggaaggcagcatatcaagagcttaccggtgtaaagaagccgaagttggatgagcagggtgtgcttcactggccagttcttctgctctacccggaggctggcgttggcacagttctgtccaaaagtgaaatattgaaaattcttttggaaggcactatggactcaaagtcacttcctgaaagcctgcttgatgaggaagatggagaaaatgatgatggcaagagcagcacaattacatcatcagataagggttctgtgaagtggatcaatgtaaaagagggaaaaactcttcaagaagtgctgcagcataaagacttcatcatccctgcaattcctggtctgcactatctcctccttggatacagctacaagcacgcatcatgcatgcagattggagtgccaagaactcaaacctgtgccacggtgatctga

SEQ ID NO: 3143 - DNA, 3534 bp, Oryza sativa
  Clone ID: PAT_MRT4530_23714C.1
tggacgcgtgggcggacgcgtgggcggacgcgtgggcggacgcgtgggctctcgccgtcgcagatccgatccaggaagagctcgccgccgccgctgccatggcgctctccgtggagaagacctcgtcggggagggagtacaaggtgaaggacctctcccaggcggacttcggccgcctcgagatcgagctcgccgaggtcgagatgccggggctcatggcgtgccgcgccgagttcggcccctcccagccgttcaagggcgcccggatctccgggtccctccacatgaccatccagaccgccgtcctcatcgagaccctcaccgcccttggcgccgaggtccgctggtgctcctgcaacatcttctccacgcaggaccacgccgccgccgccatcggcagggactccgccgccgtgttcgcctggaagggggagaccttcgaggagtactggtggtgcaccgagcgctgcctcgactggggcgtcggcggcggccccgacctcatcgtcgacgacggcggcgacgccacgctgctcatccacgagggcgtcaaggccgaggaggagttcgagaagtcaggcaaggtccccgacccggagtccaccgacaacgccgagttcaagatcgtgctcaccatcatccgcgacggcctcaagtccgaccccagcaagtaccgcaagatgaaggagaggctcgtcggagtctccgaggagaccaccaccggtgtcaagaggctctaccagatgcaggagaccggcgccctcctcttccccgccatcaacgtcaacgactccgtcaccaagagcaagtttgacaacctgtatggttgccgccactctctccctgatggtctcatgagggctaccgatgttatgatcgctggcaaggttgccgtggtctgcggttatggtgatgttggcaagggctgtgctgctgctctcaagcaggctggtgcccgtgtcattgttactgagattgaccccatctgtgccctccaggcccttatggagggtctccaggtcctcaccttggaggatgttgtctcggaggctgacatctttgtgaccaccactggcaacaaggacatcataatggttgaccacatgaggaagatgaagaacaatgccatcgtttgcaacattggtcactttgacaatgagattgacatgctcggccttgagacctaccctggtgtcaagcgcatcaccatcaagcctcagaccgaccgctgggtcttccctgagaccaacactggcatcattgtccttgctgagggtcgtctcatgaaccttgggtgcgctactggccaccccagttttgtcatgtcctgctcattcactaaccaggtcattgctcagcttgagctgtggaaggagaagagcactggcaagtacgagaagaaggtgtacgttcttcccaagcacctcgacgagaaggtggccgccctccacttgggcaagcttggtgccaggctgaccaagctctccaagtcgcaggctgactacatcagcgttccagttgagggtccctacaagcccgcgcactaccggtactaggctgcccagcacgactagcggctgtggcatgagaagtgtcaacttgaagttcgccatgacgactctggagtatcctgctttgttttcatcatcttatatgccgtcacttaggaggatttgttgtggggtttatggtttgagactggtgaaggggaggaatgggaagccgtttgcttttgcccagaaataatggcgtaattgggtggagttggggaggtgtgctttggcagatacagttttgtcttgttgactctacttatctgatatcatttgcaagcgttttgataaaaatcatgcgtcatttatgaataatattcttgcctttaaagataaaaaaaaaaaaaaaaaaaaaaaaaaaaacaataacaccggtctaccacgtgccgctagtctcatcccgcggcgcggcgctgggcgggggagaagaccagagcggcgaggaaggaggcggcgcccagcggggagagcgagcggctcgacgccgacggccatggcgctgctgatggatcccggggcgggaggccccctgacggagagcgagaaggccgacctggacgccatcgccgccatcaaggagtcggcggcggcagagtacaaggagaagggcaaccggctcgtcaagatgggccggagccactacgccgacgccgtcgactgctacaccaaggccattgcccagatggagccgctgccgccgccgccggtgccatcccccgacgcctccgtcctcttcgccaaccgcgcccacgtcaacctcctcctcggcaaccaccgccgcgccctcgacgacgccgcccgtgccgtccagctctctccctccaacgtcaaggcgtactaccgggcggcgaaagcggcgattgctctcggcttgctgccggaggcggcggccttctgccggcgggggatcgagcaggaccctgctaatgaggagctcaagaaattgctcgcacaagtggacgcccaacagagtgagcaagatcgtcatagggccaaggttgcgcaggccgtgtccgctgcgaaggatattgttgccgctatagagaagagggggttgaagcttgggaaggcagcatatcaagagcttaccggtgtaaagaagccgaagttggatgagcagggtgtgcttcactggccagttcttctgctctacccggaggtcatgtcgagtgacttcatcgaggattttccggagacagatactttcgtgccccaccttgatgtcatgttctcagaaagttctccaccattaccatgggatgataaacacgcttacacacgggatgctgttgagttatattatcaggctggcgttggcacagttctgtccaaaagtgaaatattgaaaattcttttggaaggcactatggactcaaagtcacttcctgaaagcctgcttgatgaggaagatggagaaaatgatgatggcaagagcagcacaattacatcatcagataagggttctgtgaagtggatcaatgtaaaagagggaaaaactcttcaagaagtgctgcagcataaagacttcatcatccctgcaattcctgtgttctttgttgtttcaagaaaatccaccttttacagaaagttcaaggcaggaaactggtctttgccgtaatgcttagcgtgattcagtttggcacatttggaagatgattagtgcggtacgcgtatgatcagagaagaaaagctggccacctagtcattcttgtatggttttatatgttgctttatagaatgatgaggtgtgttctttcctgtatttggtacaattctcaagtattttcctatcctttgcttgagatgctcagtatgccgtttctggagaaacacactgagaatgtacttatgtatggacagctttgggcctgatttagcgcttggcacagtgatggtatcttgtacgccatatctaccaaccaattttagcaccaaacctttcttgtcaaataccttgtgtgaactgtaagattcaacctcc

SEQ ID NO: 3144 - DNA, 2496 bp, Oryza sativa
  Clone ID: PAT_MRT4530_23715C.1
atgcctcctcttctgtataacctcttcgtgctcatcgtcgtcttcctcggcggcggtgctccggcgtgttcagccgcgacggacaccgtcaagcctggccatgtcgtcggcggcaaggacaaggtcgtctccaacaacggcaagttcgcgctcggcttcttcaaagccccggctccaaaccaagagaaatggttcctgggcatatggttcaacacggtgcccaaccgcaccacggtatgggtagccaacggcggagagccaatcatggacgccgccgacgccggctcgccggagctcaccatctccggcgacgacggcgacctggttgccttacacccaaccaccaagtcaatagcctggtcaaccaacgtttcagccaagaactccaccagcaacagcaacaacactgcagccgtccttctgaacagtggaaacctcgtactgcaagacacctcgaacatgtcccaacctcgtacgctgtggcagagcgtcgaccacccgaccgacacgctcctccccggcgcgaagctcggccgcgacaagctcaccggcctgaaccgccgtctcgtctccaagaagagcatggccggcccgtcccccggagcctactgcttcgaggtagacgaagacacgcctcagctcgtgctcaagctctgcaattcgtctgtcacctactggtccagtggaccatggaatggtcagtacttcactggcatccctgagctgatcggcaattcacctggctttcaccttgggttcttcgacaacagcagagaggaatatctccagttcaatgtgtcaaatgaagctgtggtgacacgcaacttcatcgacgtcgatggccggaacaagcagcaggtttggctggacagctcgcagtcttggctgacgctgtactccaatccgaaggttcagtgtgatgtgtacggtgtatgtggggctttctcggtctgcagtttcagtttgcttccactctgcagctgcatgaagggattcactgttggatcagtgaaggattgggagcaaggcgatcaaactggtggatgtgtgagaaagaatcagttggattgtgtaggtagcaacacgagttcatcagattcaactgataagttctactccatgtctgatatcatcttgcctgacaaagctgaaagcatgcaggatgttgacagttcagatgaatgcatgaaggtttgtctgaataattgctcttgcactgcttattcatatggcagtaaaggttgccttgtttggcacactgaattgctcaatgcaaaactgcagcagcagaattccaatggagaaatcatgtatctccgtctctcagcaagagatatgcagagaagcaagaaacgtagagtgataatcggtgtcgtcgttggtgcatgcgctgctggtttggctgtgctgatgttcattttgatgttcatcatcaggaggaacaaagacaagaacaggagtgaaaattatggtagcctcgtggctttcaggtacaaagatttgcgttctgcaaccaaaaacttttctgaaaagattggcgaaggcggattcggctccgtcttcaggggacaactgcgtgattctaccggcatagctgtgaaaagactcgacggtagatcacaaggagataagcaattcagagctgaagtgagatcgatcggaaccattcaacacatcaacttggttaatctgattggcttctgcagtgacggcgacagtaggtttcttgtctacgaacacatgccaaatcgatctcttgacacacatctgtttcaaagcaatggcaagttcttggactggaacactcgctaccagatagctcttggagttgccagaggcttgtgctacttgcacgagagctgccatgatcgaatcatccactgcgacatcaaaccgcaaaacatactactcgacgcatcgtttcttcccaaggtcgcggattttgggatggcaaagtttgtagggagagatttcagcagagcactcaccaccatgagaggaaccataggttatcttgcgcctgaatggattagtggaacagcaattacaccgaaagtagatgtttacagctatggaatggtgctgcttgagctagtgtcaggcaggaggaactcagccagatcagaagaagaatgcactactactaccactacttctacatccactgacactgatggcaactattctgtctacttccctgtgcaagcttcaaggaagcttctagatggagatgtgatgagcttgctggaccagaagctgtgtggtgaagcggacttgaaggaggttgagagagtgtgcaagatcggttgctggtgcattcaagaggatgaggttgatcggccgacgatgggtcaagtggtccagattcttgagggtgtcttggactgcgacatgcctccgttgccgaggttgcttcagagaatctttgagaggccgtcttcagttagcaccagcacaccagttttcctttttgtcggtagccctgaacgccaatga

SEQ ID NO: 3145 - DNA, 1444 bp, Oryza sativa
  Clone ID: PAT_MRT4530_23844C.1
cccccgctcccatcctcttccactctctcctctccccttcgtggcggcggcggcggcggcggcggcgtgacgaggaggagcaatggcgatggcctcctccgcctacgccccagcgggcggcgttggcacccactccgcgccgggcaggatcaggccgccgcgcggcctcggcttctccaccaccaccaccaagtcgaggcccctcgtgctcaccaggcgtgggggaggcggcggcaacatctccgtggctcggctgaggtgcgcggcgtcgtcgtcgtcggcggcggcgaggccgatgtcgcagccgcggttcatccagcacaagaaggaggcgttctggttctaccgcttcctctccatcgtctacgaccacgtcatcaacccgggccactggacggaggacatgcgggacgacgccctcgagcccgccgacctctacagccgcaagctcagggtcgtcgacgtcggcggcgggacggggttcaccacgctcgggatcgtcaagcgcgtcgacccggagaacgtcacgctgctcgaccagtccccgcaccagctcgagaaggcccgggagaaggaggccctcaagggcgtcaccatcatggagggcgacgccgaggacctccccttccccaccgacaccttcgaccgctacgtctccgccggcagcatcgagtattggcccgatccgcagcgaggaatcaaggaagcttacagggttttgaggcttggtggagtggcttgcatgattggccccgtgcacccaaccttctggctgtctcgctttttcgctgacatgtggatgctcttcccgaaggaagaggagtatattgagtggttcaaaaaggcagggttcaaggatgtcaagctcaaaaggattggaccaaaatggtaccgtggtgtccgaaggcatggcctgattatgggatgctctgtgacgggcgtcaaaagagaacatggagactcccctttgcagcttggtccaaaggttgaggatgtcagcaaacctgtgaatcctatcaccttcctcttccgcttcctcatgggaacaatatgtgctgcatactatgttctggtgcctatctacatgtggataaaggaccagattgtgcccaaaggcatgccgatctaagggagatgaactgagctgcaagagaggatagccaatatctgaattaggcttctctatattaggcactttctgtcagttctgtatttacttctgttgtccctgttgttatgtacttcttttactgtggttcttgtttgtggggaaataatattatgagaccttgattaagctcatccgaactcctgagcatggaatggatcgtgtgtagcataattagaatggacatgtgacatttctgcattccaagtattctgaatggtagacaaacaaataatatctgaaaaaaaaaaacaaaaaaaaaaaaaaaaaaaaaaa

SEQ ID NO: 3146 - DNA, 2547 bp, Oryza sativa
  Clone ID: PAT_MRT4530_24032C.1
ccccgtccccgcctcggtccccgtccacgaccccccctgcccccccgccccccgccgcctctcccgcctcccccgccgctccacgccgccccagcgcctcggcagcgggctccgcacaacccaacctgcttctgtagtcatccacgtgttcctcttctccagtactagtagctgctaattgccaaagcagccacatggattgacatagcttctcattggagaagaagatccaagaagaaggccaaagcggctaagctttggccaaagcagccttctcttcttctctagtgggaaagtgagataagaagcagccatcagaagagcactcccttgttttttgaccaaaactttgctgctcactgtcctagctggagagaatccagcgatacacgcatgtcttcttcttcagctcggtcttggttgccgacctcatttgcagatttctgcacatgaggggtctctctctcgaagtctcgtgttttgatttgggcaggtagccagccactgtgagagtgtgagctgaggtgagcatcgccatgggagaggttgcagaagacatctacacccaagatggcaccgtggacgtcaagggcaacccggccaccaagaagaacaccggcaactggcgtgcctgcccctacatcctcgctaacgagtgctgcgagaggctggcctactatggcatgagcaccaacctcgtgaactacatgaagacgcggctcgggcaggagagcgccattgccgccaacaatgtcaccaactggtcggggacttgctacatcaccccccttctcggtgccttcttggctgatgcctacatgggcaggttctggaccattgccagcttcatgatcatctacatcctgggtttggcgttgctgacaatggcgtcgtcggtgaaggggctggtgccggcgtgcgacggaggagcgtgtcacccgacggaggcgcagacgggggtggtgttcttggcgctgtacctgatagcgctgggcaccggcgggatcaagccgtgcgtgtcgtcgtttggcgcggaccagttcgacgagaacgacgagggggagaagcggagcaagagcagcttcttcaactggttctacttctccatcaacatcggcgcgctggtggcgtcgtcggtgctggtgtacgtgcagacgcacgtcgggtgggggtgggggttcggcatcccggccgtcgtcatggccgtcgccgtcgccagcttcttcgtcggcacgccgctgtacaggcaccagcggcccgggggcagcccgctgacgaggatcgcgcaggtgctcgtcgcgtcggcgaggaagtggggcgtcgaggtccccgccgacgggtcgcggctgcacgagacgctcgacagggagtccggcatcgagggcagccgcaagctggagcacaccgggcagttcgcgtgcctcgacagggcggcggtggagacgccggaggacaggtcggcggcgaacgcgtcggcgtggcggctgtgcacggtgacgcaggtggaggagctgaagagcgtggtgcggctgctgccgatctgggcgagcgggatcgtgttcgcgacggtgtacgggcagatgagcaccatgttcgtcctccaggggaacacgctcgacgccagcatggggccgcacttctccatcccggcggcgtcgctctccatcttcgacaccctcagcgtcatcgtctgggtgccggtgtacgaccgcctcatcgtgccggcggtgcgcgccgtgacggggcgcccacgcgggttcacccagctgcagcggatgggcatcggcctcgtcatctccgtcttctccatgctcgccgccggcgtgctcgacgtcgtcaggctgcgcgccatcgctcgccacgggctctacggcgacaaggacgtcgtgcccatctccatcttctggcaggtgccgcagtacttcatcatcggcgccgccgaggtgttcacgttcgtcgggcagctggagttcttctacgaccaggctcccgacgccatgcgcagcatgtgctcggcgctgtcgctcaccaccgtcgcgctaggcaactacctcagcacgctgctcgtgaccatcgttacccatgtcaccacccggaacggcgccgtcgggtggatcccggacaacctcaaccgcggccacctcgactacttcttctggctgctcgccgtgctcagcctcatcaacttcggcgtctacctcgtcatcgccagctggtacacctacaagaagacggcggattcaccggacgacaaggccgagcacgccggagcaaactgagccacgaggtgaagctgattatgacatacaagggggaattgaactgaattgtggcgtgtgaatgtcagaatgtgtggggttctaaacaagttcttgggagataaaatggaaaggaaattagtgtcgtttgtgaccttcaaaaaaaaaaaaaaaaaaaatgcattatgtctggtaggaaaaaatgaagaagaataggaggatatagtagtttaaaaatataaatgtgatgtttagttttctagaaaaaaaatgaaaaaagttgttcaag

SEQ ID NO: 3147 - DNA, 5400 bp, Oryza sativa
  Clone ID: PAT_MRT4530_24184C.1
atggggactggaagccgggccgtcgtcggcgccgccgctggcctcggcagcgccgtcctggggcctccgtcaagccttcctccacggagacgcgcaccggtattccgccggagctgtaggaccggtgcctcaactgcttgtcgtcggcgcaccagattgcgacctgccgtctcccgtgcgtcgccgattcgctcagaggacgagtcgctttgtgtggtcgagcgctcgccgcagctcatagaggaggagggccggctccggcgtgctctcttcgcccgggtgagcggcctggacatggcgctgtcggccggcgatgccgccgcggcgctgtcggctgctcttcacctccccgcaggccgcttctccgtccactgcgcgcagcccgatcacttcctcatcgtcttcgctaactccggtgacatggacctcgcgctctcgcgttccccgatcccggctcccccctaccagctgattctacgaccatggacccggcttgtgatggctacctccttctccatgccgttcagggtgtcgctggacctcgagggtgtaccggcacacgcctggaacgcgtccacggcggcggccctcgtcgctcccggtcgtctcatctctgtggacaccccggcgcgccccgacgagtaccggtttcttcgagtcaccatctcgtcgcacaacccggccgccattcccaaggctcgtcttcttctcattcccgagccgacgttgggctcccagtgccttctccggtatcgggtccttctccacgtgctctcggtggtctgcctctcggccccctcggcgtctggcgatgtcgacccggccggtggcggtggtgctagcggtgagggtggtggcgctgcgaacgatggtggtggcgctgcgaacgatggtggtggcgacctcggcgctcgttcttcgcgagcccatgcggccacctcattttctccgttggccgacgacggacggggcttgctgctggcgttgccggacgccacgaattcgccagctgctgcagacgccatcacggcctctccggtcgacgtcgtcccgccggtcgacgcgggctcgccagctgccgatgtggccaccacgtgctctccggtagccgctggcatgccggccgccgccgtggccgctgctggctcgacggctcctgctgtggtcgccccggactcgccagttgctgccgtggctgtcttcagctcgccaactgtagtggctgcctccagctcgccagctgcttcgccggttgacatcgtggccgcctcttcttcgccggctgccgccgtggccgccttcggctcgccgactgtcgtggttgcctccaactcactggttgcgggttcactagccgccgtcgtctctccggtctgcgccacttcaccggttgctgcctgccacccgccgaccgcatcttccttgctgtctggcccttcgggtggcggcccggcgttccctgcctcgccgctgtgctcgcgacgttcgccgttgttggccgatgggatcgcggcctcctacgccgagccgactggtctcttcttcgacgagctcgacgccctggccgcggagtttggtccggctgtgcctttgccgcccagggtatcgcctgtgccgccgtccgcctccggtgcaggcacttctctgccgaggactgcctgcacaccgcctactggtggggagtggctgaggcctgagtcgccgctttctcagcaggctccaactttggtggttgatgtgcccgacggcgtcctctacgatgtgccgatggttgtccttgacctcgatggccgcccactggcgcactcgcttccatcttctgtggcagacaacgccgctcttcacgccttcctcaccagctgctccaggcctctccctcctgcgctcctcccgccgcctttgccgctgccgcctctcgccgccaaggcggtggaggttgtgccgaagcgcagtgagtgtatcgctgctaagatggcacttgaggcgcttgaggggccgatccacgcagtgtcgcgcgcccagcgcaacctgatgcggaagctcggcctagttccggagaggggcccggtcacggccgaggcggtcgcggcttacaacgccctcttctccaagccactttcccaggagcacatcatcgcgctctcctcgctcttctccagctccttgcccccggccaaggctgcggaggagttggtcgagactattatggatgtaatcccctctcgtactattctggaaatgctaggcctcgactttgattattctttcttgcctgcggtcggtcggagtgggggggtgttgcttgcctcgcggacgaccgtctggtctgtctcagatgttcaccttgcggatttctctcttgcctcgttggttcgacactcttctgatgtcgccccctggtggctctccgtcgtctatgggccacaggaggagccggacaagcttcgtttcttagatgagcttcgttcgctgcgctcctctcgcacggggccgtgggccatcgtaggcgatttcaacctcattctcgaagatcaggataaaaacaaccttaatctcaatcgtcgtatgatgggtcgttttcgtcggctcgtcgacgagttggaactccgggagctgccgcttcacggacgtcgcttcacttggagcaatgagcgtgagtcgcccacgcttgttaagctcgaccgcgtcctcttctctgcggattgggaggagcttttcccctcttgcctcctccaagcggcctcttctatcgcctctgatcactgtgctcttctccttcatacctgcgtcacctccccgaaagcgcatcgttttcgttttgaggccttttggcccaagttcgacggctttcttcaagtcgtgcaggacgcctggcatccccctgccaacctaccccctcttgccgctcttgcctggtgcttctctaccacggccaagcgcttacagagctggagtgaccgtcacattggcagtgttcgtctgcagcttcagatggcgaaggaacttgtcttccggcttgatgttgcgcaggagagtcggtctctttcccccttggagacctggctgcggcgagatttaaagttgaagtgtattggtcttgcctcgcttgagcgtactatcgcgcgtcagcgttcgcgtttggtctggcttaaggagggtgacaccaataccaagttcttccacctgcacgccagagctcgtaggcggaagaacttcatcacgtgcctttgtgatggtgaccagcttgccgtctcccatgatgcgctgcaagagcttgcctcctctcacttttgcgccatcttggggacgagcgtcgagcgtgaactagccctagacctccactctcttggcctccgccctgcgcagcttgaggggctggactgtctcttcacagaggatgaggtctgggcggtgatcaagtccttgccctctgataaggcgcccggtcctgacggttttacgggccgtttctacaagtcttgctggcctgtgatcaaggtcgaaattctggcggctcttaactccttgttcctgaccaacggccaaggtttcgcttccctcaacgacgccctaatctccctcttgccgaagaaggacgaggctgttgacgttaaggatttcagaccgattagccttattcacagctttgggaagttgttctccaagatcttggcctctcgtctctcccctcgcctggacgagcttgtggcgcctaatcagagcgctttcatcaagggccgctctctccatgacaacttccgctatgtccagcttgcggcaagggcgctgcacgccaaacgcattccccgacttcttctcaaggtggatatcgcgaaggcctttgacacgagaggtcttcgccaaggagatcctctttcccccatgcttttcattctagtcatggatgtgctcaatgcgatgctccgcaaagcctctgacttgggtgattttcttcccctcaatgatcgtgctattcgacatcgtgcatccctctacgccgatgatctagttctcttcctttcccccgttcggcaagaccttgagttcatccaaggcatcctctctgtcttcggtgccgcttccgggcttcggaccaacttcaccaagtgctcgattactccgatccgctgctcggttcttgacctggagctggttcagtcctcttttccttgctcgatctcggagtttccctgcacctacctcggcattccactgtcagttcgcaagctgccaaaagcggccctgcaaccgcttgtggataaagtctcccatcggctccccccctggaagggccgtctaaccactctggcgggtcgctcggttctagtccagtcggttctctcttccattccggtccatgtttctatagcgatcggcttgccaagctgggttatcaaagccattgacaagaagcgtcgcgccttcttgtggacgggtacggactcggccaatgggggacagtgccgggtgtcctggatgagggtttgtcgtcctagggatctcggtggactgggcattccggatctcagggtggctggctttgccttgagagttcgctggctctggcttcagcgctcgggacacccctactggtctgatctgaaggcccctgttgagcggagcgtctccgacatgttcgcagcatccaccttctctatcctgggagatggtcagtccacgctcttctggactgatcggtggatcgatggtcgctcaatagcttctatagctcctgacctcctccacgtcgtgcctccacgcttccggggatcgcgcacagttgctgctgggttagcgaacaactcctgggttggtgacatacgtggcgccctcactgtcccggtcatctctcagttcctgttagtctgggacgcggtggttcctacccagctctcgccgggtattgaggatcacctcgtctggcgttggacgggtgaccagtgctactcagcgcgatcggagtatcaggcgttcttccttggccagcactcttttgcctatgccgacttactctggcacgcgaagggccctgctaaatgcaagttcttcctttggtttgcatttcagcagcgctgctggactgccgatcttctccaaaagcgtggtatcgatagccactctgcttgccccttttgcgctcaggagcttgagacagcgaaccacatcctcatcgattgcgtgttcgctcggcaggtctggctccgtgtgttgtcccctcctcgctgggctgccctctctccccctcgtggcagctggctccaggattggtggtcatcctccagggtatgtttacctgagcaccttcgcagcggcttcgactccttggtactcctagtctcctggcagctgtggaaggaacgaaactccagggtttttactctgcgctcgcttcggtcgtag

SEQ ID NO: 3148 - DNA, 299 bp, Oryza sativa
  Clone ID: PAT_MRT4530_24833C.1
acgtgatgttgcttgacttacaccttgtgccctcatctactgctgcggaatctacagtgtcttacctgaagatgaaaggtgattaccacaggtaccttgtggtatttaagactggtgccgtgagaaaggtagctgctgtaagcacattggtggtttacatggctgctcaggattttggtttggcgtgtcttgctactactcatcccataaggattggactgtcacttaactactctgggttctactactagattataaactcttcagacaaggcttgctaccttgctatgcaggcgttt

SEQ ID NO: 3149 - DNA, 4535 bp, Oryza sativa
  Clone ID: PAT_MRT4530_25119C.1
gccgatccccgggctgccggacccgccgcgtgggggtgttcccgcgtcagcccagttaccgcgcacgccgcctccggcgccgcctgtgtccctcggactggacagagggcctttatcccgggtccctccccagcctgaactggggttgctcctctctccctcgttgcagcccccggatcgctcggttaccctttccccgcgagtctctccgggcctccatcagccttctccctactggctgccttgttacttcatgtgggtcagggaggtctggcagagagcattacatgtccctggagacggtcaccaccagaggtccacattccatgccgtgggtcatcttgagccccttcaccacctccagcattgtcggcctcttgaacggctcgtcggcggtgcagtcccgggcgatggcgagcacgcgcgccatctgctcccgccacacgcttgaaaccggcaagcatggatcgaacagctcgttctgcttaccgcgggcgatcatccaccgcacccagccgacgaggtttccacccccttgcacctcctcctggcctgtaggtggccgtccggtgaggagctccagcatgacgacgccgaagctgtagacgtcgcctttcgtggtggacttcattgtgaggccatactccggaggaatgtatccaaatgtaccggcaatgtcagtgctgacatgggtctcacaggcactgatgatccttgcaaggccgaagtcagagaccctcggctcgaagttctcatccagtagaatgttgctcgacttcatgtcccggtggatgatatggggcacaaagccatgatgcaggaaggcgagcccacgggctgaaccgaggcagatcttgagacggtccggccatccaagagcttcaagtgcatctgctcggtttctcagccacatctcgaggctcccattctccatgtactcgtagatcaggaatcgttcatcgccacaaacacagtagccaagtagagggacgaggtttggatgtttcacctttccaattgtctccatctcagctagaaactcacggtcaccttggaactgatggccaccatggagcctcttgatcgcgactctccggccttcagggagcgctgccttgtagacagtgccaaatccaccatcacctattatgtgcaccttactgaagttttctgtggctttcagaatatcatccgcggtgaccctcagaagtgcatgctcaaatgttgcaagattgatactcagaggttcccttgacttctttcctagcagttcatcagttgaggtaggctcaactgtagccttggccttactggcagattcaaaagccaaaggcctgcttctaaccagcttccgtctcagataaacagccagaagcactaaaacaatgatgatgacgaatgtaaaggcacagatggtaattgcccttcgaacccgatgatatggatgcaatgctttatgatcagtaccattagtagaacaaatgcctcctgcagcacaatctgccaagctgtacatgtcaatatagttacctgagaagttggcaaatgagaggccaaatatattgcagattccacagggtatggcaccatagagattgttgctcgacagatcaagataattcaaagaactgagatcagaaagtgctgaaggcaaccttccagtgaggctattgttgtggatatcaagagtagacaattgtgtgaagttcgagatagactcatctaggctccctgagaaatggttgctgcttgaattgaagaagagcagtgtacttgagtattctttgccatcggggcaagagaactggatatgcccagataggtggttgttgctgacatccagatggtttaggtaattgttgcagagcaaagactgtggtagagtgccagtgagtgcattgcttgacaagtctagcactgcaattttgggaaggatttggcctatcttagcaggaatggagccatctaggtggttattggacagaataaggccttgcaattgaaccaaaggtccagaccatggaagcattggtccaacaaattcattaaatgacaagttaatggatgtaagatttgttagctcgccaagctccacaggaatggtgccattcagcaaattgccttggaggttgagcaccatcaccattgcacagttctttatagatgttgggatctgaccagtcaattggttgtatgacagatcaagaagaccatggtgctgaagaaactctgagtcagggtgagcctcattctcaaatcccacgcaaatctcagcagggatagaaccagacagctggttggaagacaaaatcaagctatcaagcaatgtcaagtgagatatggcacttggaatgttcccagtcagattgttatagctcaagtccagcgtggcaagttttctgcagttgaaaagtgctagtggaatgatcccagataacctattgccacgcagggatagattggtcagattccttagatcaccaacagactgagggataggcccttcgagtaagttattgtctatatgcaacctttgcaatacagagagtttaccaatactctcaggtattgggccggtaatttcattgttactgagagatatctctagaagggtttttgactcccacagctccgcaggtaacatccctgcgaatttgttttgtgacaactccagagtaaccaggggtaattctgctaaatatcctggtacctccccatgaatatggttgtctaacaagttcaattcagtgaggttcgtgcaccctttaaatgcctcatcaatagtcccagtcagattgttatgatgcaataagagtgaatgcaaggagttggcttggcatatgtgagaaggtatagaacctgagagaaggttggattctgcagcgaaacttagcagatgctgcaatggcagcactggcaaaggtccactgaatttgttctgtcccaacctgatggaccttgcatttttccatttctgaatccaatctgggacacgacccgatagtttatttccttccacaaaaaatgagacaatagcctctaaatctgcaaattcttcaggaataggtccaataagggcattgaatgacaggtttataacagtaagcttcttgcaattcccaagttcttttggcatgttcccactgagcccagcattctttgcaatcagctgtgttagattgccaagctcacccatggatgatgggagctcagcgtcaaagttgttatctgatatgtcaagttctgtcaagctgctgagtccactgattgaccaaggtattttgcctgtgaactgacattcctcgagatgaagtaacttaagctgcttcagactaccaatctcttgtggaatccttccagtgagatcattctttcctagaatcagtaattccagattttccagttgaccaatctccctaggaattgttccctcaaaactgtttgatgatagatcaagtgtcaataggtttgtcaacgaggttattccagggaatattgatccagttaggttattctggctagcatcaaagtgcaagagacaagacaggttcccaaaagttgctggtatagatccattgaatgtgttcatcttaatgtccaacaactccaggttcttcaggctgcccagatctggtggaaggcttccggagatggaattcatggatatagatagcttagtaaggtgctgcagctgagcaatagcaggactaagttgtcctgacaaggagttgtagtcaagcaccatttccttcagcatcttcaggttatatagtgagataggtattggcccagtaagctcgttattgctcaagtctaggtactggagattctgcaaatttcccaaagcttccggaagctctccggaaaacccacatccactgaagttgagccgaacaagtgactggaatgccccaatgcataatggaaacggagcatagagtggaacagaggacaaatcaatcgccacaacattatgtcctatgcaagttatgcctgaccagctgcatgggggagtttccgaatcaaaccagttacggagaaagccttttccttcggtgattgaatccctcagagtgaacagagtacttatatcacgtgattctgcccaagcagaaatggggatgaagctcactagcaggatgaaaagccagaaactattggataccatttccacgttattctttttgggactgtaacaattatcttataagatgtagccttgtaacttcaagtaggatatagatgactgacagataaaactgtgcaatacacatccttctgcagtctgaaccattacgccctctcagaaatgcatcttactcccgatgctcgtcgccggggatcgtcgcgtcgtcgaaggcgccgcgcgctcctccgcgagacgacgggctgctcgctcggctggatgggtacgacggcgtggtctcgccggcggcgagcggcggcggcgccgtgctcctgctgctgggctcgtgagtttgtcagggggcgggcacgagggagacgtgaggagcagcaggtggcgaccctcgtgc

SEQ ID NO: 3150 - DNA, 1740 bp, Oryza sativa
  Clone ID: PAT_MRT4530_25375C.1
atgggatcatgcaacgagaacattttggtgtggaacgtgcgaggcctcgactttgattattctttcttgcctgcggtcggtcggagtgggggggtgttgcttgcctggcggacgaccgtctggtctgtctcagatgttcaccttgcggaattctctcttaccgcgttggttcgacactcttctgatgtcgccccctggtggctctccgtcgtctatgggccacaggaggagccggacaagcttcgtttcttagatgagcttcgttcgctgcgctcctctcgcacggggccgtgggccgtcgtaggcgatttcaacctcattctcgaagctcaggataaaaacaaccttaatctcaatcgtcgtatgatgggtcgttttcgtcggctcgtcgacgagttggaactccgggagctgccgcttcacggacgtcgcttcacttggagcaatgagcgtgagtcgcccacgcttgttaagctcgaccgcgttctcttctccgcggattgggaggagcttttcccctcttgcctcctccaagcggcctcttctatcgcctctgatcactgtgctcttctccttcatacctgcgtcacctccccgaaagcgcttcgttttcgttttgaggccttttggcccaagttcgacggctttcttcaagtcgtgcaggacgcctggcatccccctgccaacctaccccctcttgccgctcttgcctggtgcttctctaccacggccaagcgcttacagagctggagtgaccgtcacattggcagtgttcgtctacagcttcagatggcgaaggaacttgtcttccggcttgatgttgcgcaggagagtcggtctctttcctccttggagacctggctgcggcgagatttaaagttgaagtgtcttggtcttgcctcgcttgagcgtactatcgcgcgtcagcgttcgcgtttggtctggcttaaggagggtgacgccaataccaagttcttccacctgcacgccagagctcgtaggcggaagaacttcatcacacgcctttgtgatggtgaccagcttgccgtctcccatgatgcgctgcaagagcttgcctcctctcacttttgcgccatcttggggacgagcgtcgagcgtgaactcgccctagacctccactctcttggcctccgccctgcgcagcttgaggggctggactgtcccttcacagaggatgaggtctgggcggtgatcaagtccttgccctctgataaggcgcccggtcctgacgattttacgggccgtttctacaagtcttgctggccggtgatcaaggtcgaaattctggcggctcttaactccttgttcctgaccaacggccaaggtttcgcttccctcaacgacgccctaatctccctcttgccgaagaaggacgaggctgttgacgttaaggatttcaggccgattagccttattcacagctttgggaagctgttctccaagatcttggcctctcgtctctcccctcgcctggacgagcttgtggcgcctaatcagagcgctttcatcaagggccgctctctccatgacaacttccgctatgtccagcttgcggcaagggcgctccacgccaaacgcgttccccgacttcttctcaaggtggatatcgcgaaggcctttgacacggtcagctggcctttcttgcttgaggtccacggttcccccatcggagaggtcttcgccaaggagatcctctttcccccatgcttttcattctag

SEQ ID NO: 3151 - DNA, 1023 bp, Oryza sativa
  UNSURE (1)..(1023): unsure at all n locations
  Clone ID: PAT_MRT4530_25382C.1
  unsure (1)..(1023): unsure at all n locations
ttgggggccccaaaaaaaaaattataccttgccagcccggggaaggaaactttggtcccctaaaagggccccccctttttttttttttttttttttttttatttttttttttttttttttttttttttttttttttttttttttttttttttttttttttttttttttttttttttttttttttttttttttttttttttttttncaataaaaacagtcaaattagaagatttaagcaaatccgttaacggttcccttacatataagggcagatggcaacagttagctgcttgcgaaggcaatgtcactaccgcacaaaatataataggtcaatcataccaatactgttcctaacacaaaaggctttgtttgagggttctaattctctcagcatatgaaaactaacggaatacaacatagctttcatgtgtagcttctacagcagactacggatgggttcagcgactaaaattacacagttggtccagttacgagataatttgatgaaactaaataaatgttctggtgccgctgattgagtaacccaagataaaacgctgattttccaggaggtgcacttattgtatcctagaaaaaactctcatgagttcactcatttcccatatggatggtacctgctggaaccccgcccaccagcaccggctgctccagctccaccataactgccatatcctccagcaccaccataggcacccggagcgccaccataggcaccaccaccataagcacctccgccataggcaccccctccataggcaccaccaccatatgccccataagcaccataggcacctccatacaaggagccaccataaccaccaccatatcctgatccaaatccagcattacctccatagccataccctcctctgccataaccatatgcagtactatcataataacctcctccagctgatcggtaaccagcaccatacccatagccaccactgctgccactgccgccaccaacacctccgccggacgcgtgggcggacgcgtggg

SEQ ID NO: 3152 - DNA, 1644 bp, Oryza sativa
  UNSURE (1)..(1644): unsure at all n locations
  Clone ID: PAT_MRT4530_25494C.1
  unsure (1)..(1644): unsure at all n locations
ggtccggaattcccgggtcgacccacgcgtccgctccaacatcctgagctccaatctcccactccattccggccgcgcattctcccgctctcgatcgatcgatcgatcatggtggtgccttccgcgacgacgccagcgaggcaggagacggtggtggcggcggcgccgccagctgcggcggcgtccggtgtcgtcggcggcggcggcggcgtgacgatagcgacggtggacatgtcggcggagcgcggcgcggtggcgaggcaggtggcgacggcgtgcgcggcgcacgggttcttccggtgcgtcgggcacggcgtgccggcggcggcgcccgtcgcggcgaggctggacgccgcgacggcggcgttcttcgcgatggcgccggcggagaagcagcgcgccgggccggcgagcccgctcgggtacggctgccggagcatcgggttcaacggcgacgtcggcgagctggagtacctgctcctccacgccaaccccgccgccgtcgcgcaccgggccaggaccatcgacgccatggacccctctcgcttcagtgctattgtgaatgagtacattgaagccatgaagaagctcgcatgtgagatcctggacctgttaggagaggggctaggtctcaaggaccccagatacttcagcaagcttaccacaaacgctgacagtgactgcctcctgaggatcaaccactaccctccatcatgcaacattcacaaacttgaccatgatgaccaatgcaatatcaagagccttgttagcaccaaggctagcaatggtgggaatctgatggcaggtgggcgcattgggttcggcgagcactctgacccgcagatccttagcttgctccgagcaaacgatgtggaagggctacaggtgtttgtgccggaccacgagggcaaggagatgtgggttcaggtgccatcggacccatcggccattttcgtcaatgttggtgatgtcctccaggctctgacaaatgggaggctgataagtatccggcacagggtaattgcaaccgcctgcaggccaaggctgtccacaatatacttcgcatcaccacccctgcatgcacgaatctcggcactcccagagacaatcacagccagcagcccacgccgataccgatcattcacctgggctgagtacaagacgacaatgtactcactccgcctgagccacagccgcctagaactcttcaaaattgacgatgatgacagcgacaatgccagtgagggaaaagcataggaattgctggttaaattgcagacgatgcctatggaccagtggggattaggaagctgaaactgtccccaaaattttggctctctggcagtctggctactatcgtcagatatctcactattatgatggtgtagtgcctaagttgacgggtgtgtaatatcgttagcagtctacagaagctatggttgtacggaagtaatgtactgtcgccttttcagctaactatccatgttctctcttatatgtaatgagttagttgacggatgtgtaatattgctagcattgtatataagctatggttgtatggaagtatgtaatatagccttttcagctaaaaaaaaaaaaacccaaaatacaaaaaaaaagaanaggaaaaaaaanaanaagttt

SEQ ID NO: 3153 - DNA, 1303 bp, Oryza sativa
  Clone ID: PAT_MRT4530_25496C.1
gtcgacccacgccgtccgcaacctttctgagctccaatctcccagtgggtggcgggcgcgcattctcccgctctcgatcggtcgatcgatcatggtggtgccttccgcgacgacgccagcgaggcaggagacggtggtggcggcggcgccgccagctgcggcggcgtccggtgtcgtcggcggcggcggcggcgtgacgagttcgacgggggacatgtcggcggagcgcggcgcggtggcgaggcatttttttacggcgtgcgcggcgcacgggttcttccggtgcgtcgggcacggcgtgccggcggcggcgcccgtcgcggcgaggctggacgccgcgacggcggcgttcttcgcgatggcgccggcggagaagcagcgcgccgggccggcgagcccgctcgggtacggctgccggagcatcgggttcaacggcgacgtcggcgagctggagtacctgctcctccacgccaaccccgccgccgtcgcgcaccgggccaggaccatcgacgccatggacccctctcgcttcagtgagatatgcttacatatttctgcatctgagtactgctcaggggtgatgcaacgaagcatcagtgctattgtgaatgagtacattgaagccatgaagaagctcgcatgtgagatcctggacctgttaggagaggggctaggtctcaaggaccccagatacttcagcaagcttaccacaaacgctgacagtgactgcctcctgaggatcaaccactaccctccatcatgcaacattcacaaacttgaccatgatgaccaatgcaatatcaagagccttgttagcaccaaggctagcaatggtgggaatctgatggcaggtgggcgcattgggttcggcgagcactctgacccgcagatccttagcttgctccgagcaaacgatgtggaagggctacaggtgtttgtgccggaccacgagggcaaggagatgtgggttcaggtgccatcggacccatcggccattttcgtcaatgttggtgatgtcctccaggctctgacaaatgggaggctgataagtatccggcacagggtaattgcaaccgcctgcaggccaaggctgtccacaatatacttcgcatcaccacccctgcatgcacgaatctcggcactcccagagacaatcacagccagcagcccacgccgataccgatcattcacctgggctgagtacaagacgacaatgtactcactccgcctgagccacagccgcctagaactcttcaaaattgacgatgatgacagcgacaatgccagtgagggaaaagcatag

SEQ ID NO: 3154 - DNA, 3543 bp, Oryza sativa
  Clone ID: PAT_MRT4530_25684C.1
tatagagaaatctcccgtctcgtcgtctgctgggctccttgcgccaagactactcataatcgctatcatcgtcatcttctagagggaatgttggaccttcattatcactcgaggtcgtctcctccgctccttgcgccaagacgagtcgcggctcaacagaggaggggcgccgatctccatctggcgagcagagcaggggaggggaagggaaggtatcctgaaagatgcttaatcttatcaaaataaaggataaaaagaaagagcaggcagcaagtgctgctggaaaggctcctgtgaagaagcaatctgctggagagctccgtcttcacaaagatattagtgagctaaacctacccaagagcacatcaatttcttttcccaatggcaaggatgatctgatgaattttgagatcatcgtccgacctgatgaaggatattacctaggtggcactttcgtctttacttttcaagtctctccctcttatcctcatgaacctccaaaggtgaagtgcaagaccaaggtataccatccaaatattgatttggaaggaaatgtatgcctgaacattttgcgtgaagattggaagcctgttctcaacatcaacactgttatttatggccttaaccttctttttacgcaaccaaacgatgaggatccgttgaaccatgaagcagcagctgtcctccgtgacaacccaaagctgtttgaagctaatgttaaaagggcaatggccggaggctatgtgggtcaacactatttcccaagatgtgcatgatatggtgctgggtgccacaaacattagtaagttaagccacctgggcctcttcccgacattctggattgtatggtttcggtgcgttaaagtctgtcggatggatgtgatatgttgactgtatgacggcgatgctgccatctgtgtgatatttgttaaacgtcagtaaattggtaatctggtggtggtacatgtcaacatcatcaccaaagtacttcgagcaaatagtcaaacactcagcagcaacatatgcttctgcaatggacccttcaagccttgccatgttcctcacaaaccgtttcaatgttaataaccttctttctattgggtacatccatccatattgtactggacctctaagaattgcctcttcaggtaaatggacagccaggtgtagcatcacatcaaagaaagaaggaggaaatattttctcaagcttgcacagaatgattgggacgttagctttcaatctttccagcacatctaagttcaaagtttttgcacatagttgctgaaaaaaattacctaattcagcaagtgcttcgtttatgtccttgggcatgattcctcgtacagcagcaggtataatcctttgaagaagaatatgacaatcatgagttttcaatccttggaggttgcatccatctgcagtaacacatgttgctaagttggaagcatatccatttggaaattttacactcttcaaaaaatcacaaaaatcagccttctgtgttttagtcattgtgtaaggggcatgaggagcactatatgaatctccatcacggatcaagtgtaaatgcttcctaatacccatatcttccaaatcaagcctagaatttgtactgtcctttgacttcccagctatgcctagaaatgtaccaaggatgtactcacatatatttttctcaatgtgcatcacatcaagattatgccgcagcttcaaactcgaccaatacggcaaatcccacaaacatgaccttcgcttccaacattggccctcttcgtcccgctttctttttttgctttcaggatgctttcctggtctaacatccttgaccctctccagttgctccatcagctcatccgtggtaaatttctctggcttctcacagttttcaacattaccatcaaacaccttgcttctcctccatggatggtccctagcaaggaaacgccgatggccaatgtaacatatcttattccttatccttttggagcaagcgtttttatcacaatgcacacatgcataataacctcttgtgactctacctgataatgtgctcaaaccaggataatcatgaatgcaccatattacagcagcatgtagatcaaacttcttcttagtaagtacatcaacagtagggacacctttccaaagctctagcagctcctcaataagtggctccaagaaaacatcaatgtcctttcctgggcattctcgaccagggataagcaggcccatgataaagtttgattgctctacacattcccatggaggaaaattgtacgggataagaaacactggccacatgctatacgagaagctcattttaccaaatggattgaaaccatcagtagcaaggccaagtctgatgttccttgcatcttctgcaaaccacccatactttctgtcaaagtctttccatgactcgccatcagctggatggctgagctcattctccactggcttcctcttcaacttatgccattgcacctcctctgccgttcttttggaagaaaaaattctcttcagcctaggaatcaatggaaaatgtcgcaaaaccttctcaggaatcttcttccttccaccattgtctttccatcttgtgcaaggaccaccagggtacagttcttgtttcatctcttccaatagaattgcaaacatagactttttcccttgaccttcttcttcagctgtgtacaactcctctaccataccatgaattccatcatcagggtcatcttcctcatccacattcatgtcaaaatcctcattgagactagtatcctcatcaacatggtcatcaatttcatgtggtacaaccttcaatggttctccatgatgtatccatctagtgtaagtagtagccatcccatgaatatgcaagtgatcatgcacccgtcctttaaattggggaacccgattcaaacaccgacggcatgggcacaacatctcttcatcgtcgccaaatctctcagaaagaaaggtcatgaattcattcaccccatccatgtattcattgctgaacctcttactgttgatccaagatctatccatcgtcggccacttgacgcgcctctctgcccgcccagtgcgccgctggctgcgcctcttcgcctgccccgcgcaccgctccccacgcttctctagcgtgccgctagatccgccgctgccagcgcccgccaaaccgctgccccacgctccggtgaggaccccggcagacccctcaaaactgcgctcaacgagtaggagcaccacggcgctccggtgatgctcgcgacgatgacggaggagccgcacagcggcggtggaggcggagattggagtcgcaaggagaggactgcggtatgggctcaagtaggaaggttgacgacctgttaggttagtttctttagaggatataaacatgatatataaaataatatgcaacatcgcccttgaaacagaaggttgtgggttcgactcccatggccaacatttttttaagaaattttgctgagtaacgggttggcccattttgaaattttgctgagtaacgggttggcccat

SEQ ID NO: 3155 - DNA, 981 bp, Oryza sativa
  Clone ID: PAT_MRT4530_25685C.1
ccggccgggttccggccgggagttccttcccttgcgtaatagaaagagaaatctcccgtctcgtcgtctcctccgctccttgcgccaagacgagtcgcggctcaacagaggaggggcgccgatctccatctggcgagcagagcaggggaggggaagggaaggtatcctgaaagatgcttaatcttatcaaaataaaggataaaaagaaagagcaggcagcaagtgctgctggaaaggctcctgtgaagaagcaatctgctggagagctccgtcttcacaaagatattagtgagctaaacctacccaagagcacatcaatttcttttcccaatggcaaggatgatctgatgaattttgagatcatcgtccgacctgatgaaggatattacctaggtggcactttcgtctttacttttcaagtctctccctcttatcctcatgaacctccaaaggtgaagtgcaagaccaaggtataccatccaaatattgatttggaaggaaatgtatgcctgaacattttgcgtgaagattggaagcctgttctcaacatcaacactgttatttatggccttaaccttctttttacgcaaccaaacgatgaggatccgttgaaccatgaagcagcagctgtcctccgtgacaacccaaagctgtttgaagctaatgttaaaagggcaatggccggaggctatgtgggtcaacactatttcccaagatgtgcatgatatggtgctgggtgccacaaacattagtaagttaagccacctgggcctcttcccgacattctggattgtatggtttcggtgcgttaaagtgctgtcggatggatgtgatatgttgactgtatgacggcgatgctgccatctgtgtgatatttgtttaaagtcagtaaattggtaatctggtggtggtacagataaaatttgagttgcagttcaagctggatttatacatcattttcttttgtgcaaaaaacaaaaa

SEQ ID NO: 3156 - DNA, 1018 bp, Oryza sativa
  Clone ID: PAT_MRT4530_26068C.1
cgcggacgcgtgggaaaaaaaaccctaatccatccactccaaatcgccacgcaggaagggaggaaaggaccaccagccaccgcgcgcgcccaaatcgtcgcagctgcttccccgaggagaagaacatgagtcgccacccgagcactaagtgggcgcagaggtccgacaaggtgttcttgacgatcgagctgcccgatgccagggatgtgaagctcaacctgaagcctgagggccagttcatcttctcggcgaagggccctgccgacgacaccccttatgagcttgatcttgagctctttgatgctgtgaatgttgaggagagcaaggcagctgttgcggcaaggtccatatgctatcttatcaagaaagcagagagcaagtggtggcctaggctgctgaagaaggaaggcaagccacctgtgttcctcaaggttgattgggataagtggcaagatgaggatgatgaagacattgggcttggtgacttcggtgatatggacttctcgaagctgggcatgggaggtcctgatgatgatcttgaggacgatgacgaagatgacacggctgacagtgctaacaaagatgatgaagacattaaggcagaggggagcggggaacaggaagctgctggtgaagcgaagccgtgaaatacctgagagttttagaacgctatgcttgacttgtttgtgacgctgccaggtcttaagatttttttggtgtaaactctggagagtggatcactgccactaaagtaaagtagtagttatggtttagtagctccattttgttaaaaaactttgtgcattgcacactgttctgttatgtgaatcgccatatttgcatcaaccattgcaaagctatccagccattctgtgtttcatacttttactcatagcggtttggtggcatgttccatttgccttgtactttggaacttgcataattgttcgtgactgtaaaaataaactgaagtatccagcttgctcatccatattgttaaaaaaaaaaaaaaaaaaaa

SEQ ID NO: 3157 - DNA, 561 bp, Oryza sativa
  Clone ID: PAT_MRT4530_26070C.1
atgagtcgccacccgagcactaagtgggcgcagaggtccgacaaggtgttcttgacgatcgagctgcccgatgccagggatgtgaagctcaacctgaagcctgagggccagttcatcttctcggcgaagggccctgccgacgacaccccttatgagcttgatcttgagctctttgatgctgtgaatgttgaggagagcaaggcagctgttgcggcaaggtccatatgctatcttatcaagaaagcagagagcaagtggtggcctaggctgctgaagaaggaaggcaagccacctgtgttcctcaaggttgattgggataagtggcaagatgaggatgatgaagacattgggctttggcgcgaattgacagtgcacttccttcttgttgcagttggtgacttcggtgatatggacttctcgaagctgggcatgggaggtcctgatgatgatcttgaggacgatgacgaagatgacacggctgacagtgctaacaaagatgatgaagacattaaggcagaggggagcggggaacaggaagctgctggtgaagcgaagccgtga

SEQ ID NO: 3158 - DNA, 522 bp, Oryza sativa
  Clone ID: PAT_MRT4530_26127C.1
atggcaaatgactcattgacaaggagccatatagttggagatgtgttagaccaattttcaaactcagtgcctctaactgtgatgtatgatgggaggcctgtgtttaatggcaaggagttccgttcctcggcagtctcgatgaaacctagagttgagattggtggcgatgattttcgatttgcctataccctagttatggtggatcctgatgctcctaatcccagcaacccaaccttgagggaatacctgcactggatggtgactgatatcccatcatcgacggacgatagctttgggcgggagatcgtaacatacgaaagcccaagccccaccatgggcatccaccgcatcgtgatggtgttgtatcagcagcttgggcgcggcacggtgttcgcgccgcaggtgcgtcagaacttcaacctgcgcagcttcgcgcgccgtttcaacctcggcaagccggtggccgccatgtacttcaactgccagcgcccgacaggcacaggtgggaggaggccaacctga

SEQ ID NO: 3159 - DNA, 1606 bp, Oryza sativa
  Clone ID: PAT_MRT4530_26698C.1
gcacgagggtttttttttttttttttttttttttttttttttcctgaaagtatgtgcattcatgttactcaagacatcaaatgtaaatggacatcaatttttacagtcaggtgagcccaagagctaaatttcttgttcattattttcgaatcatatcaacatcaaggacaaagtacttgatcaggaaaatttcctttggaagccaaaaaaatatggaccaacattgcgtccacaagcctagtccatgtaatatctttcatagctcatgaccttgggtagagacatatataggtactggtaagaaaggaaaaggggccacagaagcataggcaaccggagggcgcgagtgaatacgagaaggttttcggtcctcacgcttctgtctagctcgttcttcatcctgctgttcagcaccataaagaattccggtgatttcactcgtctgagtgacattatgctccttttgctcattaggcagccgatgcaacagaagtccagccataaaagcaggaagatacaaaaggctaccatagaacattctccttgcagttttgggggttggctccagcacaaatgatagagctccaattgtaaggcccaaagttagaagtgatgcttcaagactgaaccactcagatgtgagaccccagttgtatgcaaaaaatcccaagggcagcatgtatagacaatttctgagtgatacccatgcagttcttttaccagtaggatcagcaaaagaaaacattcggtaccctccagcaaggtaatcattccgacataagtatgcaagggccataaaatgtggtatttgccaatagtacaatgcagcagggagaatcatagcattcagtgacagttcagacgaagctgctgcccaccctagaagtggtggtatggcaccaacaactgctccaacccatgtatttacagggtgtatttgcttcaatggtgtgtatacaaatgcatacagaataagattagaagctgcgagcccagccgccaagccattagccttccaagccaacaaagctgttccagcaactccaacactagtagcccacatggcagcatgtgcaggactaatgcgccctgatggtaggggccgtcgcatggttcttttcattttagcgtcattctttatctcaaacacctggttgagagtatttgcagatgctgcaaccatcatggtaccagcgcaggtgcaacaaagtccagctatgtctaccatgttgccacttccgagcacataaccagccccagatgttgccacaacaagggcacgcctgcaatttacagaattattgcttatgcaaccttgaaaacttaggcgggctttggagagctcgaagtagcacctcccgtagtgcctcagcgcgtcggagacggatccagcttgcctcgaaacagcggccgcggccgccgtagcctccgcgacggcgggcacagcggcggcgatggtgggggcagacgaggaggaggaggaggaggaggagcgcggcgatgcgatgggagctagagccgtggccgggtggtgggacgtgtcggggatcaggcgcgagcggagagccctcgcggcggaggcggcggtcgcgccgcccctccacat

SEQ ID NO: 3160 - DNA, 2522 bp, Oryza sativa
  UNSURE (1)..(2522): unsure at all n locations
  Clone ID: PAT_MRT4530_2675C.1
  unsure (1)..(2522): unsure at all n locations
ccccaggctttacactttatgcctccggcccgtatggtgtgtggaattgtgagcggataacaatttcacacaggaaacagctatgaccatgattacgccaagcgcgcaattnaccctcactnaagaaacaactagaatgtgacagaatttcatttcaggcaaataaccaacaattgcttgcactgaaaaacacataacctgcaattcactgaaaaacagacagaactgccgcttggtagttccctgttttgaaaaacacaatctgcagtaacgctgctaattttccaaataataggtacaggtggagatactccctccgtcccaaaaacacatacatcaacctggagatcaacctaggagagatcacatcccctcttaattcttatcccctcttaattctttttgggacggagggagtactgttgaagaagtccgatgacattttttctctactgatcagtatgtacaagcattcacagacgtcctcctcccatatttacaaattgcaaatttgcaacaaatgctccctatacattcgtgtcttctaactagcagagcttccaaacgaacatattcttgggtctaaaatttcgccatctcactccaatatggagagtatacctggagatttcatctatgaatcatcacatacaggcgcacagcaaaatacatgcctagctagctaagctagtctcagttgaaaactatgggcaacttcagaacttggccagaagccacccaaatgtccagccaagaagcagccctgcacctgcaagacctaaaccaacggcaaataagagcgcgtcacagaaactccctgcatttttatgccttctgcctttcttccttgtccaatcttctttctcatgatctggtgtagtccttttctttagtgtaatccatggaatatcaggtatcatggttgctatctgatgctctctgtgtttaagctggaggcagatgttctccaactgtaacattttcagccattgtttgcacgcaaagagatgcgaggcctgtctgaaaaatagcttgatgacatcgtctttttcactttgtgctttcttcccagccatctcagcttccctcgcccgtgtttgcgagtgacaaagtgcctccaaaagttgagcttgctctgcaggattctggtatgttcgcttgcctcgtggttctgtattgatgcccctagaaaaatcttgtgcatcactgcgtgcaacatttctttcctgctgttgccaaactccatcactggttaaatccacctcatctgtgcttgctgtgctgtaactgcattcaatatgttcacattgtccagtatcaggatatgacattgtacctgctggacctgatgaccccctgtacctacccatattttcatgactgcgtgattcagtaccctgaacacgaactatctgggtaggtcttggtaaatcgcaattctcaatatgctgcattgctctttctgcaaccagtaaagccagctcattctcatcagtgatctgccaccatggttgactcctttcacctcctttccaaggcgcattcatatcaaaatcgtccttctgtgggttcttcgacggtggtgggttaaaatttttgaaatccaggaattctttatcattgaacaaacagtcactggcattttctttgcacttcgaaggaacttgggaatagccacctatatttttcaagtcttgtaagcctgtttcagaagaatacttcatggaagctgtggaaaccatccacgaaggctcaaaaacatcctcaatcttctcaggattggtgtcgaacatttcacaaaataatggttcgtcgtgtatattcttttgtgctgaatcctccacttccttatcactgatctctcttcccagaaaatataggtgctcacctgcaagattcttctgccctcctaaatttggttgtaactgaagccaccatctaatatcaggtggcagactggagttcatgggattccagctcaatggcatgaaattgggcacagggcggtcttcagaattcctacaatttccattgcttttgacatgctgctgttctgatgatggtggacagcaggctagttttggtgctctttttctatcctcctgaacgatgcaacggtttgcagcacgctgccaagcagcccttgcttcagcagcggccattattctcactgatcagagaactggtcacttgatggatctagggacaagaagacggcggtggcatcgcccgcatccgtgacctcgcttcgttgcccctcgatgcaaagattggggcatccgtccggtgcgaaccaccggtcgctttatgggaggagggcgagagaatcagccggtggaaatcccacagaaacggagcaaacgatggatgagatgaggtgaggtactgaggtgacgcagcagcaacagcagcagcggcagcaagctggattagactaggtggatggagtgagagtggggatttctctctccgcccccgcgggacaacgacgcgtaagctcgcgacagggaaaggcctcgtgc

SEQ ID NO: 3161 - DNA, 2475 bp, Oryza sativa
  Clone ID: PAT_MRT4530_26806C.1
atggcgccgccctgctcctctgctctcgttcttccttgcctgcttgtcatagccatggccgctctgcaaagtgctgtggtgtttgccgataccgtcactgccaaacgcccgttgtccggcagccagagtgcactggtgtccaagcgtcgcaagttcgcgctcggtttcttccagccagaaaattcacagcattggtaccttggcatctggtacaaccaaatttccaaacacacacctgtctgggttgcaaacaggggcactccaatctcgaatccggacacctcacaactaaccatagcaaccgacggcaacatggtattactcgacaattcaacaactgcaatttggtccacgaacatctccaagatcgcctccaactccacggtcggtgtcatcctcgacaccggcaaccttgtcctcgcagacgaatcgaacacctccatcatccactggcagagcttcgaccatttcggcaacacctggctccccggcggcaagctcggccggaataacaagctcgccggcgtgagcacccgtctggtcgcatggaaggctcgcaatgacccatctccaggcgtcttctccctcgagctggatccgaatggcacgagccaatacctgctcgaatggagcatcacgcagcagtactggacgagcggcaactggactggccgcatattcgccgacgtgccggagatgacgggatgctacccgagctcgacgtacaccttcgactacgtcaatggcgagaacgagagcgagagctacttcgtgtacgacctcaaggacgagtccgtcctcacgaggttcttcctgagcgagatggggcagatccagttcttgacatggatctacgcagccaaggactggatgccgttctggtctcagcccaaggtgaagtgcgacgtgtactcgctgtgtggcccgttcagtgtctgcaccgagaacgcactgacatcttgtagctgcctccggggattcagcgagcagaacgttggcgagtggttgcagggagatcacacttcagggtgcagaagaaacgtcgagctgcagtgtagcagcaatgcctcagtgatggggaggactgatggtttctacacgatggccaacgtgagattaccaagcaatgcagagagcgtggtggtcataggaaatgatcagtgtgagcaagcatgcttaagaagttgttcttgcactgcttactcctacaacggcagctgctcactgtggcatggagacctcatcaacctgcaggatgtgtctgccattagtagccaaggaagcagcactgttttgattcgcttggccgcttcagaattgtctggccagaagcagaagaacaccaagaacttgatcactattgccatcgttgctactagtgttctagtactcatgatagctgctttgtttttcatcttcagaagaagaatggtaaaggaaacaacaagagtggaaggttccttgatagcattcacataccgtgacctgaaatctgtgaccaaaaatttctccgagaagctcgggggaggcgcattcggtttagtgttcaaagggtcgctacctgatgcgaccgtggtggccgtgaagaagctcgaaggttttcgtcagggggagaagcagtttcgcgcggaggtgagcacgatcggcaacatccaacacgtcaacctgattcgattgctcgggttttgctcggagaaatcgcgaaggctactcgtctacgagtacatgccaaacggttcactggacaagcaactttttgacaataaaaaacatgtcctgagttggaacacgaggtaccagattgctcttggaatcgcgaggggattagactacctccacgagaaatgcagggattgcatcatacactgcgacatcaagccagagaacatactgctcgatggctcgtttgcacccaaggtcgccgacttcgggctcgccaagctcatgggccgcgacatcagccgcgtgctgaccacggcgaggggcacggtggggtacatcgcgccggagtggatcgccggcacggccgtcacggcgaaggcggacgtgttcagctacggcatgacgctgctcgagatcgtgtcggggaggcggaacgtgcagggacgacggaggaggcaggagcagcaggacgacggcggcgcggcggcggaccgcccattcccgttggtggcggcgggcaggctcgtcggcggcggcggaggccggcgggaggagctggtcagcgccgtggtggacggccggctcggcggcgacgccgacatgggcgaggcggagagagcatgcagggtggcgttctggtgcatccaggacgacgagaacgcgaggccggccatggcgacggtggtgcaggtgctcgaagggctcgtggagatcggcgtcccgccgattccgagatcacttcagttcctcgcggagttggccgatcaatcaaattacttgcagttcttctccgatttattaccgtcgaattga

SEQ ID NO: 3162 - DNA, 2126 bp, Oryza sativa
  Clone ID: PAT_MRT4530_26969C.1
atggcgggcgcggaggccgccaatggcaggaacaagtacgcggttcttgatcccagcgacgagccggaggggcggaggaggccctcggcgtgggagcggaggagcaaggagcggttcgtgctcgcctgcgccatcttcgcctcgctcaacgccatcctcctcggctacgatgttggtgtaatgagtggcgcaataatctacattcagaaagatcttcacattaccgaatttcaggaagaaatcctagttggttgcttgagtgtggtttcactcttgggaagtctgtcaggaggaagaacatctgatgcaattggcaggaaatggacaatggctcttggtgcaattgtcttccaggctggtgcagccataatgacgttcgccccttcattcaccgtgctcatgatcgggaggctccttgctggtgtgggcattggctttggtgccatggtatctgcagtctatatcgctgagatatcccctgcagctgcccgtgggactctcacatccctccctgagatctgtatcaatttagggatcctccttggttatgtttccaactatgctttctcgggcctttcagagcatatcaattggaggattatgcttggtgttggtatcctcccatctgtcttcattggatttgcactttttgtgatcccagaatcacccaggtggttgatgatggaaaagagagttccagaagccagggcagtattgctgcagataagtgagtctgaagctgaggttgaagaaaggattgctgagattgaggaagctgcaaatcttcttaaatcgacgaaatccgaggacaaggcagtgtggatggagctgttgaacccttctcctgctgttcgtcggatgctatatgctggctgtggtatccaaatgttccagcagatcacgggtattgatgctactgtctattacagcccaactattttcagagatgccgggatcaagtctgatcaggagcttcttgcagccacagtggctgttggttttactaagacagtgttcatattggttgcaattttcctcattgataaagttggacgcaaaccgcttctttatgttagcaccattggaatgactatgtgcttatttgtcttggggattgcactcacattgcaaaagcatgccatgggacttatttctccaagaattgggattgacctagcagtttttgcagtttgtggaaatgtggctttcttttcaattggcatgggtccaatatgttgggtcttgtcttcagagatatttcctttgagattacgagctcaagcatcggcactaggtcaagtaggtggtagagtgagcagtggtttggtttccatgtcatttctttccatggcccgtattatatcagtggcaggaatgttctttgtctttgcggttatctcgactgtctctgtggcctttgtgtatttctgcgtgccagaaacgaaagggaaaactctggagcagattgagatgatgtttgaaggtgggaaagaatggagagggagtgagatagagcttgaggatacacaacatttaatacagagcagcaagaagtctgtgtctctaggctgacactattagaaacaataaattcgaaatcattcgatgttcaatgatgaaccatacttatcctgcttccatcgcctacgggattctgaaattcaggtctgcaaaatgatcaggctgccttggactgctacggattttgagggcttaacacgagtatattaggtgtaggcgcaaaacagcatgtaaatgtctgctttacacaactacatcccaaaatgttacctgggaggacacagatgatgttgtatatggcggtatcttccacctaccaaaaaatatagttgttgaagttccttattccacagtttaattttaatagaggaagaggtgtgtgatttccaactgaatgaattctgtgtgattcttgatccagctttttgatttagtccttcatgatattgtagtactgtggctttgttggtctagtataaaaccttcaagaccatgccatgtctatagctttgcattgacgtgcagagttctgtaaataccagatttggatgattcattctgtcaaattaattatttactgaaagtgcactgtgactctgtgagtc

SEQ ID NO: 3163 - DNA, 103 bp, Oryza sativa
  Clone ID: PAT_MRT4530_27304C.1
gctgattcctagacgtgcacacaaacacacgcctgcttttctatatgccacagctggtgtgcgcaagctaccgagtgcagattctgagtggcttctggacaag

SEQ ID NO: 3164 - DNA, 1748 bp, Oryza sativa
  Clone ID: PAT_MRT4530_27531C.1
atggccacctcccacctcctcgccgccgccccctccacccccccctcctccgcgcctcttccccctcccccccccatccccagctccccccccccacctcctcgccgcctcctcctccaccgccgcctcctcggcgaccccccggcctccacgcctcagcctccgatccccaccgccctcttcactgcgcccgagccagaggccccacttcccggtggtctccgcggccgggacggcaaaaaagacgacgaccaatggaaccgagaaagctacctcgggaggctactgactcagccagcggctcggcatcaagtgctctgaggaggagatcgacatgtagatgactcgcgtacaatttactaagccggtgaaattgttgccgcttgtatagtgtgtgctttatggagtagctgattctggaaattaccaatggacagttgaagtctggagctagatctgttgtatgcatgttactgtcctgttcatgtcttccaggtatcacacagagagatattgactggtttcatcgaaaacatagatgaggttgctaagcctcacggtcctagtcattcaggcgctatttcaaacgagatatagatgcgttaaatgagccttaccttcctattcgtccttgctctaatttgggcactgttgttagcagggcttggcctgggtgctctgttagatgtatgggcaggacatgattttcctattattttttatcttgctgttggtgggtccttgctttcttacatatattcagctccacctctgaagctcaagcagaatggatggattggaaactttgctcttggtgcgagctacattggcttgccctggtgggctggccaggcattatttggaacccttactcctgatattgttgtcctgacttctttgtatagcatagctgggctagggattgctattgtaaatgactttaagagtgttgagggagatagagctctggggcttcagtcactcccggttgcttttggtatggaaactgcaaagtggatatgtgtaggagcgattgacataactcaattatccgttgcaggctaccttttcagttccggcaagccttattatgccctggcactgctaggactcacaattcctcaggtggtctttcagttccaatacttcctcaaggaccctgtgaagtatgacgtcaaataccaggcaagcgcgcaaccgttcttcgtcttgggccttctggtgaccgcccttgcaaccagccactgatgaaagcagcaatcgccctggactgtgattctgtgacagcgaagttttgggtggaagatgcagattgatggttctctgcaactgttggtggagctaggttcagcagctatgttcgcgagtgtattagcgctcttttggcggtgctgggtagtagaatgtagaatcgtttcttgttgattccctgaactgatccagatcaaacatcttctaaaggttctgcgatgcaatgctagctgcagacgggagatggtacagggggtcgttttgctactttgccgccgatgttgtagggtgtgtagacagactgtagatgaataatgtcagtaacacctgtggggggttcagtgctagtgggctgcaaaacttgagcactgcttcgatcaaattgtgtctttgattatgaaattatggaatccagcacaggcaggtaataatttcgtaatagagcataaacaatttgtgaccttaggtgcgaagaaaaaacaaaaaaaaaaaaaaaa

SEQ ID NO: 3165 - DNA, 2421 bp, Oryza sativa
  Clone ID: PAT_MRT4530_27544C.1
atctcctcttctcctctcctccctttttctttcttgtgctaatattatatccgtctcgcggcgacgcgacgatcatggagacccgggacgacgtcgccgacgcctcggcgcttccctactcctactcgccgctccccgccggggacgccgcctccgccgacctcgccgccgcccgccgttcccggaggcgcccgctctgcgtcgccctgttcctcgcctccgccgcggtgatcctcgccgtggcggtcctctccggcgtcaggctcgccgggcgccccgcgacgacgacgatggtcgtcccgggggtggtggagatggagatggcgagcagggggccggagtccggcgtgtcggagaagacgtcgggggcggaggagatggtgaggctgatgggcggcgcggcgggtggggaggcgttcccgtggagcaacgcgatgctgcaatggcagcgcaccggattccatttccagcccgagaggaactggatgaacgatcccaacggtccggtgtactacaagggttggtaccacctgttctaccagtacaacccggatggggcggtgtggggcaacaagatcgcgtgggggcacgcggtgtcccgcgacctcgtccactggcgccacctccccctcgccatggttcccgaccagtggtacgacgtcaacggcgtctggaccggctccgccaccaccctccccgacggccgcctcgccatgctctacaccggctccaccaacgcctccgtccaggtccagtgcctcgccgtcccctccgaccccgacgaccccctcctcaccaactggaccaagtaccacgccaaccccgtcctctaccctccccgcaccatcggcgaccgcgacttccgcgaccccaccaccgcctggcgcgacccctccgacggcgactggcggatcgtcatcggctccaaggacgagcaccacgccggcatcgccgtcgtctaccgcaccgccgacttcgtcacctacgacctcctcccgggcctcctccaccgcgtcgaggccacggggatgtgggagtgcatcgacttctacccggtggccggcggcgagggggtggacatgacggaggcgatgtacgcgaggaacaagggggtggtgcacgtgatgaaggcgagcatggacgacgatcgccatgactactacgcgctggggaggtacgacccggcgaggaacgcgtggacgccgctggacgccgccgccgacgtcggcatcggcctccgctacgactggggcaagttctatgcctccaagaccttctacgatccggccaagcgccgccgcgtcctctggggttgggtcggcgagaccgactccgagcgcgccgacgtcgccaagggttgggcttccctccagtcgattcctcggacggtggagctggacaccaagacggggagcaacctgctgcaatggccggtggaggaggtggagacgctgcgcaccaactccaccgacttcggcggcatcaccgtcgactacgcctccgtcttcccgctcaacctccaccgcgccacgcagctcgacatcctcgccgagttccagctcgacccgctcgccgtcgacgccgtcctcgaggccgacgtcggctacaactgcagcaccagcggcggcgcggccggccggggcgccctgggccccttcgggctgctggtgctcgccgacaagcgccaccgcggggatggggagcagaccgccgtgtacttctacgtggccaaggggagcgacggcggcgtcacgacgcacttctgccaggacgagtcgaggtcgtcgcacgccgacgacatcgtcaagagggtcgtcggcaacgtcgtcccggtgctcgacggcgagaccttctccctccgggtgctcgtcgaccactccatcgtcgagagcttcgcgcagggggggaggtccacggcgacgtcgcgggtgtaccccacggaggccatctacgccaacgccggcgtcttcctcttcaacaacgccaccagcgcgcgcgtcacggccaagaagctcgtcgtccacgagatggactcctcctacaaccaagcctacatggcctagactcctctcttcttcttcttcttcttcttctccattattacattattgctgcttacttgtaaatcatttttgacgccgccgcctgctgctagctgctggcctggccttcagaattttatctctttgcttcttttttttttttgtctctgctttaattttgtatctcgatcgatctcgaccgatcgattaattactatatctccatgaagaaatgcatggatgatggatcatggatggatcgctcccttcgatccaactgtacctaggggaagaagatgccatggtcaagcaatacttctgtaaatgtttcacatgagtcaagatttatgcagagttataatatatatgtttctctctc

SEQ ID NO: 3166 - DNA, 2080 bp, Oryza sativa
  Clone ID: PAT_MRT4530_27686C.1
tttgtgttttacatcaaaaagctttgactgtttgagtatgagtatgattaccatcacaaaaaccacagggagcaaaccaccaacaagcgccgatccacagaagtaaatcaaacccgtatatatctggagtactagcgtatagggcccccccaatcccaaggccaccgaggtgaccgtgcgcgccacgacacacttacacccctcactgtactccactaagcccacgaggccacgacccacactgtgcgcgcgcgcggcattttgaccgaacaaaagctgaagcttgacactgttcttcagacttcgaaagaatctgcagctcataaagccggagcactttcacatttcgagccactgttcccagcgaatcaacgactttagcaatagaaacactcccgccctcgcgcacgctgttctccgcgaaccgcacgctggccgcgttgaaacccttctcgcgctcgtgatccgaccactcccggctgtagtactcctccgccgtggcccccttcctcgggcctacgagcatgccgccccactgcgggaagtagatgagcatgacgggcagcgtgcacgcgatgatcatgagccccatgtacttgatcccggtctccgtcttgtactttgtgccgtggaagaagatgtactgcgtcagcacggcgcccacgttgcccccgccgccggtcatcccggagatgagccccagcgacctccgcgacacgaacggcacgatgccgaaggtgagcccgcacgcggcctggacgaagaaggagaagagcaccatcacggcgacggacgcggcgaaggagaagtcgacgattccgagcaccacgcagaggacgccgccgatggtctgcacagtccacagcccccacagcctgccgcgcatgccgtaccggctggagagccagtcggagagtagcccgccgccggggcgggagatgatgttggccatcccgaagctggcggcgatgagcccggcggtctggaggttgacgtcgaagcggtcgtagaagtactggtgcacgacgttgtcgatggtgagctcgacgccgaagctgtagccgtaggtgagcgccaggatccagccgcggtagttggtgagggcgtggcgcagcacgttgccgaagctgtccttgtgcatgtcgccagtcttgtggagcttcccgtagttgccgccgggcatgtcctgcccgaacgccagcacggcgatggccgagaacgtctgcatcaggcccgggatgaagaaggcgatgcgccacgccgtgaacggcgtgctaccgatcttgtggatggcctcgtacacgagcggcatgagcagctggacggcgccgccgccgaggttgccccagccgccggccacgccgttggccagccccactttgggggccgagaacatggagctcatccagaactgcgccgacacgaacgacgccagcgagatgcccgtgaagaagcgcacgaggaggtaccccgacggggactggatgatggaggagcagtacaccgccggtgtggtgaggaggatcagagacgcggaggccagcctgggcccgaccaggtcgcacgccgtgcccatggccagacgcgcgaacacggcgcccgacacggacgcgatcccggcgttgccgatgtccgtggccgtgagcccgagggtgtcgcggatgagcggcagcagcggcggcgcggcgaacgtggacacgaagcagcagaagaaggagaaccacgccatgtggaaggaggccatgtgtggcctcgcgaaggagaagagccagaactccgtcgccttgaggtcggagtccaccggcatcctgaaccgcggcttgccccccgccgcctcgaccccctccacctccatcgccaccggcttagcctccatctccaacacgtggtagcaaggctagcagcttagctagtgactgtgtgtacgtacatccgctgtgccctgcgcgtcagctcttatagcatagcggaaagcgcggctccggcagcgcggcgcggcgtggcgcgatggttgggtgcggcgagagggcaaccggtggagagaaaatgaataaagatttcgaacgtgatcttacgcgac

SEQ ID NO: 3167 - DNA, 2481 bp, Oryza sativa
  Clone ID: PAT_MRT4530_27817C.1
gcgaccggccgtccagacggagaagcgagaggggaagagcaccgacctcgacctagctaattaaggcgcaacacagaaaccctcaccgccgcccgcatccatggcggaggagcacgagacgaggccgccgtccgccggaaggccgccgtcgtccggccgcggcagggccgacgacgctgacgagagggaggagggggagatcgccgacgacgactccggccacgcgccgccgcaggccaaccccgccgcgccgcacccgctcgagcacgcctggaccttctggttcgacaacccgcagggaaagtccaagcaggcaacctggggaagctccatccgccccatccacaccttctccaccgtcgaggacttctggagcctttataacaatatccatcacccaagcaagttggttgtgggagctgacttccattgctttaagaataaaatcgagccaaaatgggaagatcctatctgtgctaatggaggtaaatggaccttcagctgtggcagaggaaagtccgacacaatgtggttgcatactttattggcaatgattggcgaacaattcgattatggggatgaaatttgtggagcagttgttagtgtgcgtggcaagcaggaaagaatagctatctggactaaaaatgctgccaatgaagctgctcagataagcattgggaagcagtggaaagaatttctggattacaaggactcgattgggttcattgttcatgacgatgcaaaaaagatggacaaaggtctcaagaaccgctacacagtttgatctgagcactcctgtccagatatccaagagagtagtatatccacatgtaggatgggttttcttcgatgctttagtgtttgtcattcgcttgtagcgagcgcttgaaggctataatattgccgtgaactgtttaaacttgaaacgtaatataatgacgtatcagaggtgtctctgtactctataaatcagtccagttcttcccttgtaactctgatgtcggctgtgatccctcaaaggttggcacggataatggcgctcaaccatgccaatatcaagttgttgtatcagaatattccgctaaaggttcttcagcaaatatttctgaggttacgtctgctgatccatccgaagtcacaaggatatttaccatggggctgccttatacgtctcagcatggaggtcagatcctctttgggcctactgacggatatctctacctcatgatgggggatggtggaggaaagggggacccttttaatttctctcagaacaaaaagtcgcttctgggaaaaattatgaggcttgatgttgataatccaccaagtaagtcttccagtacaggacagagtgaaattgctaaccagagcttgtggggtaactactccattccaaaagacaacccatacactgatgacagtgacttagaaccagaagtttgggcattgggtcttagaaacccatggagatgcagctttgattccgcgaggccttcctacttctactgtgccgatgttggtcaggatcaatacgaagaagtagatttgatctccaagggtggaaactatggatggcgtgcatatgaggggccacttgttttcaatccaccttcggcacctggagggaacacttccctcaattccataaacgccattccccctatcatgggctacagccattctgatgtcaacaagaagattggatctgcgtcaataataggtggtaatgtttatcgaggatctaccgacccctgcttggtcggaaggtacctatacgccgatctgtatgcatcagcgatgtggaccggcacagaggctccagagagcagcgggaactacagctcgagtctgatctccttcagctgctccaagagttctcctatagcgtgtgacactgctgctggaagccccctcccatcacttgggtacatatactcgtttggcgaggacaacaacaaggacacctacgtcctgtcgagcaagggcgtctaccgggttgtgcggcccagcctctgcggctacacctgtccaacagagaaacctgcgacgaacactgggacgacgacgccttcgtcagcggcatcatctagtatcttatccgatgttgagatcaatggtttttatttagaattaaaggtgttgcaagtgagtttgccagattcttcgatgttcgtgcctgagattctgaagtttgttatggatgcattgttggactgtccggataggttgctagattgctatccaaatgtttcagttgcctatcgaattctcttaactgtacctatgacggtagcttcagctgaaagaagtttatcaaaattgaggttgttgaagaactatttgagatcaactatgtcgcaagaaaggttaaatggcttggttatgtgctctatcgagaatgatatcttggacactattgatcttaataccgttcttgatgattttgcatcaagaaatatccaaagaagtatcttttcataa

SEQ ID NO: 3168 - DNA, 1154 bp, Oryza sativa
  Clone ID: PAT_MRT4530_28152C.1
cgggctgcaggaatcggcacgagggcgacacttcttcgcagttcgcgtcgcgcacacactctccctttgcctcgcgcagaggcggccgcgccttctccgccgcgaggcatggccggcgccgccgccgccgtggaggacgccgggatggacgaggtccagaagcggctcatgttcgacgacgaatgcattttggtggatgaacaagacaatgttgttggccatgaatcaaaatataactgccatctgatggaaaaaatcgaatctgaaaatctacttcatagggctttcagtgtattcctgttcaactcaaaatatgaactcctactccagcaacgatctgcaacaaaggttacatttcctctagtttggaccaacacttgctgcagccatcctctgtaccgtgagtctgagcttatacaggaaaactaccttggtgttagaaatgctgctcagaggaagctcttggatgagctgggcatcccagctgaagatgtgccagttgaccaattcacccctcttggtcggatgctttacaaggccccatctgatggaaaatggggtgaacacgagcttgactacctgctgttcatcgtccgcgacgtgaaggtagtcccgaacccggacgaagtggccgatgtgaaatacgtgagccgtgagcagctgaaggagctcatccgcaaagcggacgccggagaggaaggcctgaagctgtctccctggttccggctggttgttgacaacttcctcatgggctggtgggatcacgtcgagaaaggcaccctcaacgaggccgtggacatggagaccatccacaagctgaagtaaggactgcgatgttgtggctggaaagaatgatcctgaagactctgttcttgtgctgctgcatattactcttaccagggaagttgcagaagtcagaagaagcttttgtatgtttctgggtttggagcttggaagtgttgggctctgctgactgagagattcccttatagagtgtctatgttaatttagcaaacttctatattatacatgattagttaattgttcggtgtctgaataaagaacaatagcatgttccatgtttatttgctacatatatgatgatgatgatgccattccctcgtaaaaaaaaaaaacaaaaaaacagcggccgc

SEQ ID NO: 3169 - DNA, 512 bp, Oryza sativa
  Clone ID: PAT_MRT4530_28392C.1
taataagcggatgaatggcagaaattctatagaggatggatgaagttaaatgttgacgggtttttgatgcaacctcaggaactggaggtctaggtgctgttctcaggaatagtttaggctctgtcattttgtcatttttttcagcctgcggttctatggagagatgtagcagccctcttgaagctgaacttttggcttgcaaagaaggcatcaatctagctctacaatgggctctgctgccgctcattatggagtcggattgtttggtcgctatcaatatgatccagtcaccagggagggagatgtcccagcttgcttaccttgtcagggacatagaagagctgctggcaggcgatagagtggtcagcattcagaaagttcagcgatgccagaataacataagccactttttagctaatagaggccgcactaattttctttctgagttctggccagatggctcttgtaatctcatttcacagtttgtgaatgaggaagctttaaatgagtaa

SEQ ID NO: 3170 - DNA, 359 bp, Oryza sativa
  Clone ID: PAT_MRT4530_28680C.1
gctgatttttcaagacaaaaacaagtacaacacacgggggggctatttgtagtgcgatgtaccatcaaggacatcactggccaaatcatatctgctagtatagcgggtgatatggatcttgcttctgcctactcgcatgagttgccacgatatggtcttgaagctggcttgaccaactatgcagctgcctactgcactggccttctgttggctcgccgtgtgctcaagatccggggttcggatcaggagtacaagggcaatgttgaggccactggtgaggacttctttgttgagccagcctatgagaggaggcctttccgtgctctcttggatgttggccttatcaggactacaacagg

SEQ ID NO: 3171 - DNA, 2283 bp, Oryza sativa
  Clone ID: PAT_MRT4530_29154C.1
atgcagcagcaccagggtggcgggtcccagtacggggccgtgccgccggacatggggccgttctcgccgacgcatcatgcttcggcgccggcccccctgccgctgagcagccggccaccgccggcggcgttgtctcagccaccgccgccgcagcagcagcagcagcaaccgaggacgagctacgacgagctggccgccgcgaccagcgccggcgcgggcggcttccccgacgacgacatgctgggcgacgccggcggcagcggcggcggcggtgggtcgggagcggccggcaaccggtggccgcgggaggagactctagccctcatcaggatccggtcggagatggacgccaccttccgcgacgccaccctcaagggtcccctctgggaggaggtctccaggaagctcgcggagttgggctacaagagaagcgccaagaagtgcaaggagaagtttgagaacgtccacaagtactacaagcgcaccaaggaagggcgcgccgggaggcaggacggcaagagctaccgcttcttcactgagctggaggcgttgcatgccgctgcgccgcagacgccccagccgcagcagcagcagcagcagcagttgccgccggttacaagcagcgcacccgcgatgcacgccttcgcgccgccggttcccgcgccaccgccgatgagcgcaatgccaccgccgccggggccgatccagccggccccgatatcttctgcggctcccgcggtgcccctggagctgccgccgcagccgcccatcaacctgcaaggcttaagcttctcgtccatgtcggggtccgagtcggacgatgagtctgaagacgacgagatgacggcggagaccggcggcagccaggaccgcctcggcaagcgcaagcgaggcgccggcggcaaaaggctggcgactttcttcgaggggctcatcaagcaagtcgtcgacaggcaggaggagatgcagcggcggtttctggagactatggagaagcgagaggcggagcgcacggcgcgggaggaggcgtggcgcaggcaggaggtggcccgcctcaaccgcgagcaggagcagctcgcccaggagcgcgccgcggcggcctcccgcgacgccgccatcatctccttcctccaacgcatcggcggtcagtccgtacaggtcccacccgccgccaccgtcatccagatgcccacaccggtgcagctccagacccctccgccggtcaagcaacctgccaggcagcaccagccacagccaacgccgccgccgccgcaggcggcgccaatcccggccgcgcccctccagcagcaaccgccgcagccgcagcacaaggagacgattccccccgaggcagtgacgccgcgcagggcgccaccgacgtccggctcatcactcgagctggtgcccgcggcggagcagcacgtcgagagcgggctaggaggaggggagggcgggtcggcgtcgtcgtcgcggtggcccaagacggaggtgcaggcactcatacagctgcgcatggagctcgatatgcgctaccaggagaccgggccgaagggcccgctctgggaggagatctcgtcggggatgcggcggctggggtacaaccggagctcgaagcggtgcaaggagaagtgggagaacatcaacaagtacttcaagaaggtgaaggagagcaacaagaagcggcccgaggactccaagacatgcccgtacttccaccagctcgacgtcatctaccgcaggaagcacctcaccggcggtggcggcggcggcgcttccgcggccaatgtcgccgccacggcaatcgagcaccagaacccgaaccggcacgagatagaggggaagaacataaacgacaacgacaagaggaagaacggcggaggcggcggcgcgcaggtgcccaccagcaatggcgacacggcaccgaccacggccacgttcgacgtcgatagcggcatgaagaagcgtttcaagctcaatatgcgaatgttcgtgcggaagctaaccggaaatccgcttgccgtgaagccagaagacattgtgagggagctgagcgagcagccgccccgggagttcacaacggacgagaccgacagtgacgacatgggcgatgactacaccgacgacggcgaggaaggcgaggacgacggcaaaatgcagtacaggatacagttccagaggccgaacccgggcggcgccaacaccgcacctccgccggcgacaaccccggcgtccgcggtgccaacctcgactccgacgagcaccttcctcgccatggttcaatag

SEQ ID NO: 3172 - DNA, 1499 bp, Oryza sativa
  Clone ID: PAT_MRT4530_29234C.1
cggacgggtccatctcgtcaacaaaaaggcgcctctaagaattcctcccaaactttttggtgttgtcaagccgtgcgtttcggggtacatcaacggcggcgatgagctcccggatggccggatcggcgatcctccgtcacgtcggcggcgtccgcctcttcaccgcgtcggcgacctctccggcggcggcggcggcggcggcggcgaggccgttccttgcaggcggagaagccgtccccggggtgtgggggttgcggctgatgtccacgtcgtccgtggcgtcgacggaggcggcggccaaggcggaggccaagaaggcggacgcggagaaggaggtggtggtcaacagctactggggcatcgagcagtcgaagaagctggtgcgggaggacggcacggagtggaagtggtcttgctttaggccatgggagacctacaccgcggacacttcgatcgatctgacgaagcaccacgtgcccaagacgctgctcgacaagatcgcctactggaccgtcaagtcgctgcgcttccccactgatatcttcttccagaggaggtatggctgccgcgcgatgatgctggagacggtggcggcggtgccggggatggtgggcggcatgctgctccacctccggtccctccggcgcttcgagcagagcggcggctggatccgcacgctgctggaagaggccgagaacgagcgcatgcacctgatgaccttcatggaggtggcgaacccaaagtggtacgagcgcgccctcgtcatcaccgtccagggcgtcttcttcaacgcctacttcctgggttacctcctctcccccaagttcgcgcaccgcgtcgtcggctacctcgaggaggaggccatccactcgtacaccgagttcctcaaggacctcgaggccggcaagatcgacaacgtccctgccccggccatcgccatcgactactggcgcctccccgccaacgccacgctcaaggacgtcgtcaccgtcgtgcgcgccgacgaggctcaccaccgcgacgtcaatcacttcgcatcggacatccattaccagggcatggagctgaagcagacccctgcgccgatcggatatcactgaggatgtttgtctactgccgaggatttgcatcactaataatcaaatcaaatgagtatacttcgtttttcagggaaagcaaatgagagctctttagctgtatcggatttggtaattgctactagtaactactaagtactgaaaaataaggagtctccttgtttgaagtacaaatctaggagattttttgaaccaactctatctgaattgggcctgtttttcgtacgccgcactgcttcatgtacatatattccatcccctatcttatgtgtggcaagtgtctttctaaattcttggatgtaatgacacctgaatttctttcgttgaactattggcagctgagttatatatactacataccattcttttgttaaaaaaaaaaaaaaaaaaaaaaaaaaaaaa

SEQ ID NO: 3173 - DNA, 2007 bp, Oryza sativa
  UNSURE (1)..(2007): unsure at all n locations
  Clone ID: PAT_MRT4530_29468C.1
  unsure (1)..(2007): unsure at all n locations
ggacgnncngnccgngagcttggctgagcttgagctgagctgagctgatcggcggcggcaatggcgggcggcgcgatggtccagacggtgggtggcaagacgtacccggggaagatgaccgcgttcgtgttcttcacctgcctcgtcgcctcctccggcggcctcatcttcggctacgacatcggcatctccggcggcgtcacctccatggactccttcctcagcgagttcttcccgtcggtgtacgcgcaggcgaaggcgagcaaggacaccaaccagtactgcaagttcgacagccagctgctgacgctcttcacctcgtcgctgtacctggcggcgctggcgacgtcgttcgtggcggcgtgggtcacccgggtgttcggccggaagtggtccatgttctgcggcggcgtcaccttcctcgccggctcggcgctcaacggcgccgccaccgacgtcatgatgctcatcctcggccgcatcctcctcggcatcggcgtcggcttcgccaaccagtccgtgccgctctacctgtcggagatggcgccggcgaacctccgcgggatgctcaacatcggcttccagctcatgaccaccatcggcatcctctccgccaacctcatcaactacgcgacgtcgagcatcgagggcgggtgggggtggcgcatcggcctcggcctcgccggcgtgcccgcgctcatcatcacgctcggcgcgctcgtcctcccggacaccccaaactccctcatcgcccgcggctacgccggcgacgccaagcgcgtcctcgtcaagatccgcggcacggacgacgtccacgacgagtacgacgacatggtagcggcaagcgaagaagccgcctcgatcgagcacccatggcggaacatcctccatcgcaagtaccgcccgcagctcaccatcgccatcctcatcccgtgcttccaacagctcaccggcatcaacgtgatcatgttctacgcgccggtgctcttcctcaccatcggcttcgccggcgacgcgtcgctcatgtccgccgtgatcacgggcctcgtcaacatgttcgccaccgtcgtctcgatcatctccgtggaccgcctcggccgccgcgtgctgttcctccagggcggcacgcagatgttcatctcccaggtggtggtcgggacgctgatcgcgctccagttcggcgtcgcgggcgtcggcgagatgtcgcggtcgtacgccatcttgctcgtgctgttcatctgcatgtacgtggccgggttcgcgtggtcgtgggggcccctggggtggctggtgccgagcgaggtgttcgcgctggagatcaggtcggcggggcagagcatcgcggtgtgcgtcaacatgatgctgacgttcgtcatcgggcaggcgttcctcaccatgctgtgccacctcaagttcggcctcttctacttcttcgccgggtggatgctggtcatgaccaccttcgtcgcgctcttcctgccggagacgaagggggtgcccatcgaggagatgaaccacgtctggagccggcactggttctggggcagctacgtcaccgcccacgacgtcgccggcgccggcgccggaggaggaggaaaccgcagaagccacaacgtctagctcttacatatactattaccgtttacgagttacgcgagagagagagaattaatgggtaggttgtgtaattaggtaatgcaagaattaattaaaccaattaatttcaagggacaggtttttaattaattaattaattcggggaggggggagctttagaatttggtcggggcaggttaatttcagggtatttgttgtatagattttgaattttataggtgttttctttttatgaaattcttatgtagtaaattctttggagagcgcttcaaatatcgcatggtgttgccgcgcatgtaaagtactgtttctctaaccaataaaaaatgtttcaacaaaaatgtatcagttatgtgtatcttgaaaataaaaaatgtttcgtttctcttt

SEQ ID NO: 3174 - DNA, 2032 bp, Oryza sativa
  Clone ID: PAT_MRT4530_29514C.1
cactcctctcccctccccacgcaaccgccttcctccgccgccgccgacgccgacgccgacgccgaccccttctcccaatctgcggattccagcgggggtcccccccccctcccaccggcggcgcccggtggtcgtggtcgtgggggaggggagtcaacgaacgagccgagccgcccgcttgccggagctctctatctatctctctatctctatctctatccctccagattccctcctccatcgaatctctgatatttggagggagcgactcgacgcagcatcgcatcgtaaggaaggtcccctccactgtcgatggatcagcaccagctcgacgaggagaaccagagagccgcgctcttccactcctctgccccatcttcctctttgggagctgacggggaggaggagagggagactgtgccgctgctgtcctgcaagatggccgacgataaatctgacactgtccaggtctccgaggatacggcgcaccagattagcattgatccctggtatcaagttggattcattctgacaaccggggtgaatagtgcatatgttctgggatattctgcatcaatcatggtccctttaggctggattggtgggacatgtggcttgattctagctgctgcaatatccatgtatgcaaatgctcttcttgctcaccttcatgaagttggtggcaaacgccatatcagatacagagatcttgctgggcacatatatggtagaaaaatgtattcgcttacatgggctctgcaatatgttaatctattcatgatcaacactggccttatcattttagctggtcaagccctgaaggcaatatatgtattatttagggacgatggagttctaaagctaccctactgcatagcattatctgggtttgtctgtgctctttttgcctttggaatcccttatctgtctgctctcaggatttggttgggattatcaacagttttcagtctcatctatataatgatagcatttgtcatgtcgcttagagatgggattaccacacctgcaaaggattatactattcctggatcacattcagatagaatcttcactacgataggtgctgtagcaaaccttgtgttcgcttacaacactggaatgctcccagaaattcaagcaaccataaggcctcctgtggtcaagaatatggagaaggctctatggttccagttcactgttggttcgttgcctctttatgctgtcacctttatggggtattgggcgtacgggtcctcaacatcaagctatctactgaatagtgtgaagggaccaatttggataaaaactgtggcaaatttatcggcgtttcttcagactgtcatagcattacatatatttgcaagcccaatgtacgaattcttggacacaagattcggcagtggacatggtggtccttttgcaatccacaacataatgttcagagtgggtgtcagaggaggctacctgaccgtcaacaccttggtggccgcgatgctccccttccttggcgacttcatgagcctgacgggtgcactcagcacctttcccctgacattcgttcttgcaaatcacatgtacctcacggtgaagcagaacaagatgtccatcttcaggaaatgctggcactggctgaacgttgttggcttcagctgcttgtccgtcgcagctgcggttgctgcggtgaggctaatcacggtcgactacagtacataccatttgtttgctgatatgtgaggctggaaagtgcaagcatgcagccctggatcagctgtaaattcgtcctcttcttttttatttttttggttaggggatgcatgtaggtcgatagaatgatggagattgcaataaataatttggctaaaatgttgtccagatttggttgtttgaggtgcaagatgtttgcctcaaaacgtaccgctatggttcactttttaagaactgtactgctacctctgtttgcggagatttttgtctgcaggcatgcaggatgaatattattcaagtgctctaaacgaggatccgggtaccatgg

SEQ ID NO: 3175 - DNA, 1804 bp, Oryza sativa
  Clone ID: PAT_MRT4530_29596C.1
ccgcggctgttgttttttttttttttttttttttttttttgcaaccttttatcttatttaccaagggaaagaaaggagaatgtataatagagaagctaattactgtacattatttagtgtacctcttcttcacataactactgtagttaatactacagtgtgtgccttagctttttatatggatcactatctgcctaaacatttctcactgcaataataatagtaaaccaccaattacaagacgaaagaacagtacaatttaggctggttcataaattttgcacaggagtttcttctgatgttggagattctgtttctgcaggcttcagaaacttcaggatatccatttttgttttctcagtacagcctgatccttgtggttatatgctgctggcacatagggcagcgcaccaaattcttcccgcattcataacaggtctgatgtccacatccaaatgcaagatcctttgatttatccatacagatagcgcacaaaagtcttccttctaaagaactttccgaggtataagtgtcaggtgcagtggtagccacaggctgtctctgtttgaagctttcagattgctgaaagccacttgtttgtgggccgaagctactagatcgtgaataaacaccagaatgttggtcaaagctagtagacctcgaataagcattcctcataggtggcggcagaggaattcttggctgtattctttggcgacggcctagaagttggagatcaagtgttgccttgtattgtgttgggatttccatcaaggcggatagtgcaaattctgcctccttcctgtcagctgctatgctctttgacatgatgtccgtgaaattcacaaactggaaattgtcaaatgagcgagcaggtatattgtcatcaaactgatgcatcatgtcccatggtccatcacccaccccaacaagaacaatagacaaggggaactggctagcttttactatagcatcaatcgtatcacgctcctgcgggcttaactgcccagactgtgtatcaacacttcgagtaacctgtccatcggctattatcagaagaacatgatactgaccaccagtgctgtctacaataccaattgctgtttcaatcatcggggcaaaagatgttggtccagctaatcgaagagtcggaacaatttctctgtatctttctaatgcctcttcaaatccgttgcatgggcggttctctggataaaagctgaatacctcctgatcatgagttgatgcgtcaccaaatccaaagcaaggaatcaaattatcttcatcaaaagctgaaagtgtccttccaataatagatattgcttgctcatatggatttggagtgtttccaatatcatgcagacatcggcgattgaaggaaagtttacctgtccattcattgctctttgtaaaatcaatgcctacaataagatttgatgattcaagacctgcttgtgccaaagcttcagtcacttgattcagagagcggtagtcatcaccaatcctcgagtacttcctctgcaacctggcatgcgtttctggctgcacatagttctccatagaaggagcataccttgtgttctgactggaagatgcatttgcagggtatgcagggtatctcgagttatatcccgatgatgaattcccatgatcatatgaagaagaatagctgtatgagggcttggagtcctttgcccccatttctcacctcagttgaattccccctgctacgcggcacgcctccgctccacgacgagagaggccccgaggaagacgacgacgatgagcgagcgagcgagcggag

SEQ ID NO: 3176 - DNA, 2023 bp, Oryza sativa
  UNSURE (1)..(2023): unsure at all n locations
  Clone ID: PAT_MRT4530_29796C.1
  unsure (1)..(2023): unsure at all n locations
cggggggcttggtgttttttttttttttttaaccacgtagacacagcatactgcagttttctttttcattttgcattttgcattcttgctttaacaggggggaggggggacaaatgcaggtgctcgacaaagcgaatgatagtctgatacagcacacacatggcttgcttgatgacccagtatcatatactggaattcataagttgctattgccatgcaaggcttattgtaaaaccgtaagagcaactgtaaaaaaaattctgtccgtccgttctgaatgtacagggttgatcttgctttcaggtaatgacgtgctccgtcgctcttgacacgaatgacaaatctacagcttggatggaggccggtaccatccgtatggttcatctgagcagtacttggtgacttgcttcacgctcaagtagttatcgaggccccactgtcctagctcccggccaaaaccactccgcttgttccctccccatggagcttgaacaaagcatggttgcgagcaatttatccaaacgatacctgactggatagcctttgaaatgcgctcgcacctctctagatcattggaaatcacagcgccagctagaccatagtgagtatcatttgcaagttctactgcttcacgctctgtcctaaattctttaacgcagatgaccggtccaaagacttcctctcgccaaatttgcattgatgtgctaacatttgttataatagtaggctcaataaagaacccccttttgaggtgttgtggtcgggcacccccatatagaattgtggcaccttcacatcttgctgttgagatgaacttcattattttttgatactgcccttcactaacgactgaccccagcctgcaaccttcttctagtggatctgagattttgatactctttgcccatgcaaccaacctatccaagaatcgctttgcaattttctcatgcaaaagtagacgagaagtagcactgcagacttgaccagcgttcgcaaaacacccaaacatggcccactcaacagctttatcaatatcaacatcatcaaagacaataagaggacttttgccaccaagctctaacgaaacaggcttgaccatttgggaagcagtaatcattatcctcttaccagtttctgtgcttccagtaaaagcaatcttatccacatggggatgtgaagctaatggagcaccagcttcagtgcccagaccagtaattatgttcaagactcctggaggtaatccaatttctgcacatattccaccaagctctaaacatgtcagggaagcaagctcagatggctttaatacagctgtacacccagcagccagggcaggtgcaaccttccaagtagccatcagcagaggataattccagggagtgataagtccaacaaccccaatgggttctttgagtacataggactcaaaattttccatgggtagagagattggtgcccgttgtttcccatctaaagcttctgccagatcagcataatactcaaagcatgcagcgacatcctccatgtccccagctgcttcatccagaggcttcccagaatcaagagtctccaacaaagctagataagatttcttatctttaatcttagcggcgatcgccttgaggtacttggcccgcacggccccaggcgcgcgcgaccagtgtctcccaccgtcgcggccgaacgcatccctcgccgccgacaccgcgagctcgacgtcctccgccgtggccgccgggatgtcaccgatggttgcctccgtggccgggttgacgacggggaggcggcggccgagggacggctcccgccacccgccgccgatgaacaggccgcggcgggggatcgccgacggcgcggccatggcttccggttggggggcggcgcgagctgctgctgctgctgctccgctgtcgccgcggccttttgggttgtcccggaccttgggcgatcgacgacgagcactctctctcaccgattgatgagagcaaaaaaaagcggacgcgtggtcgacccgggaantccg

SEQ ID NO: 3177 - DNA, 379 bp, Oryza sativa
  Clone ID: PAT_MRT4530_30009C.1
tttttatccattcttctccagcttccacttccgtggatgcttccacgtagcagtcacagaacgcgatcgacatgggaaggtttgccacgacctagaagacccatgcctacttcaagcgtttgcacagtaagttcaagagacaggaggcagggcacgactgactacagggcacaggattaggctgagcaaccaagataagaacaaggccaacacaccggcgtaccgctttgttgcgagatgtacacacaaagatcttacatttgagattgtatatgctaccattgaggatgatatcgtgatggctgctgcctactgccatgagcagcctcgttatggtctggaagttggtctcaccaactatgcgagagcttactgcact

SEQ ID NO: 3178 - DNA, 282 bp, Oryza sativa
  Clone ID: PAT_MRT4530_30384C.1
atgaggaggtttctgccggtggggggaggaggaggaggaggggtggagccgtcgtcgtcgtcgacgacgccgcagcgaggggaggcggaggcggcggggctgcggttcggtgggggggacatctcgctgggcccgcacggcggcggcggcggcggcggcggagggggcggagggcatgggcatcagctgcaggacgggagcgtggacttgctggcgcggcacagcagctcgccggccggattcttctccaacctcatggccagcaacggagagaacggctag

SEQ ID NO: 3179 - DNA, 5332 bp, Oryza sativa
  UNSURE (1)..(5332): unsure at all n locations
  Clone ID: PAT_MRT4530_3082C.1
  unsure (1)..(5332): unsure at all n locations
aatctataaaaggcgcagcccgtcgtcgagccctctcatccctcttctttgtctgatcgatcgattgcttctccctcctctcgctactagactagagagtaggtagagctagctttctagctcgtggatcgttaagtttgtagtcctgcccgggcgccggcggtgaggtcgcgatggccggcggcgcggtggtgagcacgggggcaggcaaggactaccctggcaagctcaccctcttcgtcttcttcacatgcgtcgtcgccgccaccggtggtctcatcttcggatatgacatcggtatatcaggtggtgtgacgtccatggacccgttcctgaggaagttcttcccggaggtgtatcggaagaagcagatggcggacaagaacaaccagtactgcaagtacgacaaccagctgctgcagaccttcacctcgtcgctctacctcgccgccctcgtctcctccttcttcgccgccaccgtcacccgcgtcctcggccgcaagtggtccatgttcgccggcggcctcaccttcctcatcggcgccgccctcaacggcgccgccgagaacgtcgccatgctcatcgtcggtcgtatcctcctcggtgtcggcgtcggcttcgccaatcagtcggtgccggtgtacttgtcggagatggcgccggctcggctgcgggggatgctgaacatcgggttccagctgatgatcaccatcggcatcctggcggcggagctgataaactacgggacggcgaagatcaaggccgggtggggatggcgggtgagcctggcgctggccgccgtccccgccgccatcatcaccctcggctccctcttcctcccggacacccccaactcgctcatcgacaggggccacccggaggcggcggagcgcatgctccggcgcatccgcggctccgacgtggacgtgtcggaggagtacgcggacctggtggcggcgagcgaggagtcgaagctggtgcagcacccgtggcgcaacatcctccgccgcaagtaccgcgcccagctcaccatggccatctgcatccccttcttccagcagctcaccgggatcaacgtcatcatgttctacgcccccgtgctgttcgacaccctgggcttcaagagcgacgcgtcgctcatgtccgccgtcatcacgggcctcgtcaacgtcttcgccacgctggtgtccatcttcaccgtggaccgcctcggccgccgcaagctgttcctgcagggcggggcgcagatggtggtgtgccaggtggtggtggggacgctgatcgccgtcaagttcgggacgagcggcatcggcgacatccccaaggggtacgcggcggtggtggtgctcttcatctgcatgtacgtggcagggttcgcgtggtcgtggggcccactggggtggctcgtccccagcgagatcttcccgctggagatccggccggcggggcagagcatcaacgtgtcggtgaacatgctcttcaccttcgtcatcgcgcaggccttcctcaccatgctctgccacatgaagttcggcctcttctacttcttcgccggatgggtcgtcatcatgaccgtcttcatcgccctcttcctccccgagaccaagaacgtccccatcgaggagatggtgctcgtctggaagtcccactggttctggcgccgattcatcggagaccacgacgtccacgtcggcgccaaccacgtctccaacaataagctccaaccataatccgctcacgaatatcgtcgtccatgtctccgtcacgccctatattcttcttcttgtgttcatccccgtgtacagtagatgccttttattagtttgttttgttttgcctagtcagtcttcaatcttaatgtacgtgtgtttcttgtttggccaaattgatcttaattgctgtacctttcactgtcaaagagcgtcccttgttaccattatcacacggaaagattaatcaattaatttcactctgtatgtacagcaagaataacattagcagagtgtttacaggttgcccatctaaatattgttttgttcctcattagtcagcaatgaattattcaacacaatcaccatttgtcttccaatgtaatactactcaacaccatctaggaaaacatatcatacgaactgctgctgcagctgaaactcagcatattgtttgagctttatttaccaacaaattaaaagaaaacaggagagagcattggcagtctgaaaaacttattactgagcctttctctcgatctgaacatccccggcaccgccatattccatcagtctaggccctgaagctgccaccgccatgcttcggccccttggattcttcagaaaagagctcgaggcatgcccagaacgcgcatgccgtgaactctgtgccttgtaagaggatgtgctagccaccaacctcgaggatttacgatccgatctaccgctgcgatcggaacgatgggaagaagaaatcttgcgggtgtgccggtccgatacctcttttgagccagatgctcttataggatgcttgttgtagaaaccaaggtttggcaggagacctacaaggtacttcttcaggtgctcatcacctacattcttctgcgctgggttcccatctaggtttacggcttcaagagaactatagtttgcagccagctgaccaagccccttcgatgtggagatcttgttgtggcgcaggtccagaacctttagcttcagaagacggtgaagaccatctacctcactgatcttgttaccacccagatacaactccttcaaagaagaacaggacgccaaaccatggccaattctggatatcctattatagctgatgtccagtaagcgtaagcgtgtcaattctctaaggccctcaattgttgagatattattctttgacaagcttaacatgtgaagaccccttggaagagcccctgcagttattcgcacaattgaattcccagacaagttcaacaagcgtaggcctaagaaagcgctcaatcttggaattgcaaccaagccaaggtttcctaattgtgccgacgaagaagtcggagtcaatttcgaaatataagtgtaagctatctccatgccaagaggacttttagcatcaggccggacagcaggaacaccagccaccggctcattatattttgtcaacaccgagtttgaactttctccttgctcctcgacaagggtgccatcgtcaatatcaatttggttgatccaatcctcaattcttttaatgctaaaagttcttggggaaagttcatctgggtccacatcgaaatactggttgtcattaattccagttctgttgtgcttgagttcttcactaatatcctttgaatcacacaactttagatcactcgcatcaatgacaagtgatttgtggtagggagtgctatctctgttccacaagttatcttttctctcttgatctagagcttcattgatgccaccgtcattgttggaatggtgagaaccatcccctgtaccagagtagtagggggcaactggatcaactgattggtgaccgctcacatatttgttatcccaatattcatgacttagcatcccatccctaacaaaactttcttctgcacttgcagtagacctttgacccccatcagcagcatcagaacaacctattgaaccattgtcctcaaagttcattctttcatagacatctggagaagaaggtccagcacaatgcacatccaaatttgatttagagtgatgtggctcgacgctattcagataatcaaccttctcactaaccgctgaacacagatcgctattcagataatcaaccttctcactaaccgctgaacacagatcttcataagacctgcaacgaggccctagtatctcagaatcagcagaaccttctgtaccacaattggaattattctgaaatatagcagattgtgatcttggaaatttggtctggtcataacacaggtagtggctatcagagtcaacaacatggtcacctgaaggactgaccaagtcagacaaggcatcaaaagcattctcattgcccttagtgtttaacttagcagaatctccaacagctgaattgcttttcaaactagagcaatggcctttgtggtcacagtcaataatatcacattcagcaccttcactaaaatgatgatcatgatccttgtgaagcatgtttccaagagataggctcttctttaggtggccagactccttactgtcatcagagcatgcatatctgttcaagtcttcagatctccagcattcttgatgagacgatgggctagtatcatactgccggctaacatttgaatgatcatttacatctgtcaactggtttggacttgctgatccagcgttggacttcactgtttgatcctgagaatccatctgtgaaacagcaagcatggtatccttctgtgaagcaccgagaatgacttgttcagctggcagaaagtgttccctaagagcacaaaacgctttgaaaattgcaacagcaaggacgagatagaaatgaaaaggctttatgctcttatcgagtccatcgttggacgacccaatggcaacagttaatgagatacgagtacgagaggtcctggaccgaaagctccccagcactgtctcatctcgtgagcacatttgccctatgatgtgtggtactggtcgaggatgagaagcagaaaaacctanccataagtcaactctgatggcaatcacaagtacaacacaaacagagtcgacccaatcacattgctatatcaaaggactaccttcgatgagaactcagttcagcaaacgtgttacatctcaactattgttggaaattaaccataatcgaaaagaccctccaatgctcggcgtagtctccagatgtaagacgggcttttccccagaggcgaggttaagttggttgcagagtagttgcaaacccacacccacttagaggtgcgagatgtgcctgacctcttgatatctgccaggctggacgaaagattaaggaactagataattccagaaggatgcatatggttggcacaatccttcttcttccctctccgccttgtccgtccagaaaagaatccggctctaatggctaggagctagttggggtggtgtgcgctgcggcgaagagagtcaggagaacctacctcacctgtgattggatctgtaattatcaatctctctctctctctctctcgctgctgctgctccttcttcttgtttgggacttggagaccgaccgggtaaaggaaaggaagtgtttcttcgttttatttatttatttccctttttttttctggtgatgaggaggagaccgaagagaagcagaagggaag

SEQ ID NO: 3180 - DNA, 1821 bp, Oryza sativa
  Clone ID: PAT_MRT4530_3088C.1
ggaccgaccccgaggctgaagcgacgccgccgccgcaagccgtccgccttgctcctcctcgccgagagcttggtcctcgccgtctcctctccccacgcgcagatctaagcctagggttagggtttgtgtagctcgcagcgatggcgatcaagaggaccaaggcggagaagaaggtggcgtacgacaagaagctctgccagcttctcgacgagtacaccaaggtgctcatcgccgtcgccgacaacgtcgggtccaaccagctgcaggagatccgcaagggcctcaggggcgactccatcgtcctcatggggaagaacaccctcatccgccgctgcatcaaggtgcacgccgacaacaccggcaacaaggagttcctcgagctcatgcccctcctcgtcggaaacgttggcctcatcttcaccaagggtgacctcaaggaggtccgcgaggaggttgccaagtacaaggttggagctcctgctcgtgttggtcttgttgctcctgttgatgtggtggttccccctggcaacactggtctggatccatcccagacctctttcttccaggtgcttaacatccccaccaagattaacaagggtactgtggaaattatcacccctgtggagctcattaagaagggtgacaaggtgggctcctccgagtctgctctgcttgccaagcttggtatccgccccttctcatatgggctggttattaccaatgtctatgacagtgggtcagtcttcagccctgaggtgcttgacctcactgaggatgacctgatggagaagtttgcttctggtgtttctatggttgcctcagtctccctggcaatctcgtacccaactattgctgctgcaccacacatgttcctcaatgggtacaagaatgtgcttgctgttgctgtggagaccgaatactcgtacccacatgctgataagatcaaggagtatttgaaagaccccagcaagttcgctgttgctgccccagttgccgccgacagtggtgctgctgctccatcggctgccaaggaggaagagaagaaggaagagcccgaggaggagtccgatggtgacctgggcatgagcctcttcgactaagcctcttgccatatcgctgcaaagttgaaagttttgtttcaagttctgaacatcgaagtttgtttttaatctttagcatattaattttctactagacaagaatgtatccaacaatggtatcgttaattatgcattttggttgtgcccgtaaaaaaaaaaaaaaaaaaaaaaaaaaaaaaaaaaaaaaaaaaaaaataaaactccctgttttgtgctatcctgtcccggagagcacggatatacaccaacatccctctttgtgctttaaattcgtcggtctctcgtttgctccagcggtggacgctccgccctcctcccgactcttctcagtgcgccttccggtggcatgccctgtgccccccccccctcctaccggtccctggggccgcccccctcagcacccacccgctcgtttgtacatctgaccttgttgccaatctctgtcatgttaattgcttactaggactaggcatggatgcagcaatgaagtacgaccttatgcatagtgcttttgccccctgggcatgagcctcttcaactaaacctggttgccatattgttgaaaatccaaactgtcttgctcatgctttcaacatcgtagcttttttatagtgtctcctatattaattttacttctccacaggtttgcatccaacagtcgtgtaataacttgtgcgttctgaatttactcgtcttgcatcacatccccctttagacaagt

SEQ ID NO: 3181 - DNA, 1519 bp, Oryza sativa
  Clone ID: PAT_MRT4530_3089C.1
aaaacccacacctcgcgcgccgccgccgccgcaagccgttccgccgccttgctctcctcctccccgacgccgagtcctcttcgtgtgagctcgcactcgcagcgcagcaatggcgatcaagcggaccaaggcggagaagaaggtggcgtacgacaagaagctgtgccagcttctggacgagtacaccaaggtgctcatcgccgtcgccgacaacgtgggatccaaccagctgcaggagatccgcaaggggctcaggggcgactccatcgtcctcatgggcaagaacaccctcatccgccgctgcatcaaggtgcacgccgacaacaccggcaacaaggacttcctcgagctcatgcccctcctcgtcggaaacgttggtctcatcttcaccaagggtgacctcaaggaggtccgcgaagaggtcgccaagtacaaggttggagctcctgctcgtgttggtctggttgctcctgttgatgtggtggttccccctggaaacactggtctggatccctcccagacttctttctttcaggtgcttaacatccccaccaagattaacaagggtaccgtggaaattatcacccctgtggagctcattaagaagggtgacaaggttggctcctctgagtctgccctgcttgccaagcttggtatccgccccttctcatatgggctggtgatcaccaatgtgtacgacagtgggtcagtcttcagccctgaggtgctcgacctcactgaagaggacctgatggagaagtttgcatctggtgtttcgatggttgcctcagtgtccctggcaatctcatacccaactattgctgctgcgccacacatgttcctcaatgggtacaagaatgtgcttgctgttgctgtggagaccgaatactcatacccacatgctgataagatcaaggagtatttgaaggaccccagcaagtttgctgttgctgccgctgttgctgctgctgacagtggcgctgctgctccagctgcttccaaggaggaagagaagaaggaagagcccgaggaggagtctgacgtaagatgcagatacgtgcatcaagctagacttccaatcctgaccgtcgattttagattggacggcagcggcgaggaggaggcggcggcgccgctgctgctgctgccggcggcggcggcggcggcggaggagaggtgcccggggtgcgtgcaggagcagaggaaggcgaggcgcggagggcggatcccctacacggagctcttcttcgtcgccgttaccacactcgcttcttttatcgccggagagatggacgagatgaagggtatcgatcacgaacatgctttaccaatcacgtgcctcttccctttcctctacttcatggtaagggacctgcaagtagcacaaacagaggaggacattgggaattatgctggatttctcggtgctctaaatggtttacttgcgccaataaaggttaacacagcatggggtttgggtctggttgttggtccagctcttggaggctaccttgcacag

SEQ ID NO: 3182 - DNA, 817 bp, Oryza sativa
  Clone ID: PAT_MRT4530_31692C.1
ggcgggaagaagcaacagtgagtttgaacagaacaacgcgacgacccttgcagcgcacgaccccgcggactcgatccagatctagggcttctcgtcggcggcgatggcgggcaagggaggcaaggggctcctcgcggccaagaccacggcggcaaagagcgccgacaaggacaaggacaagaagaaggcccccgtctcccgctcctcccgcgccggcctccagttcccggtggggcgtatccacaggcagctcaagtcgagggcgtcggctcatggccgcgtcggcgccaccgccgccgtgtactccgcggcgattctcgagtacctaaccgccgaggtcctggagctggccggcaacgcgagcaaggatctcaaggtgaagcgtatcaccccgcgccatctccagctagccatccgcggggatgaggagctcgacacgctcatcaagggcaccatcgccggcggtggcgtcatcccccatatccacaagtcgctcatcaacaagacctccaaagagtgatgcgaaaaaaaaaaaactccctcatgtgctttgcttgactcgaagtttggtgggtgttttactgttaatttgttatgttttctcatttgatttgatgtatttgtgctacagtgttcaatccttagtgggtttaggtgccttttagtcttttgaaattatcgtgacaatgttggttgcagctgaattcttgtgaattcttcactccgtatgctgttctgaaccatccatctcgatgcttcagttcagattatcttgttaatgtttaagatcagttcgattgaaaaaaaaaaaaaaaaa

SEQ ID NO: 3183 - DNA, 2022 bp, Oryza sativa
  Clone ID: PAT_MRT4530_31733C.1
tcctaatagtcagttcccgcgccgtgtgaccaatactcaacacttaaaccgcgcgctttttagccgacccgagcagccggagagtgaggcgaggcgaagcgaagggaagagcgcgaggcagagtaagcagacgagaagaacagcgcgcggcgcggtagctgaggagagtggtgcggagatggatcacgaggcggacgcgtaccggacggacctgatgacgatcacgcggtacgtgctgaacgagcagagccgcaacccggaggcacgcggcgacctcaccatcctcctctcccacatcgtgcttggctgcaagttcgtcgcctccgccgtcaacaaggccgggctcgccaagctcatcgggctggccggcgagaccaacgttcagggagaggagcagaagaagctggacgtgctgtccaacgaggtgttcgtcaaggctctcgtcagcagcggccgcacctgcgttcttgtctccgaggaggacgaggaagcgacgttcgtggaccctgcgctgcgtgggaagtattgcgtgtgctttgatccactcgacggctcctccaacatcgactgtggcgtctccatcggaacgatctttgggatctacatgatcaaagataaggagaatgtgactcttgaggacgtgttacagcctggaaaaaacatggttgctgctggatactgcatgtacggcagttcctgcacgcttgttctgagtactggaaatggtgtcaatggcttcacacttgatccatctctcggggagttcatattaactcatccagacatcaagataccaaagaaagggaagatttattcagtgaatgaagggaatgcgaaaaattgggacgagcctaccgcaaagtttgtggagaagtgcaagttccctaaggatggttcatcacctaaatccttgagatacattggaagtatggttgctgatgtccaccgtacgttgctatatggaggagtatttttgtaccctgcagacaagaagagcccaaatggaaaactccgtgttctgtatgaagttttccccatgtcattcctgatggagcaggctggaggccagtctttcacaggcaaagaacgggctcttgacctcgttcctaccaagattcacgagagatccccaatatttcttggaagcttcgaagatgtggaggagatcaaagggttgtacgctgcacaggcgaagtaagctcggtttgatcgatctggcaccatcaaggcgtgcgaatggactccctggccttactgtaacatgcatgattcgtcaggcacttcttttattcgtcttactgtacgtttgtaaaattcagtgtaatagtgttgaggcctggaacagcttcatgagcaactaaggccttttctactattatttacaaaatacatacaccgtgcatctctagcagctaaagcactaatacaacaagtcactaaggcaaacctgtgcttcctgtcttcctggcaaaatattttttcagttttgggtaccccttttgagtagatattttacggtccttcagaaagtgtacctgcggtgcgggtatcaaaattttacactaaaattttagtacctcaaggtagtttggcacttctattaaacacatgatcaatggcggtgaaggattgttctggtgttatactactggtctactgccccaagtgctcaatgtactgagcatacagatccctgcaaacttgcaaagatgtcatcttgctgttacacgtgtaaactgtaaactactcaatatatcgttctaaaatctgaactgatggacagttcatcacttacatggaatactggatggcatcccgagcagcggtcacaggcagtacctcattcacggcgacctccttgttttcattcttcttgtagtcttcaaagaaacgccggatttcctggacgcgatgaggcgaaagctcactgagatcgttgtagtggcggtactcaggatcgtccacgcagacggctatgatcttgtcgtccttctctccctgtctccttaaagctgcagcccg

SEQ ID NO: 3184 - DNA, 1265 bp, Oryza sativa
  Clone ID: PAT_MRT4530_31736C.1
atggatcacgaggcggacgcgtaccggacggacctgatgacgatcacgcggtacgtgctgaacgagcagagccgcaacccggaggcacgcggcgacctcaccatcctcctctcccacatcgtgcttggctgcaagttcgtcgcctccgccgtcaacaaggccgggctcgccaagctcatcgggctggccggcgagaccaacgttcaggcaagtgtacctggcaataactgtcatctttctcagtttcttgtctctgagattgagataggagaggagcagaagaagctggacgtgctgtccaacgaggtgttcgtcaaggctctcgtcagcagcggccgcacctgcgttcttgtctccgaggaggacgaggaagcgacgttcgtggaccctgcgctgcgtgggaagtattgcgtgtgctttgatccactcgacggctcctccaacatcgactgtggcgtctccatcggaacgatctttgggatctacatgatcaaagataaggagaatgtgactcttgaggacgtgttacagcctggaaaaaacatggttgctgctggatactgcatgtacggcagttcctgcacgcttgttctgagtactggaaatggtgtcaatggcttcacacttgatccatctctcggggagttcatattaactcatccagacatcaagataccaaagaaagggaagatttattcagtgaatgaagggaatgcgaaaaattgggacgagcctaccgcaaagtttgtggagaagtgcaagttccctaaggatggttcatcacctaaatccttgagatacattggaagtatggttgctgatgtccaccgtacgttgctatatggaggagtatttttgtaccctgcagacaagaagagcccaaatggaaaactccgtgttctgtatgaagttttccccatgtcattcctgatggagcaggctggaggccagtctttcacaggcaaagaacgggctcttgacctcgttcctaccaagattcacgagagatccccaatatttcttggaagcttcgaagatgtggaggagatcaaagggttgtacgctgcacaggcgaagtaagctcggtttgatcgatctggcaccatcaaggcgtgcgaatggactccctggccttactgtaacatgcatgattcgtcaggcacttcttttattcgtcttactgtacgtttgtaaaattcagtgtaatagtgttgaggcctggaacagcttcatgagcaactaaggccttttctactattatttac

SEQ ID NO: 3185 - DNA, 1442 bp, Oryza sativa
  Clone ID: PAT_MRT4530_32113C.1
ccccgggcccccgggccgcggcgccctaaacctcacgacttcacgagctgcagcgagaggagcgaggactcgagaggcggacttggacgcggcggggcagatggagaacggcggcggcggcggcggcgatggcggcaagagcgacgtcccggcggacgccaacgagcattgccctgggacgcagtcggaggaggcggggaaggcggatgcctgcgccggatgccccaaccagcagatttgcgccaccgcccccaagggccctgatcctgacttggttggtattgttgaacggatggctacagtaaaacacaagatactggttctgtctgggaaaggaggtgtagggaagagtacattttcagcccagctctcatttgcccttgctgaaatggactgccaggttggccttcttgatatagatatatgtggccctagcatcccaaaaatgttaggccttgaaggtcaggatattcatcaaagcaaccttggttggtcaccagtctatgtggagtccaaccttggtgtcatgtcaattggtttcatgctgcccaacccagatgatgctgttatatggagaggacctcgcaagaacggactcatcaaacagttcttgaaggatgtcgattggggggagattgactatcttgtggttgatgctcctccagggacatcagatgaacatatttcaatcgttcagtaccttcaagccacaggaattgatggtgcaataatcgtgaccactccccagcaggtctctctaatcgatgtgcggaaggaaataaatttctgcaagaaggttggtgtgccgatcttaggtgttgtggagaacatgagtggcttgcggcaggttctctcagatttcagattcgtgaagcaaggtgagggaggcgagatggatgctacagaatgggcgctgaactatatcaaggagaaagctcctgagcttttgacaatggttgcatgcagcgaggtgtttgatagcagcaagggtggtgcggagaaaatgtgcaacgaaatgggagtacctttccttggcaaggtgcccatggatccacagctatgcaaggcggctgaggaagggaggtcatgcttcgtcgatcagaagtgcagtgctagtgcaccagctcttaaaagcatagtcaagaagctgatcgagaatcaagattgagtgaactttttttaaaaaaaggataattgaagactgagtgaactagtgatgatggtttctgggaaacgggatgcggagatatcgaagctcagtgtagatatacctgatactgtcccatatgttttgaagttcagttttggttgtgtagaactattctgcttgtggaatcactgaatcagtttttcagtctgatgtgaggaatgtgccataataaattgcatgatgctgcaagctcatccaaccagttgttcttgatatacattaaaaaaaaaaa

SEQ ID NO: 3186 - DNA, 660 bp, Oryza sativa
  Clone ID: PAT_MRT4530_32262C.1
attcggctcgagcaacctcttaccgagcgaatccctcaattcttttaaactaacaacatcatcaccatcgtcgcaccgaaatcaatcgccacaacctcgggatctcagattcgacgcgccaaatcatgtcgaaggcgcgtgtctacaccgatgtcaatgtccttcgccccaaggagtattcggattacgagtctctcacccttcaatggggtgatcaagatgattatgaggttgtgcgaaaagtgggcaggggtaaatatagtgaagtttttgaaggcataaatgtcaatagcaatgagcgctgtataattaagattctgaaacctgtcaagaaaaagaagattaaaagagagataaaaatacttcagaatatttgcggaggcccaaatattgttaagcttcttgatattgtcagagatcaacattcgaaaactcccagtttgatatttgagtatgtcaacagtacagattttaaagttttgtatccaaccttgactgattatgacatacgctattacatatatgagctccttaaggccttggattactgccattctcaaggcatcatgcatagggatgtcaagcctcataatgttatgatagatcatgagttacgaaaacttcgctggatagattggggtcttggctgattttatcatc

SEQ ID NO: 3187 - DNA, 1022 bp, Oryza sativa
  Clone ID: PAT_MRT4530_32410C.1
acgaggcccaaagcagcaattgcaagaagcaaaatctcttctcctcctcctcctcctcctcatcatcatcctcctctcgcccttcgacaacgcaccatagtttaacccaagctagaagaagaagacgatagatatgagcactactcgcggcgtctcctcctcttctgctgctgctgctcttgcgctgcttctcctcttcgccctctgcttcttctccttccacttcgccgcagctgctcgcgccgttcctcgtgatgaacaccaagagaatggcggtgtcaaggcagtagcagcagttgcagctgatcagcttgtgctccagctggaaggtgacaccggcaatggcgacgaggtctccgagttgatgggagcagctgaggaggaagcagcagcatgcgaggaggggaagaacaacgacgagtgcgtgcagaggaggctgctcagcgacgcccacctcgactacatctacacgcagcacaagaacaagccttgatcgatcgatccatccatccaactacacgctgaaatccaaagctaatacaaggaagatcgagatcgagataaattaaccaactctatatgcatatctatctatccatctacctctgcatgctgttttcactgcatcgatcgctactgttctgcagtgccaatcactgtccgtttctgtacaatctgtgatactactagctagtagcagtacatggcatcgttttccttcaagtgttcgttggcttttacttagtccggtgagtgcttgtgggttatttctgacgagggagtgtgatcagtacgcgtactaatgggattttggtttgtcatggcatgatgaaattaagctgtggtagcaatataatgcatatatatattacctttgtctcatgtccttagtatgtagtagtggtaaatagtacatagcatgaataatatacttatcaaggaacacttgtgttttgtttaatggcgcaaaaaaaaaaaaaaaaaaaaaaaaaaaaaaaaaaaaaaaaaaaaaaaagggcggg

SEQ ID NO: 3188 - DNA, 1893 bp, Oryza sativa
  Clone ID: PAT_MRT4530_32481C.1
tctattgaagaagcttccagctgagctgggggatcaaaatggaggtgcttcttccccttctccttgcctgctctctcctcttcaccattgcaacccctatcagagacatcaccgacgtttgtgcctcacagatcagtgatttccagcacctgaacagctccggactgcacctgacgctgcaccacccgcagagcccctgctcgccggcgccgctcccctccgacctccccttctccgccgtcgtcacccacgacgacgcccgcatcgcccacctcgcctcgcgcctcgccaacaaccacccgacatcgccgtcgtcatcgtctctcctccacggccaccgcaagaagaaggccggcggcgtcggcggctcgcaggcgtcgtcgtcgtccgtgccgctgacgccgggcgcgtcggtggccgtcggcaactacgtgacccgcctgggcctcggcacgccggcgacctcctacgtgatggtggtcgacacggggtcgtcgctcacctggctgcagtgctccccgtgctcggtgtcgtgccaccggcaggccggcccggtgttcgacccgcgcgcgtcgggcacgtacgccgccgtgcagtgctcctcgtcggagtgcggcgagctccaggccgccacgctcaacccctccgcctgctccgtctccaacgtctgcatctaccaggccagctacggcgacagctcctactccgtcggctacctcagcaaggacaccgtctccttcggctccggcagcttcccgggcttctactacggctgcggccaagacaacgagggcctcttcggccgctccgcggggctcatcggcctcgccaagaacaagctctcgctgctctaccagctcgccccgagcctcggctacgccttctcctactgcctcccgacctcgtcggcggcggcgggctacctctccatcggctcgtacaaccccggccagtactcgtacacgcccatggcgtccagctccctcgacgcctcgctctacttcgtcaccctgtcggggatctcggtcgccggggcgccgctcgccgtgccgccgtcggagtaccgcagcctgccgacgatcatcgactccggcacggtgatcacgcggctgccgccgaacgtgtacacggcgctgagcagggccgtggccgcggccatggccagcgccgcgccgcgggcgccgacctactccatcctggacacctgcttccggggctccgccgcggggctgcgcgtcccgcgcgtggacatggcgttcgccggcggcgcgacgctggcgctgtcccccgggaacgtgctcatcgacgtcgacgactccacgacgtgcctggcgttcgcgccgaccggcggcacggcgatcatcgggaacacgcagcagcagacgttcagcgtggtgtacgacgtcgcgcagtccaggatcggcttcgccgccggcggctgcagctgaggacccaaactgcagctggccgactcaagctaggtaaaagagcaatgctgcttcttctgctgctgccgccgcctcctatctctgctcaggcacagaagtgacaacttcttaactgcaaattcattcatcacatgtaaatgcatatacatgtgccaggaagttacgagtgtggctctaggacctagttttacatgtcataaacaaatatagatgtacaaataaatacagggtaactactttaggtgaagataatacttatcaatgtgaaagattattatgttatatggctgcttgttagcaatcaagccaaaatgttcatcatgtacatgtaaactatgggtgtgtttgggttctaaatgttcagggtgaaaagaaaagcagtataagaacatgaagatttgagttatcatttatcattggttaattgataaaaaaaaaaaaaaaa

SEQ ID NO: 3189 - DNA, 2612 bp, Oryza sativa
  Clone ID: PAT_MRT4530_32658C.1
ccggccgggctctcaaaaccctctcctaaccctagccgccgccgcagccgcagccgcagccgcgcgtcgtctcctccgcccgcgagctcctcttcccgccggcgagagatcaggagcacgcaaggcgcgcggccatggcgtcggagaccgagacgttcgccttccaggccgagatcaaccagctgctgtccctcatcatcaacaccttctactccaacaaggagatcttcctccgcgagctcatctccaactcctccgatgcattggataagattaggttcgagagcctcacggacaagagcaagctcgatgcgcagccggagctgttcatccacattgtccccgacaaggctagcaacaccctgtcgatcatcgacagtggtgtcggcatgaccaagtcggacctcgtcaacaacctcggtaccatcgccaggtcggggaccaaggagttcatggaggcgctcgctgctggtgctgatgtgtccatgattgggcagtttggtgtcgggttctactccgcctaccttgttgctgagagggttgttgtgaccaccaagcacaacgacgacgagcagtatgtgtgggagtcacaggccggtgggtccttcactgttacacgtgatacctctggtgagcagcttggacggggtactaagatcaccctctacctcaaggatgatcagctggaataccttgaggagcgtcgcctcaaggatctggtgaagaagcattctgagttcatcagctaccctatctccctatggactgagaagacaactgagaaggagatttctgatgatgaagacgaggaagagaagaaggatgctgaggagggaaaggttgaggatgttgatgaggagaaggaagagaaagagaagaaaaagaagaagatcaaggaagtctctcacgagtggaacgtgatgaacaagcagaaacccatttggttgaggaagccagaggagatcaccaaggaagagtacgctgctttctacaagagcttgacaaacgactgggaggaacatctggctgtcaagcacttctctgtggagggtcagcttgaattcaaggccatcctgtttgtaccaaagagagcgccatttgacctctttgacaccaggaagaagcaaaacaacatcaagctgtacgtacgccgggtgtttatcatggacaactgtgaggagttgatcccagagtggctcagctttgtcaagggcattgttgattctgaagaccttcccctcaacatctcacgtgagatgctccagcagaacaagatcctgaaggtgatccgcaagaaccttgtgaagaagtgcgtggagctcttctttgagatcgctgagaacaaggaagactacaacaagttctacgaggctttctccaagaatctcaagcttggcatccatgaggattccaccaacaggaccaagattgctgagctcctgaggtatcactccaccaagagtggtgatgagttgaccagcctcaaggactacgtaacccggatgaaggagggccagagtgagatctattacatcactggtgagagccaagaaggctgttgagaactcccccttcctcgagaagctgaagaagaagggttatgaggtcctgtacatggttgatgccattgatgagtacgctgttggtcagcttaaggagtttgaaggcaagaagctcgtctctgccaccaaggaaggtctgaagcttgatgagagtgaggacgagaagaagcggcaggaggaactcaaggagaagttcgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtctagcaagaagaccatggagatcaacccggagaatgccatcatggacgagctccgcaagcgtgccgatgcggacaagaatgacaagtccgtgaaggacctggtgatgctgctcttcgagactgccctgctgacctccggtttcagcttggaggaccccaacaccttcggcaccaggatccaccgcatgctcaagctcggcctgagcatcgacgaggacgagtccgccgaggctgacgccgacatgccgccgctggaggacgacgccggcgagagcaagatggaggaggtcgactaaacgtcatggacccatggatgccattctgtcccttctagttatccctctcctagttctcttctcatagctatctgactgctgctgttcgctttctttttggtacgttggatgcatcagttttgtctttgtcttagctcttaaacaatgcgtggtaccttgtcatactgtttgcgttgcaatgctactagccgaagtatatgccagcttcttattcatacttataacgtctttttttatcaaattatgttggctgaatcccttggagtgtgccaatttccatcttgaacttgagtattccaagtagctgttgtgagcagcccgaccagtattctggaacttcttcctaataagcctggttgctgcaaattgatggaatg

SEQ ID NO: 3190 - DNA, 544 bp, Oryza sativa
  Clone ID: PAT_MRT4530_32862C.1
acagaaaaaaatacattggttcatgacacggggagggccatgcccaccacttatttggacacacagagggcaagggtgcagaaaaaatcaagcaacacaagctgaacttacgggcccacctgtaagccttttactgggcgagggcggagacttttgtgaaaaacagaaacaccacccatgcagaaaaagacaaattttttcacacacaaatcgaccacccggggggcggggacctacggggaggtcgtcgccccccccggcgacgttgtgatgagggcgatcaccccaaaagggggggcttttttttcccgggggactcctcggggctcttgggggccttctttttctcggggggctcggggaaggggtaacccccggggcccaccgccgccggggccgcaaactcctccgtgatcttgggcctgggcgcgttctccggggccttttttgccttgggcttttaatacaaggcaaaggcccccgcgggaagggcccccgccttccccaagagctggttgggcttgggcttgttcttctccttttt

SEQ ID NO: 3191 - DNA, 1372 bp, Oryza sativa
  Clone ID: PAT_MRT4530_32961C.1
cggacgcgtgggcggacgcgtgggcctaaacctcacgacttcacgagcagcagcgagaggaggagggagcaatcaatccatcggcggcaatggagaacggcggcggcgacgtcccggagaacgccaacgaccattgcccggggacgcagtcggaggcggcggggaaggcggacgcgtgcgccgggtgccccaaccagcagatctgcgccaccgcgcccaagggccccgatcccgatctgcttgccatcattgagcgaatgaataccgtgaaacacaagattctggtactgtctgggaagggtggtgtcgggaagagtacattttcagcccagctctcttttgcccttgctgagatggaccatcaagttggccttctcgacatagacatttgtggtcctagcatcccaaaaatgttaggccttgaaggccaagatattcatcaaagcaatcttggctggtcgccggtgtatgttgagtccaacctaggtgtcatgtcaattggcttcatgctgcccaacccagatgatgctgttatatggagaggtcctcgcaagaacggactcatcaaacagttcttgaaggatgtcgattggggggagatcgactatcttgtggtggatgcacctccaggaacatctgatgaacatatttcaattgtacagtacctccagatcgcaggaattgatggggcaatcattgtgaccactccgcagcaagtttctctgatcgacgtgaagaaggagataaacttttgcaagaaggttggcgttcctgtcttgggagttgtcgagaacatgagtggcttgaggcaggcattttcagacatgaaatttgtgaagccaagtgaggcgggagaaacagatgccaccgagtgggcgctgaactacatcaaggagaaagccccagagcttttatctgttgtcgcatgcagtgaggtgtttgatagcagtaagggtggtgctgagaagatgtgccaggaaatggaggtcccttttcttggcaaggttcccatggatccccagctctgcaaggcggcagaggaaggaagatcatgcttcactgatcagaaatgcagtgctagtgctccagctcttaaaagcataatcaagaagctggtcaagacgaagtgagaaggtggtgtgactcatgaccgtgaagttacgccagtagtttctgccgtatggagtgctattacttgctgagtgtgtgtgtgtgtgtaatgcgatcctaactttgcctagagtttttcttgccgcatgcaaagttggcagatattcgcgctgcagctgttgcagtggtaaacaattcagcacatctagaagcacatcccttcagtttatggttcattttgctctgccgcttttgggcatgc

SEQ ID NO: 3192 - DNA, 1767 bp, Oryza sativa
  Clone ID: PAT_MRT4530_3350C.1
atgtcgtctcctcccgacagcgccacgacctgcaacttcctcttctcccctcctgcagcacagatggtcgctccttcacctggctactactacgtcggcggcgcctacggagacgggaccagcaccgccggcgtctactactcgcacctccctgtcatgcctatcaagtccgatggctccctctgcatcatggaaggcatgatgccgtcgtcatcgccaaagctcgaggacttcttggggtgtggcaatggcagtggccatgacccggccacctactatagccagggccaagaagcagaggatgcaagcagggcggcctaccagcaccaccagctagtcccctacaactaccagccattgacggaagcagagatgctgcaagaggccgcagcggcgccaatggaggacgcaatggcggcggccaagaacttcctcgtcaccagctacggcgcctgctacggcaaccaggagatgccgcagccgctcagcctctccatgagcccagggtcccagtccagcagctgcgtcagtgcagctccccagcagcatcagcagatggcggtggtcgctgcagctgctgctgctggtgatggccagggaagcaacagtaatgacggtggcgagcagcgtgtcgggaagaagaggggccccgggaaagggggccaaaagcagcctgttcaccggaagtccattgacacgtttgggcagaggacatcgcagtataggggcgtcaccaggcacaggtggactggaagatatgaagcccacctctgggataacagttgcaaaaaggatggacagacaaggaagggaaggcaaggtggttatgacactgaagataaagctgcgagggcttatgatctggctgcgctgaaatactgggggctatctacgcatataaatttcccgttagaaaactaccgagatgagatcgaggagatggaaaggatgacaaggcaagaatatgttgcgcacttgagaaggagaagcagcgggttctctcgcggtgcttccatctaccggggagtaacaaggcatcaccagcatggaagatggcaagctcggattggcagggttgctggcaacaaggacttgtatctcggcactttcagcactcaagaagaagcagcagaggcatacgacattgctgccatcaagttccgtggcctgaacgcggtgacgaactttgacatcacaaggcacgacgtggacaagatcatggagagcagctcgctgctgcctggtgaggcagcgcgtaaggtgaaggcgatcgaggcagcgccggaccatgtgccaataggccgcgagctcggtgcgaccgaggaagcgagcgctgctactgtcacgggcaccgactggagaatggtgctccatggatcacagcagcagcaagctgcagcgtgcaccgaagcaacggcagatcttcagaagggcttcatgggtgacgcgcactcggctctccacggcattgtcgggttcgacgtcgagtcggcggcagctgacgagatcgatgtcccgggagggaagatcagtggcatcaacttctcgaactcgtcttcgctggtgactagcctgagcaactcgagggaggggagccctgagaggcttggcctcgccatgctctacgccaagcatcatcccaccgccgtcagcctcgccgccatgaacccctggatgccgatgccggcgccggccgcagctcacgtgatgaggccgccgagtgccattgctcatctccctgtttttgcagcctggacagatgcttaa

SEQ ID NO: 3193 - DNA, 1741 bp, Oryza sativa
  Clone ID: PAT_MRT4530_33578C.1
ttattccacccccttcccttctctcgtcctcctcctcctcctcccgctctcactctcgctcttcaaaataggtgggcggtgctctcgcctcccctccccgccggcttccgcctccagatccgcgccgcccgccgccgccgcgctcgctcgagcgggagctatagctgccgccttcgattcgacgctgcatgtactggcgagaggcgtagcgcgtggcgtgctctccccgacgcgcgcctcgcctcctccccgttcattacaagatggcgatgatggtggaccctcctaatggcatgggaaaccaagggaagcattactacacaatgtggcaaacgctatttgagattgacaccaagtatgtgccaatcaagcccatcggaagaggggcttatggaatagtttgctcctctataaaccgtgcaaccaacgaaaaagttgcaataaagaagatcaacaatgtctttgacaaccgtgtggatgcactgaggaccctaagggagctgaaactactgcgacacttgcgccatgaaaatgttattgccttgaaagatataatgatgccagtacacagaaggagtttcaaagatgtatacttggtttatgaactcatggacacagatctacaccagataattaaatcatctcaacctctttctaatgaccactgtcaatatttcctttttcagctactccgaggtctgaagtacctccattcagcagggatactccatcgagacctgaaaccagggaacctcctggttaatgcaaactgcgatctgaagatctgcgactttggtttggctcgcacaaacaacactaaaggccagtttatgactgaatatgtcgtgacccggtggtatagggctcctgagctgctgctctgctgcgacaattacggaacctccatagatgtctggtctgttggctgcatctttgctgagcttcttggccgcaagccaatatttccaggaactgagtgcctcaatcagctcaagctcatagtcaacgttctcggcaccatgagtgaagctgacattgagttcattgacaacccaaaggcccgcaagtatatcaagacccttccatacactcctggcatccccctcaccagtatgtacccgcaagcacatcctcttgccattgatctgttgcagaagatgctcgtctttgatccctccaaaaggattagtgtcactgaagctctggagcacccttacatgtctccactgtatgatccaagcgcaaaccctcctgctcaagtgcccatcgatctcgacatcgatgaaaatcttggcgtggatatgatccgggagatgatgtggcaggagatgctccactatcacccagaggttgttgcaggagtgaatatgtgacaggcaagaacgaacatgtgaaggcaacgtgctacactaagatcttcacatgttggttttttgtataaatcttattcgcgattgtcgcgcctatcaagcttaagctatggcgatgtcgcccaggtgacctcttatgtaaatatgtgcgaataagacagcattctggagttgttcttcctgtggacctctacttgtagtatatggactaatgtgttgtatgagtacgtgaagcagaattcggtattatcaaggcttgtaatgttagatgctcttatattacactatgaagtgtcaactttcaagtggccacgtttacacataaaaaaaaaaaaaaaaaaagagactcgtgccctctcccccccgtgccg

SEQ ID NO: 3194 - DNA, 2242 bp, Oryza sativa
  Clone ID: PAT_MRT4530_33579C.1
ctcgttttgcgtatcttcccaatctcctcaatccccttctcctcaaacactccgggaacggaacaggaggccggtagctcgccggaggaagaagccaagaggcgcgggcggcggctgcggcagaagaagacggagtcgctagctggaggcggagacgatctagacgaataggccgcggcgacggcgagagtggcaagtgggggagtccgtgcggtggtcgctccctcctctcgcgcggtgacatctaagtgccgcgtgttctcctcttcctcttcccctccaccttcatttcccattccacccccttcccttctctcgtcctcctcctcctcctcctcctctctctctggcgctctctctcttcaaaataggtgggcggtgctctcgcctcccctccccgccggcttccgcctccagatccgcgccgcccgccgccgccgcgctcgctcgagcgggagctatagctgccgccttcgattcgacgctgcatgtactggcgagaggcgtagcgcgtggcgtgctctccccgacgcgcgcctcgcctcctccccgttcatgtaagtgggataaattcctcgccgcctcacctcctcctccagtacttctgtcacgacgccgcgtcggcgagtacaagatggcgatgatggtggaccctcctaatggcatgggaaaccaagggaagcattactacacaatgtggcaaacgctatttgagattgacaccaagtatgtgccaatcaagcccatcggaagaggggcttatggaatagtttgctcctctataaaccgtgcaaccaacgaaaaagttgcaataaagaagatcaacaatgtctttgacaaccgtgtggatgcactgaggaccctaagggagctgaaactactgcgacacttgcgccatgaaaatgttattgccttgaaagatataatgatgccagtacacagaaggagtttcaaagatgtatacttggtttatgaactcatggacacagatctacaccagataattaaatcatctcaacctctttctaatgaccactgtcaatatttcctttttcagctactccgaggtctgaagtacctccattcagcagggatactccatcgagacctgaaaccagggaacctcctggttaatgcaaactgcgatctgaagatctgcgactttggtttggctcgcacaaacaacactaaaggccagtttatgactgaatatgtcgtgacccggtggtatagggctcctgagctgctgctctgctgcgacaattacggaacctccatagatgtctggtctgttggctgcatctttgctgagcttcttggccgcaagccaatatttccaggaactgagtgcctcaatcagctcaagctcatagtcaacgttctcggcaccatgagtgaagctgacattgagttcattgacaacccaaaggcccgcaagtatatcaagacccttccatacactcctggcatccccctcaccagtatgtacccgcaagcacatcctcttgccattgatctgttgcagaagatgctcgtctttgatccctccaaaaggattagtgtcactgaagctctggagcacccttacatgtctccactgtatgatccaagcgcaaaccctcctgctcaagtgcccatcgatctcgacatcgatgaaaatcttggcgtggatatgatccgggagatgatgtggcaggagatgctccactatcacccagaggttgttgcaggagtgaatatgtgacaggcaagaacgaacatgtgaaggcaacgtgctacactaagatcttcacatgttggttttttgtataaatcttattcgcgattgtcgcgcctatcaagcttaagctatggcgatgtcgcccaggtgacctcttatgtaaatatgtgcgaataagacagcattctggagttgttcttcctgtggacctctacttgtagtatatggactaatgtgttgtatgagtacgtgaagcagaattcggtattatcaaggcttgtaatgttagatgctcttatattacactatgaagtgtcaactttcaagtggccacgtttacacatatatttgctatgctgacttgctgagacatgcttggttttagggcggtttgcagcttaacatgtgttcctttcaaagagcagtagatctgcagtttgcatggtattcctgtccaaactgtctagtatactctatactgatactctggtataaagctccctgcagtttgcaaaaaaaaaa

SEQ ID NO: 3195 - DNA, 1379 bp, Oryza sativa
  Clone ID: PAT_MRT4530_34086C.1
gcccgcggttcgggcgcggctgctttcccgagtggcgaatccgttgctgtcgtatatctcgtctatggcgtgctgtatgtcctctccttctttcttcctttccaaataagcactcctcttcttcctcctcctcctcctccgcctcctcttctcattcccaactcatcgatccatcagtagctagctagctagctagctagctgcattgtccggcgagagagatagctgctgcagggggcggccatggggaggggcaagatcgagatcaagcggatcgagaacgcgaccaacaggcaggtgacctactcgaagcgccgcacggggatcatgaagaaggccagggagctcaccgtgctctgcgacgcccaggtcgccatcatcatgttctcctccaccggcaagtaccacgagttctgcagcccttccaccgacatcaaggggatctttgaccgctaccagcaagccatcggcaccagcctttggatcgagcagtatgagaatatgcagcgcacgctgagccatctcaaggacatcaaccgcaacctgcgcaccgagatcaggcaaaggatgggagaagatctggacgggctggagttcgacgagctgcgcggtcttgagcaaaatgtcgatgccgccctcaaggaggttcgccacaggaagtatcatgtgatcaccacacagactgaaacctacaagaaaaaggtgaagcactcctacgaggcgtacgagactctgcagcaggagctggggttgcgcgaggagccggcgttcgggttcgtggacaacaccggcggcgggtgggacggcggcgccggcgccggcgcggcggcggacatgttcgccttccgcgtggtgcccagccagcccaacctgcacggcatggcctacggcggcaaccacgacctgcgcctcggttgatatatcatcgccgccgccgccgccgccgccggcggcctgctcgtcgccggccggccggccgccggacaccgtatcatcgctcgatctagataacaagccgacgaataaattgcagtgctcgtgttacttacctgcatgcgcatgcattattatcgatcaacgcaagaacttcatttcatttaccaaaccacttgatgtgtgctatgatccagcggttaaaccgtgtgttgtctcttgacattttgtaccagttactgatgatgttgtattatgtatgcgtggtgtgcaactgtgcttggataatttcacacttatttgccacgcttgctttattagctttgactatcaagctactgatcagagagttacctagctcaaaggattaattattatgtatacagctcaaatacattaatgggctactggctgctgctgtccgagtaattatttacacctgtggt

SEQ ID NO: 3196 - DNA, 197 bp, Oryza sativa
  UNSURE (1)..(197): unsure at all n locations
  Clone ID: PAT_MRT4530_34426C.1
  unsure (1)..(197): unsure at all n locations
tcgttccgctgcacgagccgtcatctctgcgcctgggcttcccctcgcgccggcctctgcctccaccaccaccgccgccgccgncgcagcagccggaggacgaaactcgccgtgcgcgcgatggcaccgacgttgtnctcggtgtcgacggcggaggcagctcccccggggctgaaggagggcatcgtggggatcta

SEQ ID NO: 3197 - DNA, 2345 bp, Oryza sativa
  Clone ID: PAT_MRT4530_34852C.1
caaggagtggctcgccgaggtgcagctgctgggcgcggtggcgcgctggagatcgagaagacgccggaggcggcggaggacatggagtcggagcccgcgctggcggcggcgcgcgaggcggagcgcgtcccgccgtggcgggagcaggtgaccgcccgcgggatggtggcggcgctgctgatcggcgtggtgtacacggtgatcgtgatgaagctgagcctcaccacggggctcatccccacgctcaacgtctccgccgcgctgctcgccttcctcgcgctccggggatggacgcacgcgctcgaccgcctcggcattgcctcccgccccttcacccgccaggagaacaccgtcatccagacctgcgccgtcgcctgctacaccatcggctacggcggtggattcgggtcgttcttgctggggctgaacaagaagacgtacgagctgtccggcgcgagcacgccggggaacgtgccggggagctacaaggagcccgggatcgggtggatgacggggttcctcctctccaccagcttcgtggggctcctcaccttgctccctctccgaaaggtgctggtcatcgactacaagctaacatatccaagtgggacagcgactgctgttctcataaacgggtttcacacgcctcaaggagataagaatgcgaaaaagcaagtccgtggattcctcaggtatttcggcatcagcttcttgtggagcttcttccagtggttctacaccggcggtgacgtctgcggattcctccagttccctacctttgggctgaaagcttggaaacatacatttttcttcgacttcagtctcacgtatgttggtgccgggatgatctgttctcaccttgtcaacctctctctcttgttcggcgcgatcctctcctggggaataatgtggccgctcatcggcaagcagaaggggaattggtactctgctaaggcatctgaaagtagcatgtcgggcctgttcggttacaagtccttcatctgcattgcacttctcgttggagatggcttctacaacttcgtcaaagtgatcgttgtcactctcaagagcgtacgcgaaagatcaaggcgcaggggtcttaacaacagagtggcggacgcggacaccatggcgatcgacgacatgcagcggaacgaggtgttcaaccgggacaacatccccgacctggatggcgtacaccgggtacacgctgctcagcgtcatcgccgtggtcctcatcccggtgatgttccggcaggtgaagtggtactacgtgatcatcgcgtacctgctggcgccggcgctggggttctgcaacgcctacggcacggggctcaccgacatgaacatggggtacaactacggcaagatcgcgctcttcatcttcgcggcgtgggccgggaaggacgacggcgtggtggccgggctcgtcgggtgcgggctggtgaagcagctggtgctcatctccgccgacctgatgcacgacttcaagacgggccacctgacgctgacctcgccgcggtcgatgctggtcgggcaggtggtgggcacgctgatggggtgcgtcgtcgcgccgctcaccttcttcctcttctacaaggcgttcgacgtcggcgaccccaacgggtactggaaggcgccgtacgcgctcatctaccggaacatggccatcatcggcgtggaggggttctcggcgctgccgaggcactgcctgcagctgtgcgcggggttcttcgcgttcgcggtgctcgccaacctggcgcgggacttcctgccgcgcaggtacgggcggtacatgccgctgcccatggccatggccgtgccgttcctcgtcggcgccagcttcgccatcgacatgtgcgccggcagcctcgtggtgttcctctggcacaggttcgacggcaagagggccgcgctgctcgtgccggccgtcgcgtccggcctcatctgcggcgacgggatttggacgttcccttcgtcgctgctcgcgctggccaaggtcaagccacccatctgcatgaagttcataccgggaaactagccaatgcatcgctgtaatttacagcgtcaatgcagacgtatagatcgtaaaaaaagagatcgtatagacgtatagcgtcaatgcagaaacactagaaaagagatcgtgtatcgagcgttttggacttagatttaagatttaggcgcagcgagaggaagaacgggtgtagctatgacggataaatccccaaaagcagaaatgctgttcataggggttggggttctgtactgtgtatatcagttgagaagaaaattagatgaaaacacaacaattagttgtgcttattgtcaaaaaaaaaaaaaaa

SEQ ID NO: 3198 - DNA, 2943 bp, Oryza sativa
  Clone ID: PAT_MRT4530_3553C.1
gtcgaatcctcctccgagaagaggagagtacatgaatcctagcgcgaggatctcgcaggtagcaatggcggcgatactgccggacctggcgacgcaggtgctggtcccggcggcggccgtggtcggcatcgcgttcgcgctggtgcagtgggggctggtgtgaaaggtgaagatgcccgcggagcgccgcggcggggaggggtcccccggagcggccgccgggaaggacggcggcgccgccagcgagtacctcatcgaggaggaggaggggctcaacgagcacaacgtcgtcgagaagtgctccgagatccagcacgccatctccgaaggagcaacttctttcctcttcactgaatacaagtatgttggactattcatgggcattttcgcggtcctgatcttcctcttccttggatctgttgagggattcagcacaaagagtcaaccttgccactacagcaaggataggatgtgcaagcctgcccttgcaaatgctatcttcagtactgttgcctttgtgcttggtgcagtcacctctcttgtatctggtttccttggaatgaagattgcaacttatgcaaatgccaggacaacccttgaggcaaggaagggtgttgggaaggcattcattactgctttccgctctggtgctgtcatgggtttcctgcttgctgcaagtggccttgttgttctttacattgccatcaacttgttcggaatttattatggtgatgactgggaaggtctttttgaggctatcactgggtatggtcttggtggttcttctatggccctatttggccgtgtaggtggcggtatttacacgaaagctgctgatgttggtgctgacctagttgggaaagtagaaaggaatatccctgaagatgacccaagaaacccagctgtcattgcagataatgttggtgacaatgttggagatattgctggaatggggtcagatctctttggttcctatgctgagtcatcttgtgctgctcttgtcgttgcttcaatctcttcttttggaattaaccatgaattcactcctatgctgtacccgctcctgattagctcagttggtatcattgcttgtctgataaccacacttttcgccactgatttttttgagatcaaggctgttgatgaaattgagcctgccctcaagaagcaacttataatttccaccgttgtgatgacggttggcattgcacttgtcagttggttaggcctcccatattccttcacaatattcaactttggtgcccagaagactgtgtataactggcaacttttcttgtgtgtggcggttggtctttgggctggactaatcatcggatttgtgacagagtattacacaagcaacgcctacagccctgtccaagatgttgctgattcctgcagaaccggagctgctactaatgtcatctttggccttgctctgggatacaaatctgtcattattcctatttttgctattgcttttagtattttcctcagcttcagccttgccgcaatgtacggtgtagctgtggctgcccttggaatgcttagcacaattgcaactggtcttgccattgatgcctatggccctatcagtgacaatgctggaggaattgctgagatggctggcatgagtcacagaattcgtgagagaactgatgctctggatgctgcaggaaacaccactgctgccatcgggaagggtttcgccattggctcggcagccttggtgtctcttgccctctttggtgcctttgtgagccgtgccgccatctccactgtcgatgttctgacacctaaagttttcattggactgattgttggtgctatgctcccatactggttctctgctatgaccatgaagagtgttggcagcgcagcgctcaagatggtggaggaagtccgtaggcagttcaactccatccctgggctcatggagggcacaaccaagcctgactatgcaacctgtgtgaagatctccactgatgcatccatcaaggagatgatccccccaggtgctcttgttatgctcagccctcttattgttgggatcttctttggcgtcgagaccctctcaggactacttgctggtgctctcgtttctggtgttcagattgccatctctgcatcaaacactggtggtgcctgggacaacgcaaagaagtacattgaggctggagcatctgagcatgcaaggaccctgggcccgaaaggctcagactgccacaaggctgctgtgatcggcgacaccattggggatcctctcaaggacacctcaggcccctcgctcaacatcctcatcaagctgatggctgtcgagtcgctcgtgtttgccccgttcttcgccacccatggaggcatcctcttcaagtggttttagatggtgacgatagatttacgaggacgttatttttgccaggagggcgctggaaatcatccatatattatagagttcatcgagttgacacatatagttccctccgtttcctatttgttattactgtctgtccatcagtcgatcatgctaagcttattagcatcatacctgtgtctagtttttttgagtctggtagttgtagccgatgggagcaaatcactggccacctacaggtttggacaagagtaccttgaatttgcgttttcctgtaggttggatgatacgatgatggtgatgattattgtacgtgcacggaatgcacctgtctcagtgaaattttcccgggaaggttctgctgtttctttatgtccttgtgggaatgttaggatgatcttgtacaaaaaagaaaacaactctagtgatagggggtggagtacatgtgtgccaactaagtttgagttgtcttgaattattgaagtaaaatactttagctaaaaaaaaaaaaaaaagcgtgtgcttgcttttgttttaagatagagaattatagtattattttgtataccccc

SEQ ID NO: 3199 - DNA, 2652 bp, Oryza sativa
  Clone ID: PAT_MRT4530_3554C.1
atggcggcgatactgccggacctggcgacgcaggtgctggtcccggcggcggccgtggtcggcatcgcgttcgcggtggtgcagtgggtgctggtgtccaaggtgaagatgaccgcggagcggcgcggcggggaggggtcccccggcgcggccgccgggaaggacggcggcgccgccagcgagtacctcatcgaggaggaggaggggctcaacgagcacaacgtcgtcgagaagtgctccgagatccagcacgccatctccgaaggagcaacttctttcctcttcactgaatacaagtatgttggactattcatgggcattttcgcggtcctgatcttcctcttccttggatctgttgagggattcagcacaaagagtcaaccttgccactacagcaaggataggatgtgcaagcctgcccttgcaaatgctatcttcagtactgttgcctttgtgcttggtgcagtcacctctcttgtatctggtttccttggaatgaagattgcaacttatgcaaatgccaggacaacccttgaggcaaggaagggtgttgggaaggcattcattactgctttccgctctggtgctgtcatgggtttcctgcttgctgcaagtggccttgttgttctttacattgccatcaacttgttcggaatttattatggtgatgactgggaaggtctttttgaggctatcactgggtatggtcttggtggttcttctatggccctatttggccgtgtaggtggcggtatttacacgaaagctgctgatgttggtgctgacctagttgggaaagtagaaaggaatatccctgaagatgacccaagaaacccagctgtcattgcagataatgttggtgacaatgttggagatattgctggaatggggtcagatctctttggttcctatgctgagtcatcttgtgctgctcttgtcgttgcttcaatctcttcttttggaattaaccatgaattcactcctatgctgtacccgctcctgattagctcagttggtatcattgcttgtctgataaccacacttttcgccactgatttttttgagatcaaggctgttgatgaaattgagcctgccctcaagaagcaacttataatttccaccgttgtgatgacggttggcattgcacttgtcagttggttaggcctcccatattccttcacaatattcaactttggtgcccagaagactgtgtataactggcaacttttcttgtgtgtggcggttggtctttgggctggactaatcatcggatttgtgacagagtattacacaagcaacgcctacagtccctcatgtccctcacaccttgaatttcccttgtccagccctgtccaagacgttgctgattcctgcagaaccggagctgctactaatgtcatctttggccttgctctgggatacaaatctgtcattattcctatttttgctattgcttttagtattttcctcagcttcagccttgccgcaatgtacggtgtagctgtggctgcccttggaatgcttagcacaattgcaactggtcttgccattgatgcctatggccctatcagtgacaatgctggaggaattgctgagatggctggcatgagtcacagaattcgtgagagaactgatgctctggatgctgcaggaaacaccactgctgccatcgggaagggtttcgccattggctcggcagccttggtgtctcttgccctctttggtgcctttgtgagccgtgccgccatctccactgtcgatgttctgacacctaaagttttcattggactgattgttggtgctatgctcccatactggttctctgctatgaccatgaagagtgttggcagcgcagcgctcaagatggtggaggaagtccgtaggcagttcaactccatccctgggctcatggagggcacaaccaagcctgactacgcaacctgtgtgaagatctccactgatgcatccatcaaggagatgattcccccaggtgctcttgtcatgctcagccctctcattgttgggatcttctttggtgtcgagaccctctcaggactacttgctggtgctctcgtttctggtgttcagattgccatctctgcatcaaacactggtggtgcctgggacaatgcaaagaaatacattgaggctggagcttcagagcatgccaggacccttggtcccaaaggttccgatccccacaaggcggccgtcatcggtgacaccatcggagaccctctcaaggacacttcaggaccctctctcaacatcctcatcaagctcatggcggtcgaatccctcgttttcgcccccttcttcgccacccacggtggtatcctcttcaagttgttctaaaccggcgacgttgggtgtaacaaaggccatagttttgttggggatgagcaaaatatgtagactattttgtcatgatttgctccttgagttgatgactccattgtctacttgatttcccatttttgttctagttccaggttccaaccttgtgttttgatcccagaattttctctggtcctctttagcttttgtctccagctgcataagtcatcctgtggcacagtgaacaaggagcattggaaaatttgccattttctagcgataaaatgatgaggatgatgatgatgattgatgtcg

SEQ ID NO: 3200 - DNA, 582 bp, Oryza sativa
  UNSURE (1)..(582): unsure at all n locations
  Clone ID: PAT_MRT4530_35991C.1
  unsure (1)..(582): unsure at all n locations
acactatgcagttcgtccacgaggcccagagacggtgtgcttactcgcttcagcaccctcctcactctatggtaagcccacttgcaggaccgagttcctcttccgtgctctcccaatgatgttctcgcaatgctctccctctcccgagacagaggctcagaggctccagctnactagaggagtgagttcggtgcatgcactcccttccntccggagctaccacgacgatttatctgcggncagaatctcttcggtaggcttgcggtgcntgtctgctgctagctccattgcccncattgttttgctgctatgtactgtccggtctttccactaatgtgatcagctctctttatcccttacntgcatatcgtcgggcgtcacgtggtggagctccgcttttgttcctttagtgacggttcttgcgccgcttggtgtaatcatggtaataaaattttccctgtgtgaacttgttatccgctcaacttttcacacaacttccgatcnggagcctaagtgtaaggctgggtgctatgatggctactcattaattggttgcccctgccgttccgtggaactgtttgc

SEQ ID NO: 3201 - DNA, 562 bp, Oryza sativa
  Clone ID: PAT_MRT4530_36022C.1
ggcggtgaaattgttgctattaaaaaaatgaagaaaaaatattactcatgggaggagtgtgggaatcttcgagaagtaaagtctttgaggaggatgagtcatccaaatattgtaaaactcaaggaagtcataagggagaatgacactttgttctttgtttttgagtacatggagtgcaatttatatcagcttatgaagaacagaggaaagggttttactgaggcagaggttaggaactggtgcttccaggttttccatgctctggctcacatgcatcagcgtggctattttcaccgggacctcaaacctgaaaatttgctggtgacaaaaaatgtgatcaagatagcagattttggccttgctcgtgaggtttcttctgaaccaccatacacagaatatgtttccactcgctggtatcgggctcctgaagttttgcttcaggctaccttttacaactctgcagttgatatgtgggcaatgggtgctattattgctgaacttttcacgctgcgccctctttttcctggcgccaatgaagcagatgagatgtacaagatatgca

SEQ ID NO: 3202 - DNA, 2337 bp, Oryza sativa
  Clone ID: PAT_MRT4530_36922C.1
atggaaacaattccctgcctcatcctcttttcgtcactacagattctggcattctcttctgcatcaccagagcatacactgggtaccggctcattcttatcggtagaagaatatgagaaaccatttctcatctcacccagcaatactttctcctttggtttctacgaaacaggtgacaacgccttctccctctccatctggttcaccaatacagtcgaaaaaaccgttgtttgggcagcaaactcagaatcaccagtgaatggtcatggctccaagctatcctttactcaggagggtagcttagtcctcagcgatgagaagggcttcgttgtgtgggatagcaagacaatgctaggacaggattctcgagttgctctacttgatacaggcaatcttgtcatcactgattccaagggtagtgttgtgtggcaaagctttgattcacccactgataccttgctacctttgcagctccttaccaaggacaaaaggttggtgtctggttactatagcctctactatgacactgataatgtcctccggctcatatataatggaccagagatttcaagtccctattggccaaacccatctgagtcaatttttgattttggacgaactaactacaacagctccaggattggagtcctcgacaatactggtcatttcacgtcaagtgatggcctaaacatcattgcttctgactcaggtcttggaataaacagaaggctcacaattgatcaagatggcaatctcaagttgtacagcttaaataaagtggaaaaaagctggatagtcacatgggaggccatgccgcagcactgtgacgttcatggactatgtgggagaaatagcatatgtgagtattctcctggtcctcggtgttcctgtcttccaggttatgagatggctgatctagagaattggagcaaaggttgtcagccaatgttcacaaacaactacggccaagccatagggcaagtcatatttgtcgagatgcgtcatgttgaattttatggatatgatacgggatttaatatatccgtttcactggaagattgtgaggaattttgttctcaacaacgttcctgtgttgcctattcataccatgccggaagtggttattgctatactaaaggtatgctctacaacggccggaagactcaatccattactggaagcacatatttcaagctacccaaaacttgcaatatctcagaggtgaaacaacatggcttgacatgcagacattcacattctacatatgaaatgcatcgacaacacggaaagtggttgtatttctatacatgtgctgcaatatttggagggctagagttgttcttcacaacaacagcttgtttatttcttcgaagcaaacagaatattccaaagtcagtgatggatggttatgaattgatgactgagcacttcaggaaattctcatacagagaattgaaggaggctacaggaaattttaaggaagagcttggaagaggtggttctggagttgtttatagaggcgtacttgacagaaagaaagttgtgacagtgaaaagattaacaaatgcaacagaagctgaagaggagtttcaatcagaaataagtgtgattggcaggataaatcatgttaatttggtaaggacttggggctattgctcagaaggcaaacataaactattggtttatgattatgtggagaatgagtcactggacaagcatctctttgagagcatagatgcaaaaaaattacttcgatggaaccagaggttcaccatcgcattgggaacagcaaggggcttggcatacctccaccatgagtgccttgagtgggttgttcattgtgatgtgaagccagaaaacatactcttgacccaggactttgaagttaaaatagcagactttggcctagcgaagctatccaaaagggattgctcttgtttgcaattatcccatatgagaggaacagtaggatacatggctcctgaatgggcgttgaatttgcccattaacgcaaaggttgatgtttttagctatggaattgtgcttcttgaaattgtgatgggagctaggatttctagtcagacaacaacagaaggggagaaactggatttgacacaaattgtggaagcactaaagcaagttgtagcttgtggagatgttacacacatagtggatgctaagctgcatggacaatttaaccatctccaggccatggaaatggtgaagatttccttatcatgcataggagaaaggacaaagaggccaacaatggatgaaattaccaaagctctgatggcatgtggtgatgaagacaagtatgctgactgcacagaatag

SEQ ID NO: 3203 - DNA, 1593 bp, Oryza sativa
  Clone ID: PAT_MRT4530_36991C.1
cgacgacgcctccctcgtacgccggcgctctcgcagttgccgccgccgccgcgaacgcccaccgcccgcgctctggtcggtggatcgtgacgtgctgtggtggtctctgatctgctctgggggtgggtgggcgtctcgcggagtcgccgtgttcgtcgagggctcgatcggctcggggagagcgagtgagaagaggtgagggttggggggaggcacatccgcggcggcggagagatggcggatttccggacctccacgcatcgggagaggtggatcttccagacgaacgatctgatggatagatggggggcggcgaaccagcgggccacggagacgctcgttcagtatggaacgacgcggttgaaggtggaccctgttgatgggtcgctgtcatacccggaacctgcgcctgatcatgttgtagggagctcaggtgtaaagcctctgtcttgtgaagaggagcgattgatgcgggtattttatgagcaaaagattcaagaagtatgttcagcatttaagttccctcacaaaatccaggctaccgcaataatatatttcaagagattttatctgcaatggtctgtaatggaacatcacccaaagcatattatgttaacttgtatttattcttcttgcaaagtggaagaaaatcatgtttctgctgaggaacttggtaaaggaattcaacaggaccaccagattattctaaataacgagatgattgttctcaaatctttagattttgatctgattgtttatgctccgtatcgatctatcgaaggatttgttgatgacatggaggatttctgcagagcaggtaatggtgagcaccaacggttgcaggatttacgtcaaactgcgatatctcaggttgacaaaatgatgttgactgacgctcctcttctctacactcctggacagttggctctggctgctttgcacaaatccaatgatatgcacaagatccttaattttgaaaggtacttggaaagtgttttttcaaggcaacattctgattgtccaatcgaacaatttgttgggtcaatcaatatgatcaattatttggttgagcagcttaaaatacctactcctaaggacatgaggcatattgaccgcaagcttaagcattgtttggatccaagctcacaggatgagcataagaagaaagagaagaagtcgaagcacaaatcaaaaagggcagctaatgaagcccaacttgacagctagaaaacatacggttgggctgcaccgtgtaagaatcagttctttagtttgttgtggctccaattgatcaaaagagctactttcctgagcaggtgaggttccgttttagccgaggacaaccaattttgagatgaagcgagataatacccatgacctcgccttcttgtaatcttgtatgcctggaagccctagcaaactcctcgttgcaatggctactgtactttttttggggggtaatttatcccttgtcaaatgggaagaagcagcatacatcggatgattgcctccatatacgaaaatgacagctaactcagacttttgtcggttgcatttttctgtttaaaaaaaaaaaaaaaaaaaaaaaaaaaa

SEQ ID NO: 3204 - DNA, 234 bp, Oryza sativa
  UNSURE (1)..(234): unsure at all n locations
  Clone ID: PAT_MRT4530_37018C.1
  unsure (1)..(234): unsure at all n locations
ggcgagctctcgaccgccactactgtacacggcccanagcgagcctcctcctcctctgcaccaccggagatggcttccgccgtgctgccggagccntcgngccnaagaagaaggncaacgtccagttcgccttnggctncngcatcctngantccatgacctacatcctccnnggntacgatatnggggtnatgagcgangngtnggtgtacatcangaaggacttnaacatca

SEQ ID NO: 3205 - DNA, 144 bp, Oryza sativa
  Clone ID: PAT_MRT4530_37686C.1
atgaatgcaacgccctttgatgaaggtagtttgggagcagggaacgaggacatccagcttcgtcgacagacgctacgccatgactttcgcagccagcttggagaagctatgcaccaggctgatcggcctgtagtccttgagtag

SEQ ID NO: 3206 - DNA, 1562 bp, Oryza sativa
  Clone ID: PAT_MRT4530_37832C.1
ggggagagagccactagcagcagcagcgatcacaaattgtgccaattcacaaaccgccgcccccttccctttttaatagctgccttcgcctctcgtcccccgtccggcatcgccttgctgtctctgcgaatcgagagagagtcagataaggtcgttaattaggtttgtcaattcggctgcttgcggcgagagaagaggaggagggattagggatggacggggcgccggtggcggagttcaggccgacgatgacgcacggcggccggtacctgctctacgacatcttcgggaacaagttcgaggtgacgaacaagtaccagccgcccatcatgcccattggccgcggcgcctacgggatcgtctgctccgtgatgaactttgagacgagggagatggtggcgataaagaagatcgccaacgcgttcaacaacgacatggacgccaagcgcacgctccgggagatcaagctcctcaggcacctcgaccacgagaacatcataggcatcagggatgtgatcccgccgccgatccctcaggcgttcaacgacgtctacatcgccacggagctcatggacaccgacctccatcacatcatccgctccaaccaagaactgtcagaagagcactgccagtatttcctgtaccagatcctgcgggggctcaagtacatccactcggcgaacgtgatccaccgcgacctgaagccgagcaacctgctgctgaacgccaactgcgacctcaagatctgcgacttcgggctggcgcggccgtcgtcggagagcgacatgatgacggagtacgtggtcacccggtggtaccgcgcgccggagctgctgctcaactccaccgactactccgccgccatcgacgtctggtccgtcggctgcatcttcatggagctcatcaaccgccagccgctcttccccggcagggaccacatgcaccagatgcgcctcatcaccgaggtgatcgggacgccgacggacgacgagctggggttcatacggaacgaggacgcgaggaagtacatgaggcacctgccgcagtacccgcgccggacgttcgcgagcatgttcccgcgggtgcagcccgccgcgctcgacctcatcgagaggatgctcaccttcaacccgctgcagagaatcacagttgaggaggcgctcgatcatccttacctagagagattgcacgacatcgccgatgagcccatctgcctggagcccttctccttcgacttcgagcagaaggctctaaacgaggaccaaatgaagcagctgatcttcaacgaagcgatcgagatgaacccaaacatccggtactagattgaatcaccatggaaatgagatcccgtctatacctgctttgtacatatgatcaagattgagagccgggtagactgaacattgcatttgtttgtttgttgatgttcgaaacccacattctctgcaagttgtggctgctttgtatgatatatggtactatgttcgaataaaagggtttggaactttggattaaaaaaaaaaaaaaaaaaaaaaaaaaaaaaaaaaaaaaaaaaaaaaaaa

SEQ ID NO: 3207 - DNA, 275 bp, Oryza sativa
  Clone ID: PAT_MRT4530_37978C.1
tttgtttttttttttttttttttttgattatcgaaatttgactgccattaattggaactagagtgtaacaaactacatacatagacaaactccccgaatcatggccctaaacattttcaaatggaaaaatggacgccccttgaaaccatgacatttttaaacaacctaacacaggggctcgattaaaaaacaccagaaggtggcgacccatgactacagctagtccttatcatacgactacggttccgccttctttttgaggctggatgattcct

SEQ ID NO: 3208 - DNA, 2190 bp, Oryza sativa
  Clone ID: PAT_MRT4530_38425C.1
atggtgggcatcgacctcaacaccgtggaggaggaggaagacgaggaggagggcggcgccaccggcaccgtcacggcgcctgcggaggcgagggcggggggcgcggtgtgcctggagctgtggcacgcctgcgctggccccgtggcgccgctgccgcggaagggcagcgccgtcgtgtacctgccgcagggccacctcgagcacctcggggccgcgcccggctccggccccggcgccgcggtgccgccgcacgtgttctgccgcgtcgtcgacgtcagcctccacgcggacgccgcgacggacgaggtgtacgcgcaggtctcgttggtcgccgacaacgaggaagtggagaggcggatgcgggagggagaggacggcgcggcctgcgacggcgagggcgaggacgccgtgaagcggccggcccggattccccacatgttctgcaagacgctcacggcctccgacaccagcacgcacggcggcttctccgtgcctcgccgcgccgccgaggactgcttcccgccgctggactacagcctgcagaggccattccaggagctcgtggcaaaggatctgcacggcacggaatggaggttcagacatatctatcgaggccaaccacggaggcaccttttaaccactggatggagcgggtttatcaacaagaagaagctagtatctggggatgcagtgctattcctcagaggtgaagatggagagcttcgattgggagtgcgccgagctgctcagctaaaaaatgcatctccttttcctgcacttcataaccagatctcaaatactagtagtcttagtgaagttgcacatgctgtggccgtgaaaagtatttttcacatctactacaatcccaggttaagtcagtctgagttcattataccatattggaagtttatgagaagcttcagtcaacccttttctgttggaatgcgattcaaattgagatatgagagtgaggatgcttctgaaagaaggcgtactggaataataattggaagcagagaggcagatccaatgtggcatggttcgaagtggaaatgtttagtggtgaaatgggatgatgatgtggagtgccgtcggcctaatggggtatctccttgggagattgagcttagtggatcagtttcaggatctcatctgtccactccccattcaaaacggctgaaatcatgcttcccccaagttaatccagatattgtgcttccaaatggaagtgtttcttcagattttgcggagtctgccagattccacaaggtcttgcaaggtcaagaattgttgggtttaaaaactcgtgatggtactgttaatacagcttctcaggcgactgaggcaagaaattttcagtacactgatgaacgaagttgctctatcaacatgagtaacaatatcttaggggttccgagacttggggtgaaaactccaagtggaaaccctgggttttcctaccattgctcaggctttggggaatctcaaagattccaagaggtcttgcaaggtcaagaagtgtttcgtccttaccgaggagggactttgtccgatgcctgtataagaggttctggcttccgtcaacctgatggcaaccatgcacctggtgcagcatttaaatggcttgcaccacaaggatgtgatcatcatgggataaccacatcagttctgccgcaagcatcctctccatcatctgtcttaatgtttccacaaactagttcaaagatgcctggccttgaatacatatacggatgcctggatagaaatgagaatagccgacattttaagattggacctacacaagatatgacaagaactgatcaaacattacgactctggcctcatcttatttcaggcaaagtgctagatgagtgtacgagaaatgagaagctgcactctccagtcagtggtgctgagcatgaatcaaataacaagtgtcttaatacaaatggctgcaaaatctttggtatatcattgactgaaaaggcccaagcaggcgatgaagtggattgtggcaatgccagttatcattctcggctccagtctttaaaaccacagatgccaaaatcattgggcagcagttgtgccacgcatttccacaggctgtgctaccgcatccaggatgatgacaggggaaatgcagatgatacacgaaggatgcttgtcaagtttgttgtaatgcacttctaa

SEQ ID NO: 3209 - DNA, 2854 bp, Oryza sativa
  Clone ID: PAT_MRT4530_38426C.1
gccattcatggccatcaccaccatgtgtcgcctccccacctccgcctctcctcacccactccgctctccgctccattaaacccaagcgagggacctcgatcgcctcccctcctcgcttccctccccgtctctcctctttcgaccgcgttggaagcaagcgcggcggcggcgcggcgagctgccggtggggggttgcggctatggtgggcatcgacctcaacaccgtggaggaggaggaagacgaggaggagggcggcgccaccggcaccgtcacggcgcctgcggaggcgagggcggggggcgcggtgtgcctggagctgtggcacgcctgcgctggccccgtggcgccgctgccgcggaagggcagcgccgtcgtgtacctgccgcagggccacctcgagcacctcggggccgcgcccggctccggccccggcgccgcggtgccgccgcacgtgttctgccgcgtcgtcgacgtcagcctccacgcggacgccgcgacggacgaggtgtacgcgcaggtctcgttggtcgccgacaacgaggaagtggagaggcggatgcgggagggagaggacggcgcggcctgcgacggcgagggcgaggacgccgtgaagcggccggcccggattccccacatgttctgcaagacgctcacggcctccgacaccagcacgcacggcggcttctccgtgcctcgccgcgccgccgaggactgcttcccgccgctggactacagcctgcagaggccattccaggagctcgtggcaaaggatctgcacggcacggaatggaggttcagacatatctatcgaggccaaccacggaggcaccttttaaccactggatggagcgggtttatcaacaagaagaagctagtatctggggatgcagtgctattcctcagaggtgaagatggagagcttcgattgggagtgcgccgagctgctcagctaaaaaatgcatctccttttcctgcacttcataaccagatctcaaatactagtagtcttagtgaagttgcacatgctgtggccgtgaaaagtatttttcacatctactacaatcccaggttaagtcagtctgagttcattataccatattggaagtttatgagaagcttcagtcaacccttttctgttggaatgagattcaaattgagatatgagagtgaggatgcttctgaaagaaggcgtactggaataataattggaagcagagaggcagatccaatgtggcatggttcgaagtggaaatgtttagtggtgaaatgggatgatgatgtggagtgccgtcggcctaatggggtatctccttgggagattgagcttagtggatcagtttcaggatctcatctgtccactccccattcaaaacggctgaaatcatgctttccccaagttaatccagatattgtgcttccaaatggaagtgtttcttcagattttgcggagtctgccagattccacaaggtcttgcaaggtcaagaattgttgggtttaaaaactcgtgatggtactgttaatacagcttctcaggcgactgaagcaagaaattttcagtacactgatgaacgaagttgctctatcaacatgagtaacaatatcttaggggttccgagacttggggtgaaaactccaagtggaaaccctgggttttcctaccattgctcaggctttggggaatctcaaagattccaagaggtcttgcaaggtcaagaagtgtttcgtccttaccgaggagggactttgtccgatgcctgtataagaggttctggcttccgtcaacctgatggcaaccatgcacctggtgcagcatttaaatggcttgcaccacaaggatgtgatcatcatgggataaccacatcagttctgccgcaagcatcctctccatcatctgtcttaatgtttccacaaactagttcaaagatgcctggccttgaatacatatacggatgcctggatagaaatgagaatagccgacattttaagattggacctacacaagatatgacaagaactgatcaaacattacgactctggcctcatcttatttcaggcaaagtgctagatgagtgtacgagaaatgagaagctgcactctccagtcagtggtgctgagcatgaatcaaataacaagtgtcttaatacaaatggctgcaaaatctttggtatatcattgactgaaaaggcccaagcaggcgatgaagtggattgtggcaatgccagttatcattctcggctccagtctttaaaaccacagatgccaaaatcattgggcagcagttgtgccacggtccatgaacaaaggcctgttgttggcagggtcgttgatatttcagcagtgaatacgatgatctgatacatttactgtatccagggagtatgcttgcagaaatagggaccaacattagtatcatactcactggtgctgaggacacaacttccattctggctatctcgtccctctacgtgcttgttgcctcaacttcagcatttccacaggctgtgctaccgcatccaggatgatgacaggggaaatgcagatgatacacgaaggatgcttgtcaagtttgttgtaatgcacttctaagttctaagctttgaacctcttaacgttgctcctattttaagctcccgttgtaatcggcatttatgttgcctgacctacttgcatatttttcaatttgtccgttaagacagcccttttagagggcttgcttatgttagcaacccttaatttccaaattccaagtatggcgaccgttcgaggggtttgtttgctcctgggacgacatcggtacatgacatagaatccattggtgacaccagggcacatcagaattaaggtgtagggcg

SEQ ID NO: 3210 - DNA, 1729 bp, Oryza sativa
  Clone ID: PAT_MRT4530_38784C.1
gggtttttcataaaccctttctctgtggtgccagcagccgaacccaactgcaaaaggcgccatttttttcccctctttccctcgtcttcttcctccaaatccttcgccccctcctataaatccacctcgcgcaaatccaaatccaaatccaagctcggagaagagacctacctacctacctacctactctaggcgggagagatggtggggaagagcggggtggcggaggagggcggagcggcggcggcggcggcggtgaggaggtgggtggaggccggcggcgggaggctggtgatggacggcgggctggcgacggagctggaggccaacggcgccgacctgaacgacccgctctggagcgccaagtgcctcctctcctccccgcacctcgtccgcaaggtccatttagactacctagaagcaggtgcaaatatcataatcacagcgtcataccaggctacaattcaaggctttgaatccaagggattttcaaaagaacaaagtgaagacttgctcgcaaagagtgttgagattgcacgtgaagcgcgtgacatgtttctgaaggaacattcagatcgtcccatacaacatcctatcctggttgcagcttccattggaagttatggggcctatcttgctgacggctctgagtacagtggggattatggcgaagctggcacgttagaattcctgaaagattttcataagcgaaggctggaggttcttgcggaagcaggtcctgatttgatcgcctttgaaacaattcccaacaaattggaagctcaggcttacgttgaacttcttgacgaatgtaacatcagtatccctgcatggttctcatttaattcaaaagatggagttcacattgtgagtggagactcgttaattgaatgtgctactattgctaatgggtgttcgaaggttggtgcagttggaataaattgcacacctccaagatttatccatggcctgatactctccattcgaaaggtcacagataagccaattctgatatatcccaacagcggagaaagatatgatgctgagaaaaaggagtgggtggaatcaactggcgtgtcagacggtgattttgtttcctacgtaaacgaatggtgcaaagatggggctgtcctcattggcggctgctgcaggacaactccaaacaccatcaaggccataagtagatcacttaaccaacgccactcttcgctgcatttacctgtggcatagagttgcacgctccttcaggtgtgctactcatgctggtacctgaacctgatgaacatatcctggaggtccttactagcagcatgatgttctctgctgcaaatgagatggctctgcacttacacttgcgaataactgtgcgtttcgtctgagttcttaaagttgcccaatctggaggtacaacctaccaagaaggattagcaagcagaaaacagtgatagtgaactgttctactaagtaagtaacaagtgagtgaaaacaatctgcggcaaagttgatgaagcttgtaagctatcaagagttgttgtgcagacctgagcctgttataagagcctatgttgtgtactactactactgctgtactactactaccctgtgaactcttgttttgctatacaagtctataacaataagttttgtttgttaatggagaacttgaagctctctcgtgccgattcctgcagcccgaggagtccaagccttcggtacgcgtgcatcgacg

SEQ ID NO: 3211 - DNA, 647 bp, Oryza sativa
  Clone ID: PAT_MRT4530_38870C.1
acggcggcacggtcaccaccgcaccagtgccaccacccacggcgagccttcgccgcgagctcgccctctctccaaacctccccgcgcgcggaggcgtcgccggacagcccaacgctgccacccgcgaggcccccgccgccgccgtctcctccgcccggcgagtcgtcgtcgtctctccctccctcgcgggatacctagatgagcaattttgtcaggtggaagatttgcaggatgaagctagtcctaattttgtggaagaagttgttactttgttttttaaggactcgggcaggctaatgtcaaacattgagcaagctctggagaagtacccaagagatttcaacaggtgggatacatatatgcagcaactaaaaggcagctgttccagcatcggcgcttctaggatgaagaatgagtgcatgtcgttcagggatagttgtggccaaggaaatgttgaaggttgcatgaggtctttccagaaagtgaagcgggagcatgctgtcctgaggcagaaactagaatcctatttccagctgctaagacaagctggccccgctggagctgccactaggcctgtcatggctcatattggccatgcctctggttctgttctgccaaccctgtttctcttctctgaagcatgctga

SEQ ID NO: 3212 - DNA, 1194 bp, Oryza sativa
  Clone ID: PAT_MRT4530_38906C.1
atggccaccaccgaggggtgcctcgtcgccagcacgaaccgcggctgcaaggccatcgccgagtccggcggcgccgtcagcgtcgtcctccgcgacgggatgacgcgcgcccccgtcgcccgcctccccaccgctcgccgcgccgccgagctcaaggccttcttggaggattctgtcaacttcaataccctctccatggtcttcaataggtccagtagattcgcgaggctgcaaggggtacaatgtgccatggctgggaggaacctgtacatgagattcagctgctgcacgggggatgccatggggatgaatatggtctccaagggcgtgcagaatgtgctggattacctccaagatgacttccctgacatggatgttattagcatctcaggtaacttttgctctgacaagaagccagctgctgtgaattggatcgaagggcgcggtaaatctgtggtttgtgaggcagtaatcaaggaggatgtagtcaaaaaggtgctgaagaccaatgtgcaatcgttggtagagctcaacgtgatcaagaatcttgctggttcagctgttgctggggctcttgggggtttcaatgcccatgctagcaatattgtaactgcaatcttcatagccactgggcaggatcctgcccagaatgtggaaagctctcactgcatcacaatgttggaagctgtaaatgatggcagagaccttcacatctccgttactatgccatcaattgaggtgggcacagttgggggagggactcagctggcgtcacaggctgcttgcttggacctgctcggcgtgaaaggcgcgaacagggaatccccgggatcaaacgcgaggctcctggccaccgtggtggcaggtggtgtccttgccggggagctgtccctcctatctgcactcgccgcaggccagcttgtcaagagccacatgaaatacaacaggtccagcaaagacatgtccaagaggtcaagggctcatcaaacaaaagtgaaggacagtgaagtttacggtgacatcgtcatggctgctgatgctgatacaaacagttcttgttccgaggagagagctgcgctggctgctgcttcggatccttaccgttatgttgagaaacgaaagccaattcctgacccccaggatactggcctaatttatgggaagaagaaggatcctacaaaatctgacaactag

SEQ ID NO: 3213 - DNA, 1979 bp, Oryza sativa
  Clone ID: PAT_MRT4530_39157C.1
tgtaagcgtcgatgaaggcgcgcagcatgcgagcgaagaggaaggcgagccatcgcggacgaacagggagcagtcgcaagaagcgcttcctaaaaacgttattgctgccttctcctggtgtaggacgtcgaaggcagaggttccggagacttgctctcccgatcgccggtgcacgccggcgagcgggatggagtagtctacgagcgacggcgcagcacagagtaggaggcaaatcctagattgattttgcatgtgttgcgtgaaggcggcggctcggtttatatagagataggtcgcttgatcagggtgctcgcacgatctccactccgtgtaactgaatcggataagtcgcgcgtaacttatccggactccacgccgttttcacgcaccagatttttcggaatgtttccaaaataaaacaaatccgaatttcccgtagcaaaaaatcacaaaagcccacctcatgggatggcatgcatgaggagtttagtaccaccttgcttattctagaagagggggacctccgtgcacgacgtacgcatcgaatggtccgcaaaattggctcctcacccttgcgtagatgcagccttcttttgcagttttgttttgctgcgggaagttcggatttgttttgttttggaaatatttcgaaaaatccggtgcgtgaaaacggcgtggagtccggataggttacgcacgacttatccagttcggtcgaaatcaatctaggatttgcctcctactctgtactgcgtcttcgctcgtagactacttcatcccgctcgccggcgtgcaccggcgatcgggagagcaggtctccggaacctctgccttcgacgtcttgcaccgggagaaggcggcaataagatttttgggaagcgcttcgcgcgactgctccctgttcgtccgtgacggctcgccttcctctccgctcacgtgctgcacgtcttcatcgacgcccgcaaccacgagtagttcctgccgagcaaccggtctttccgccacctcgatgtgtgcttggcgacaagagatttgctattattgcagagagcttagagctccatcaacatggacaaaaatacagcaccggtatagttcatgaaaggtctgtttgctctcacacaaaactataaacagatccgggataacaatgtgggggtaaagtacggtctggatttcccaagaacagatccaggattttcttgatacaaatgctctcgaagctctatcacatcaagtagaaaatgaccgcttgcgcttctgaacatcaaactcaacatcaatgaggccggttataccagctttgatcttctgtcctggtcgtactgggcctacaccctcaggagtaccggtcagtataacatcaccctccattaatgtcatgatggaactgatataacttattagagatggtatcttgaatatcatatcacttgtagatcccttctgcctaagttcatcatcaacctttagccagagctctagatcatcaggattagctacatctgattttggaatcactgcactaattggagtgaaggtgtcctgtgctttacccaaagtccaaggaagacctgcagacttagccgcagactgaagttctcttgctgtcatgtccaaagcaagtgcataacctcctacgaagtccatggcggatgcttcggggacgtcgcgcgcgcgctgggagatgacaacggcaagctcgacctcgtggtgcagcgactcgaccggctccggcacctcgatggcggcgccggccacgcccgcgtggaggaacgacgaggtgggcttcaggaacagcaccggctccttggggacggggttcccgagctccttggcgtgggcgacgaagttgcggcccacccctacgatcttcgtgctggccgccaggagcctctgcgccgccgccgccatggccgccggaggagagctgcgagcggcggagggatgcgtcgatcgaggaggtggaggtggtggtg

SEQ ID NO: 3214 - DNA, 641 bp, Oryza sativa
  Clone ID: PAT_MRT4530_39492C.1
gtgtcctgtcactaatatgtctactggaggaggggatttgtcaagatcttcaaatgctcccgttgcttctggttcaccatccaattcagtctccaaaagtactggtggcagcccaccggcttctggaagtgcaaagggtgttccaccagctgtccaattgccgtcacctcaacaacaatcagccaagaatccagcatcgacgtctggagccaagtcagctcccacaaatcactatagtagtatgcctatgccatcgatccttggtcaacagccaaatgtgccgcctggttctaattcaggcagtaagcagcagtcgcacatgatgaaacagcagccatttccacaaggaggtcatttcttcatctccaatgcatacacaccacaagcccctggagctgctggaggtgttgctcttggcctttaccagaagcgctcagctgacaagacgcagcagcagcagcagccccatcagcagagcgccatgtcggctgcagccagcaataacatgaagactcatcatcctcccgctggcagttttatgcatcttgccgcagcatctcagtcttcgaggcggtgtgcctcactctcatatgtcagcggcacaattgacttttggggccccaatgtcaatgtctgtaaaa

SEQ ID NO: 3215 - DNA, 2670 bp, Oryza sativa
  UNSURE (1)..(2670): unsure at all n locations
  Clone ID: PAT_MRT4530_39564C.1
  unsure (1)..(2670): unsure at all n locations
agatcacttaatgatcactctcctttcgctaaatcatgaccatccagaccagagcatggagaaagaaaaaccaagctgctactacaaacagatcatcatcaacgacagcgaacaaaggcgaatatcgagcattctcaacatacattagggtcgatcccttctatgcgtgcatgtatcgatcgtgcgtgcacgcatcataagccgctgacgcgggagcacgtccggcggacctcgccgtcggtgccggtgctgacgccgaggctgctgagcctggcgaacgaggccgcccagctggcgaagaagctgccctcgctccgagcgaacgcatctagcgtgggcttttttcaacctttcaattcaagatcttgagaagtcactgacgaacaatgtgaacttaaaattcttgtacagaaacattccgtaatttatacacagattatccagttgcgttgctaattacactggtacaacagaacgctatgaatgtgtcgatccaaacagcacatatattattatagcagagtggtgtcacagttcaaagtgcttctaagcgaaacgagcagaataattcaatttccaaggctggtagatctggattacaatttggcgtgacatagctcagaagcacagccaaaagcagatgaaccatcatcggttcatttatcagttgccagaacacaccgcaggcagccaccttcatgcagcaggtcaaacgccttgttgatgtcagtcaggttcatgctgtgagtaacgtactcgtccaccttgatttccttgttcaagtacttctcaacgagccatggaacttggcttcggctcttgaaaccgccgaaagctgttcccttccagacacggccagtgacgagctggaatggtcgtgtagagatttcttgcccagaagcagctacaccaacgatgacagaggttccccagcccttgtggcagcactccaatgcagacctcataacagaaacatttccaatgcattcaaagctgtagtccacaccaccgtctgtaaggtcaactatgacctgttggattggtttgtcatggtcctttgggttcacaaattctgtaaccccaaagttctttgcgacatcaaactttttgctatcaatgtcgatgccaataatccgagaagcaccagctgattttgccccctcagcaactgcaagtccaactgtgccaagtccaaaaatagcaacgatggaacctgcttcaacctttgcggtattccatactgctccgaggccagtagaaacaccgcagccaagcaggcaaactttgtctagaggtgcctctgggtttatctttgcggcatttccattgttgaaaaaagtgcactggctgcatttagatatgacaccgacacctgtagcggcacgaactttgacacagaggttggtctttccactcttgcaaaacttgcattctctgcattctgcttggtaacaaggaatgacatggtccccaggctgcacctcagttactccttccccaacactttcaacaattccagcagcttcatgaccaagaatgcaaggaaatagaccctcaggatccttgccgctccaggtgtagtggtcggtgtggcagagcgcggtgaagaggatcttgacacggacctcgccggcctgcggcggcgccacctgcacgtcctcgatcgtcatcggcttgttggcctcccatgccaccgccgctttgcaggtgatgacctggccctgggtcgaggaagccattttcaccccccctccttgcacgctctgtggtagatacggtggagaaaaggatggaaaaacagagagggcagtagatgtgtagccaagaacaagcagtgagaccttgagtgacttggccatctgcaacgcgttgtcgtttgcgtactgcattgagccgtctggaatgttttgtataccacgtgctagttgccatgagagaaatccgaaaacaagtccaactgcagctccaatatttgccttttctgctgtcaactcaaactcaagttctaaaaacttcaatttcctttttactttcatagcctctacttcagattgaactactggacgttttgatagcagcttaccggttttgctcattgtttcagcaatcttcttcagctctcccttgccgtattgtcccatggacgtaaacctccttccagctgacatcagccgcttgccaaatgtgccggtcaagtagggttccattgaaggaagttgcttgacaaggttgtttgatgtcgatgtgtcagccatctcccatgcctcgtcaagaacaggcccattggagagatcaaatgccgcatcattgagatcgaggcgaaggtcgcggggaagctgggacaggaatttgggcgggagaaccaagcaatccgcgagttcttgcaagaggggaaggacaggctcctcgtcggggttgtcaccgccggtagaagaggaggtaaccggctttggggagtcggaggagacggcgaatacagggggtgggtatctacatcgccggagatggaagcgggaggggcggaaggaggaggaggtggaggagacggcggcggcggcggcggcggcggcgaggagtgggcggcggaggacggccgtggccattcgaagactccccccccccccctcctgncacgctcggtggtagatgcgatggagcagagaagggaag

SEQ ID NO: 3216 - DNA, 881 bp, Oryza sativa
  UNSURE (1)..(881): unsure at all n locations
  Clone ID: PAT_MRT4530_39566C.1
  unsure (1)..(881): unsure at all n locations
attggtttgtcatggtcctttggggttcacaaatntctgtaacncccaaagtcttttgcgacatcanacttttttgctatcaatgtcgatgccaataatccgagaagcaccagctgattttgccccctcagcaactgcaagtccaactgtgccaagtccaaaaatagcaacgatggaacctgcttcaacctttgcggtattccatactgctccgaggccagtagaaacaccgcagccaagcaggcaaactttgtctagaggtgcctgtgggtttatctttgcgacactgacatcgtgcacaacagtatactggctgaatgtagatgttcccatgaaatgataaatgggttttccatttattgagaaacggctcttgcgatcattcatcatgacaccgacccctgtggcagcacgaactttgccacagaggttggtctttccactcttgcaaaacttgcattctctgcattctgcttggtaacaaggaatgacatggtccccaggctgcacctcagttactccttccccaacactttcaacaattccagcagcttcatgaccaagaatgcaaggaaatagaccctcaggatccttgccgctccaggtgtagtggtcggtgtggcagagcgcggtgaagaggatcttgacacggacctcgccggcctgcggcggcgccacctgcacgtcctcgatcgtcatcggcctgttggcctcccatgccaccgccgctttgcaggtgatgacctggccctgggtcgaggaagccatttcacccccccccccccccccccctccttgcacgctcggtggtagatgcggacgagaagagaagggaagaggatgtgattgcgaggtgagaggagaggatagggagggggaga

SEQ ID NO: 3217 - DNA, 309 bp, Oryza sativa
  Clone ID: PAT_MRT4530_39601C.1
cccacgcgtccgcccacgcgtccgaacccccccacctcgagctctagggtttcgcggatcgaggggcgccgcggctagggtttgggtggggggtgcctgcgcgatggccgctccggcggcggagtcggcggtggtgggggtgggggtggattcatcgacgagcgccgtcgttagggatggcttcacggagcttgagcggtagcaatagcttggttgcgatctggacgcgcatgcaccaggtactcatggagcacttaaggctcgctggagcgcctttatccctagcgcattgtagacgctctgtaacaa

SEQ ID NO: 3218 - DNA, 185 bp, Oryza sativa
  Clone ID: PAT_MRT4530_39942C.1
acggcacgaggcgcgagcagagcaagcagaccaagcagcagcagcgatagccgccgcagccacgacatactcccacctgctacctgctactacccgccagcaggcggtggcctcgctccaatgcggcctctacctataccggaggcagcccggcaggctcgccggcgggtcgtcggccccgagcg

SEQ ID NO: 3219 - DNA, 2592 bp, Oryza sativa
  Clone ID: PAT_MRT4530_39949C.1
caggggcacagcgggctgccggtgtcggtccccccggcggaggagcaggaaagactgccgtcgttttcgttctcctctgcttcgcctcggccacgctgcggccacctcctttctgccacggcaaaagcctcctcgggatgctccactgatcgtcttctacttactcctctttcttccagcttggccggcgtgtggctgattattccagaatttccattagcttaatcaccggatcaagaagaatgagagaaaggggggagaggctcttttctgtgggatggcatgattccgttttgtaggagcagcgcaccatttcagatttcttcctcctcctcttcttctttccgttgtgcttgctgcttttctctactaccttttccactgttgcgaagtcgggttggtgggtggttgattgattgttctttccttcctcgtgagggttcttgcttcttggcttcttggccgcttcttgagttggggctagctggttcttttgctgtctctgtcccgtcaaactgaagcgagcgagagattgaccgggtgggtgattcttcttcgaggagcttcttcttggagctcgtgagagtggagtgatcgaggtggtggtgtgagagcagtagacaggtttttcttggggagcttggaggtagccggagttgggggaggaggaggaggatggccgccgcgccgccgcccaaggccgacgagctgcagccgcacccgcccaaggaacagctcgccagcgtgtccttctgcatcaccagccctccgccatggcccgaggccattatattaggattccagcatttcattgttatgctgggcaccactgtcatcataccgagtgcacttgtacctcagatgggaggaggaaatgatgaaaaagctcgggtaattcagacgctgttgtttgttgccggaataaacaccttgttccaaacattcttcgggtctcgtctccccgttgtgatgggtggctcatacactttcgtcgcaccaaccatctcgatcattctggctggacgttacaacaatgaagcagaccctcgtgagaaattcttacggaccatgaggggaacacaaggtgctctcatcatcgcgtcgacgattcagatgatacttggtttcagtggtctctggcgcaatgttgttaggttgttgagtccattgtctgcggttcctcttatttcacttgttggatttgggctttatgagcttggttttccaggggtagctaagtgtgtggaaattggtcttccagaactcatcctacttgttgcattttctcagtatttgcctcaagtgttacattttgggaagcctatctttggccggtttggtgttcttttcaccgtttcgatagtgtggctttacgcgtacattctcacaattagcggtgcttacaagaatgctccaccaaagacacaggtgcattgccgtgttgatcgctcaggccttatttcaggagctccttggattagagttccttatccctttcagtggggagctccaacttttgatgctggtgaagcctttgcaatgatgatgacttcatttattgctcttgtggagacaactggagctttcattgctgcttcaaggtatgcaagcgcaactatgatacctccatcaatcattagtcggggcatcggttggcagggaatcagcatcttgattgattctttttttgggacggccaatggaacctcagtttcagtggagaatgttggtttactcgctttgacacatgttggcagcaggagagtagtgcaaatatctgctggtttcatgatcttctttgctatccttggaaaatttggagcacttttcgcatccattccattgcctatatttgcgggcatgtactgtattttcttcgcttatgtcggtgcctgtggtttgagtttccttcagttttgcaacctaaacagcttcaggaccaaattcatcttgggttttgctttcttcatggggatctcagttcctcagtacttcaatgagtacacagctgttgcaggttatggaccagtgcacactggtgccagatggttcaatgatatgataaacgtgccgttctcgtcgaagccgtttgtcgcgggtcttgtggcctacttcctcgacaacacgatcgagacgcacaataacacggtgaggaaggatagaggctaccattggtgggacaaattcaggagcttcaagaaagacgcgaggagcgaagaattctactcgttaccgttcaatctgaacaagttcttccctgctgtctgaatgatctagcaaatgtcacccaagcaaaaatggttcatgtctgaacataattctgctggccttcttcagtgttgctgtgcgtcagttttgtgtacttataataggcgaatcttactaattggacaacggagatgtgccttagaatgggaatatcatgtctatttttttgtcctacaatgatttatgtgtcattacctaggtctttctcttatcaagttgtcaatgacccaatgtacatgtggcttttctatcggatagtattagtatcacatttaacaaaaaaaaaaaaaaaaaaaaaaaaaaaaaaaaaaaaaaaaaggcgag

SEQ ID NO: 3220 - DNA, 2506 bp, Oryza sativa
  Clone ID: PAT_MRT4530_40043C.1
tctcccccaaccaaaccccaaagcatatcacaatcactcgggagggaagggccccttatttattcgcagtcctctcctcatcatcactcatctcccttccctgtcgattaccttctctccttcctctgttcctcctctcctccacacatccaggcaggcaacacaagaatcatccgggagagcgacatggccccggttgccgtgggcgacaccctccccgacggccagctggggtggttcgacggggaggacaagctgcagcaggtctccgtccacggcctcgccgccggcaagaaggtcgtcctcttcggcgtccccggtgccttcaccccgacctgcagcaatcagcatgtgccaggattcataaatcaggctgagcagctcaaagccaagggtgtagacgacatcttgcttgtcagtgttaacgacccctttgtcatgaaggcgtgggcaaagtcataccctgagaataagcatgtgaaattccttgccgatggtttgggaacatacaccaaggcacttggtcttgagcttgacctttcggagaaagggcttggtattcgttcgagacggtttgctctccttgctgacaacctcaaggttactgttgcaaacattgaggaaggtggccaattcacaatctctggtgctgaggagatcctcaaggcactgtaagagcttcagctcttaggaacggcagcgatcacttggacctatcgtgtcaatcttgtttaaatttgtctgcaaaatacttgtgcgaataaaattgtcgatgagctgcctagttgtgaggactttatgataatgtttgaatctgtatccactgttgaatcaagtagtaatgttcagtgctcatgttaagttataatcttcaaaaaaaatctccaaaaaaaaaaattttttttttttttttttttttcctttttagattgcaactgttattattataagccgaagctgtaggtgcactgggtgatgggtcaacaccagagaatcaagcataaagaaactgaacatgtggatgatcgagaattacagcagccacagtatcccagaagtccataacatcaggatataacgaccaatgttatctctcggacaccatcctgttcgtgctgataatgtttggacctcagttgataccgcgtcaaggtttactaacaaatgtgtaaactaccaaactatataccagcaatgtctaccaaaatctgacgtggaaatgatgcgaggaatatcaattgctccagaaaatgcataaccttgctagctctgattcagacatcatgcagagtaccttgatggttcctgctttaatctagcttatcagtaaataagaacttcgctgagcttttaccacctataatgaacagcggaggggtattcttgttggatgacagctgctttcacatcccacaacttaaccgcctaatctaatttaaaatttcaatgtacaacatcacataatatcagggcgtctgactccagcaactttgtcccattcctctggggagagcatgtcagccatgtacttctcttgaccacgccaaaggatcttgtcaatgacaccaaactcctttgccttcaaggaatccatataaaatggtcctctcatcaccttgtctattttctctggtggattccccgtgtgccttgctaaaagtctcactaaggtgttcctgttgtgcacaacctctttcgcccgaataacaacatcagatgcttgcatcattccatatgaagggatacgaggttgctgaatcatagctggcatgatagaatctttggcatgagggaacatatagcgttttcctttctttcctgctgcaagtacaagacaggcatgacctgccgcagctcctatacaaagtgtatggatcctaattttctcagttttcatccgcatcatggcatcatagatagcaaaaccttcactctccattccaactggttcaccatcatcacgagctgttcctgtggagttgatgtatatgtaaacaggttctttactattcatccactcaaggtacatcaactgcgcaacgacaagctctgtaactgctggcaccaacggcatgccaatgtaaacaattcggccatgaagaagcaatgatggcaagtcagggggaggccttctaggcctgtgctggctgtaagaactgctagatcgttccacctgcgcgggcgaggccatgagcttggcgttctggaagatctcgaggaacggcaggtggtcgtcgccgcggcgcccgccacctgccgccgcagcctggagctcctccggcgaggcggcggcgagggtggacaggaacgggtcggccctcgggttgaagagcgggttcgggctcccccccgacgccgcccgcgccaccagcgcggaggacgccgccgcgccaccccgcgcctggcggagcaaggtcggaggcagggagaggaacgaggaggaggccccggaggaaggtgcagtggagggcgtggggaggcggagcgacagggaggcggacgccat

SEQ ID NO: 3221 - DNA, 861 bp, Oryza sativa
  Clone ID: PAT_MRT4530_40136C.1
atgagcgggcgggggaggggggacccgctggtgctggggagggtggtgggggacgtggtggacccgttcgtgaggagggtggcgctgcgggtggcgtacggagcgcgggaggtggccaacggctgcgagctccgcccctccgccgtcgccgaccagccccgcgtcgccgtcggcggccccgacatgcgcaccttctacaccctggtgatggtggatccggacgcgccgagcccgagcgatccaaacctcagggagtacctgcactggctggtcaccgacatcccggctaccacaggagtctcttttgggacagaggtggtgtgctacgagagcccgcggccggtgctggggatccacaggctggtgttcctgctgttcgagcagctggggcggcagacggtgtacgcaccggggtggcgccagaacttcagcacccgcgacttcgccgagctctacaacctcggcctccctgtcgccgccgtctacttcaactgccagagggagtctggaaccggaggaagaagaatgtgagctagctctcccctctctatctctcactccctgaatttgggacaagtcctgaattttgcatgacaaatcctatactcggaacgatttgaaatggtaaaatttgatcatatgtatttttagctccctatcctctctctctgtacgttagttacataaatgctcccaccgattctaaatgtaatttatttatatttctctatttttctcgaaatttaagttgttataggacgttgaggaactttgtcccccatttttcctttcatacccttcattgttaagggaaatgctaccactctgatatatataaaaatgatgtaccattttcaatat

SEQ ID NO: 3222 - DNA, 1423 bp, Oryza sativa
  Clone ID: PAT_MRT4530_41010C.1
ggagagagagaactagtctcgagtttttttttttttttttttttcctaaccttttctctttttttatctgaatttaaattaggaatacatgaaaaacttcacatccaggacagagttgcaaggatgatacaattacaaatgcacataaagtactacgtttggatccagatccaaattcaagataaatacaggatatgactggtaatctagcattgaaccatgaccaacatatatgtcctcaatacaacaggcaattcaaaattgaacaataattaacagacttcttttcaaattaatagctgacatccttttctttcaaaatctggtcagaagcaagccgttgatccatgttagtggcaaggcaaagtctacgttgttccattgcatgtagcatatacactaaaacagagatgcacgagaagggtttttgcataataaaccatttttcatgacagtttactacactagtaacattcaagatatcaacatcagatagtggcttgatgcactgatttcttggcccaggtccaattactccaccaaccagatatatgttgtctcccaaaccaatcatcccaaaacctatcctgctttggaattcagatgcacacgacaccatcttatcagggaaattcacaccacgctgcttcataatgcaactattgctcagcacataaagctccccacgaaccattgccatcggaccttgcagccaagagtagtcctcaacagcccaagcattgccatcttcaagaatctgcactgttggtaggcctttgtgcaatacatgcatcttaccctttatgacaagtccagagcatgcagagctgtgtgcttgacgtaggtcagggagaggctcccacgtgtcagcttcagggttataaatctcagcctttgatattgatttgcggcaatttgtgaagcccccagcaacaattatgttcccatccagtgcacaacaggcaaacattgcgcgagctacaagcattggagccctctggacccataaacgacagagaggatcataagaccaaacctcattgcttgcaaagatcctgtcatggtctccagtaagtgggtcaactcgatcactgccaccaccaattacatagagcttgcctgcaaccgaggccactccaaaacgagcaatattcctaatctgagatggcatgacaggaagggttatccacttatctcgaagagggtcataaagctgccacatgttttcaggttcaaatgctaacacacataacaggtcttcagtcgcactaatctgattcctaactttggaaagctcaccatttcgaacagatgctctccaagaatggcagaccatttgaagaacaggatgggacaaaaatggcacccgtgcaaggcactgaagagcaacttcattagggagaccatcaattagtgttgacat

SEQ ID NO: 3223 - DNA, 446 bp, Oryza sativa
  Clone ID: PAT_MRT4530_41055C.1
cttctgtttggtaaagcgacaggcagaactaagtacagggggggatgtttgaaagcatcaggccggttgcaagagcgccaacgagctgctcccgcccagcgccagtttcgtgaagctgtcggacatgagccctaaacagtggagcgcattcctcgacaagctccaggagctgctcccaggtgccctgagcgcccggaagcacgctgccggtgtcgtcggccagcgctcgatgccgaggctgggcacgccttgccagttctgagagttgcagaagagaagcccaccgacccaagggtccacgaacgcgcttctgttcgagctctggtgtgcagcagacaagcaggtacggagtattatataatgcttgcagcaagtgctctgggcccgtggtggcagagagggttcccgaataagatcatccatggcatgtgagatgaggctgcggg

SEQ ID NO: 3224 - DNA, 239 bp, Oryza sativa
  UNSURE (1)..(239): unsure at all n locations
  Clone ID: PAT_MRT4530_41126C.1
  unsure (1)..(239): unsure at all n locations
actagtattggtanataattaaaactgcaaatccgtcatgcatgcatggtatgcccatcgatccanccatgattatntntagttanatgtagtaacaaactgcatgggngtgttgtgctcatcagtgttaattttggccgcccccctgttnataaacagtttttgatcgatganagctagctttngttttntttttaaaaaaaaaaaaaaaaaaaaaaaaaaaaaaaaaaaaaaaaaaa

SEQ ID NO: 3225 - DNA, 3136 bp, Oryza sativa
  Clone ID: PAT_MRT4530_41131C.1
ggcacgaggcaaagcaaagcagcgaatccggcttcactagtcttcttcccccccgccgccgcatcgatcccccttcccctcgtcttccttccctttcccccaatcagattgcttccagaagcctccttccccgcgaagcaaccaaccccttccggatcccgactccatccaaacccccatcccctcccctctcccctacgctcgaaaccctagggagatccatccacatgccgccccgatgaggtcgctccgccgcgtcctcctccagctcgtgctcctcgccggcgtcgccttccgcggggtccgcttcgacgacgccgccgacgccgccgccgccgcccaggggtcgtcagacctcttcgagctcccttcgccgtccccgactctcgcgctccccggcggcggggatgagggggcctcgacggagatcatcgccgcgccgtggccggggcgccacggcctgttcacgccgccgcggagcacgtcccagccggcgagagcggtggtccagccggccgccgacttcggctcccaactccagttttacgacaatggtacaattcaactagtggaccttctatcaaaattgcctcggtggcagttctccaccggaccccctctttcgaagcatatcactacttcgaaacctgatttgaactatgtcatataccttgatgggtcagaaacatcggaccttatagaagttcataatggcagtggtgtgagacttccctggaaactggaggagtttattgctgagactccatatatacgggattcttttgttacgattggatcaaaggtttcaactacttttgtggtcaatgctgatagcggtgagatcatttacaagcatagcttgccagtggccttgaacgaggtaggtggccccctggttgaggaaattccatccaagttagatgctgctagaagtggtacaagtgctaatatcatagtggttgtgagaactgattattctatcagtgcatcggatcttggggaacatttgttcaactggacaagaacttccttcactgcaaattactatgcgaggtatggccaccaagacatgcttgcccaatcgtcctgtctgcgaggaaatattccatgcattaggactgagggtccaccaattaaactttatttacctgattcaagttcagataatgcaattgtcttgagacctgtgaacgaagtttctgctgtggatgctctggaaccacttctacctccaaagaagttaccacaacctgctggcgagtctaatgtggccttggatagtgctcaaaaccagactgctgacattgccctaggtcattttgtgcctgctgacactgaattgaccaacagtgtcactaaattttcttacagatggctattccccacgtttctcatgttgttgatcatggcttgtctagtgaaattggccgatgcaagcaaatattgcaggcaatttgtgattcgatttttgaagccatttatgcgtgatgagaaattgatggacccaagaggcaaatcagagggaacatcaaaaagaaggaaggcgcggaagaaagatggacttatcaatagcactcagatcttttcagcatctgataaagaggggaatggaactggtggatcaactgaggcacaaagtaataaagcacatgattcaacaaatgtggaactccctaatggcctcaatgggcgtcagattggtaagctttgtgtttacagtaaagaaattggtaaagggagcaatggtacagttgtctttgaaggctcctatggtggtcgggaagttgctgtgaaacgtctgctgcgctctcacaatgatatagcctcgaaagagattgagaatctgattgcatctgatcaggatcctaatattgttcgaatgtatggttttgagcaggacaatgattttgtttatatctcccttgagaggtgtcgctgcagcttggctgatctaatccaactgcactcggtaccaccattttcaaatactaagggaacagacattgaactttggaggcaggatggacttccttcggcacaacttctaaagctgatgagagatgttgttgctggtattgtgcatttgcatagtttgggaattatacatcgtgatttgaagcctcagaatgttttgataagcaaggaaggacctctcagagcaaaactttcagatatgggtatcagtaagcgtttgcaggaggatatgacttctgttagtcatcatggcactggatttggaagctctggttggcaagcacctgaacagcttcgtcatggtcgtcagactcgagccatagatttatttagtttgggctgccttatattctattgcattactaaaggcaagcatccgtttggtgagtactatgaacgggacatgaaaatcataaacaatcaatttgatctcttcatagtggatcacataccagaagcagtgcatcttatttctcaactgttagatccagatccagagaagagaccaacggccgtgtatgtgatgcatcatcctttcttttggagccctgagttgtgcctttcatttctacgagataccagtgacagaattgagaaaaccagtgaaactgatctcatagatgctttggaaggcataaatgttgaagcatttggtaaaaattggggagagaaattagatgctgccctgcttgcagacatgggacgttatagaaaatatagttttgagtccactcgtgaccttctaagattgatcagaaacaaatcaggacattacagagaattttcagatgatctcaaggagctacttgggtcgctgccggagggatttgttcagtatttctcaagccgattcccaaagctgctaattaaagtctacgaggtcatgtccgagcattgcaaggacgaagaagctttcagcaaatatttccttggaagctcggcgtagctgtaacctgcaggaggggtgaaggccctgccctgcctagtgtgtacactaacactcttctagcaaaaatgtatgtacatgtgatttgtaccatatatcatagggtaaagaaagttcagcctgtacattgtattccacagaattgtgtattacttatagtaaatcaaatcttttacctgactaaaaaaaaaaaaaaaaaaagtttaaaaaaaaaaa

SEQ ID NO: 3226 - DNA, 2109 bp, Oryza sativa
  Clone ID: PAT_MRT4530_41161C.1
tcatggagcgaaaaggacgctgaatcgtgggaaaggtgtgtggtggccggtgcccgacgacggcgcctggcgatgggtggggagaaggtgagcagttgtagttgggacccgtgccacacccccgcacgtgcgcaagtccatgacgtgagcgctcccggtcattaggagccacgtcagctggcggcctccgccgttgagcttttccccataggcaggcgacaacgcggcagcagagcgctgcacgacctccgcctccccaatccgtcccgtctcctcgcccgccgccctcgactcccgtctcctcgcctgccgctggcgccgatctccatcctgctagcagaggtggcgccggcgtcctcctgctcccgccgcattcgcatcctaatccatcccatccggcctcggcctcgaatttcgtctcctcgcccgccgcttgcgccgatccccatcctgcgagcagaggtggcgcccggcgtcctccttcttccaccgcatcgtcgctcgccgctcatggatcctgagatctagacgtcaacgtgcttcctggaaagagagaggctcaggcatgagagcatacctctaaaataatgtccgtgcttacctgtgtgcttgataacatgggctcatcctgtagcagatctcattctttaagtgaggctgaaacaaccaaaaatgcaaaatctgcagacattgacaggcgaattttgcaagagacaaaagcagagcaacacatccacaagctcttacttcttggtgcgggagaatcagggaagtctacgatatttaaacagattaagctccttttccaaactggctttgatgaggcagaacttaggagctacacatcagttatccatgcaaacgtctatcagacaattaaagtatgcaatactggaaaagatactatatgaaggagcaaaagaactctcacaagtggaatcagattcctcaaagtatgttatatccccagataaccaggaaattggagaaaaactatcagatattgatggcaggttggattatccactgctgaacaaagaacttgtactcgatgtaaaaaggttatggcaagacccagccattcaggaaacttacttacgtggaagtattctgcaacttcctgattgtgcacaatacttcatggaaaatttggatcgattagctgaagcaggttatgtgccaacaaaggaggatgtgctttatgcaagagtacggacaaatggtgttgtacaaatacaatttagtcctgttggagaaaacaaaagaggtggagaggtatataggttgtatgatgtaggaggccagaggaatgagaggagaaagtggattcatctttttgaaggtgttaatgcggtaatcttttgtgctgccattagcgaatatgatcagatgctatttgaagatgagacaaaaaacagaatgatggagaccaaggaactctttgactgggttttaaagcaaagatgttttgagaaaacatcattcattctgtttctcaacaaatttgatatattcgagaagaaaatacaaaaggttcctttaagtgtgtgcgagtggtttaaagactaccagcctattgcacctgggaaacaggaggttgaacatgcatatgagtttgtcaagaagaagtttgaagagctctacttccagagcagcaagcctgaccgtgtggaccgcgtcttcaaaatctacagaactacggccctagaccagaaacttgtaaagaagacattcaagttgattgatgagagcatgagacgctccagggaaggaacttgattcagagctaagactaggttgtaagtcacacagggaaggtaattaggacggcgagaggaacaaagtttcacactgtcacagctttatctgttgtaattcttttacacgtggaccattgattgatcttttggttcttactgtgggctgttcaggtctgtaccctattttttgttctctagttagccattgtgcaaattttccttgaatcagattctctacctgttgtctatgtgtgttatcttggtctgttaatttgcatagcccacttgttcattaaaaaaggagatctttactacttacaaaaaaaaaatctagtgggaaagtggttgc

SEQ ID NO: 3227 - DNA, 1200 bp, Oryza sativa
  Clone ID: PAT_MRT4530_41323C.1
atggccgccgccgccgatgctcccccgcctcctccggaggtcgccccgcccgcgcccgcgcccgcccccgcgccggcgccatatcagccgccgcggctggcggtggccgacggagcgggaggtggcggcggcggcggcgggaagccgtgcaggcaccacgcgtacagccgcaagcagaagtcgctcggcctcctctgcaccaacttcgtggcgctgtacgaccgggaggacgtggagtcggtggggctggacgacgcggcgaggcggctgggcgtcgagaggcgccggatctacgacatcgtcaacgtgctcgagagcatcggggagatgtcactgagggcggtgtcaagcgtggcgtcaccgtcgctggatgaaacatctgctgctaatgtctcggatgatgaggatgatgacaagttagatgatgctgagggcgatgcggagagcgagaagctcagcctcagccagtccattgacaatccttctgataagcctgatgcacccccttgcaagcttcgatccgagcataggaaggagaagtcccttgggctgctcactcagaattttgtcaagctcttcctcaccatggagattgagacgatctcacttgatgaagccgcaaagcggctccttggagagggacatgcggcgaacaatatgagaaccaaagttcggcgattgtacgatattgccaatgtgctgtcttctttgaatcttattgagaagacacaacaggcggactcaagaaaacctgcattccggtggctgggccaggcaaaacggaatgaaggcgtcacggttgctttacccccaaccaagacgttgcctaacaagagagcatttggtactgatctgactaacattgacaataagaggggtaagttggactccacaatggagaacagaggcaagcccacgcaggatggtggcaacctattcaataatttgcagaggcaattagggcaagagaacaggagcgattttgtttatggccccttccaccctgctgttgcaaggaaacaagaacatggtaatcgcacagtacaagagaaggagaggaagagcattcaagactgggagaaccttgcttcttctttccgtccgcaatatcaaaatccaggactgaacgatctttttggccactacatggaagcatggaggtcatggtactcggatctcaggcgagacagagcatcataa

SEQ ID NO: 3228 - DNA, 1764 bp, Oryza sativa
  Clone ID: PAT_MRT4530_41649C.1
atgtcgtacgatcgcgtcacgaccttcgaggactcggagaaggcgggcgagtacggctacgtccgcaaggtttctggacctgtggtcgtggctgatggaatgggtggtgctgccatgtatgaacttgtccgagttggtaatgataacctcattggggaaattattcgtcttgagggtgattcagccaccattcaagtttatgaggaaacagctgggttgatggtcaatgatccagtgttgagaacaagaaagcctctttcagttgaattgggacctggtatccttggaaatatctttgatggaatccagcgccctctaaaaactattgctataaagtctggagatgtgtacataccacgtggtgtttcagtccctgctcttgacaaagatcagttgtgggattttgagccaaagaagctaggtgttggagatgccatcactggtggagatctatatgctactgtgtttgagaatacgctgatgaaacatcatgttgcccttcctcctggttctatggggaaaattagttacattgcaccagctggccagtatagcttgcagacatggcctgtccggtcaccaaggcctgtttcatcaaagcttgctgctgacacgcctcttctaacaggacagcgtgtacttgatgcactatttccctcagttcttggaggaacttgtgctattcctggagcatttggttgtggaaaaactgtcattagtcaggcactttcaaagtactccaattctgaagctgtggtttatgtgggctgcggggaaagaggaaacgagatggctgaggtccttatggacttcccacaattgacaatgacattgcctgatggacgtgaagagtctgtcatgaaaagaactacacttgttgctaacacatccaacatgcctgttgctgctcgtgaagcctccatttatacaggaattacaattgctgaatacttccgtgacatgggctataatgtcagtatgatggctgattctacttctcggtgggctgaagctttgcgtgagatttcaggacgtctggctgaaatgcctgcggatagtggttaccctgcatatttggctgcacgtttggcatccttttacgaacgtgctggtaaggtgaaatgtctcggcagtccagatcggacaggcagtgtcacaattgttggtgctgtctctccacctggaggtgatttttcagatcctgttacctctgcaactcttagtattgtgcaggtcttttggggattggataagaagctggctcaaagaaagcatttcccatctgtcaattggctcatctcttactcaaaatactcaaaggctctggaatccttctatgagaagtttgatcaagatttcattgatattagaacaaaaagctcgcttgttggtaaagatgcactggcagaatctgataagattacattggaaacagccaagctactaagggaagattacttggcacagaatgcatttaccccatatgacaagttctgtccattctacaagtctgtttggatgatgcgcaacattattcatttcaatacattagcaaatcaggctgtggagcgtgcagctaatgctgatggacaaaaaataacatacagtgtcataaagcatcgtatgggtgatctattttatcgcctagtatctcaaaagtttgaggaccctgcagagggtgaagatgtcctagtcgcaaaattccagaaattgtatgatgacctcacaaccggattccgcaacctagaagatgaagctaggtga

SEQ ID NO: 3229 - DNA, 776 bp, Oryza sativa
  Clone ID: PAT_MRT4530_41651C.1
tctccctcttcgcttctcctctcccccccgtgatctgaccgccggcgacgaccccctcccaccacccgccgccgccgccgcgcccccgcccccgccggcgacgaccaccatgtcgtacgatcgcgtcacgaccttcgaggactcggagaaggagagcgagtacggctacgtccgcaaggtttgggggcctgtggtcgtggctgatggaatgggtggtgctgccatgtatgaacttgtccgagttggtaatgataacctcattggggaaattattcgtcttgagggtgattcagccaccattcaagtttatgaggaaacagctgggttgatggtcaatgatccagtgttgagaacaagaaagcctctttcagttgaattgggacctggtatccttggaaatatctttgatggaatccagcgccctctaaaaactattgctataaagtctggagatgtgtacataccacgtggtgtttcagtccctgctcttgacaaagatcagttgtgggattttgagccaaagaagctaggtgttggagatgccatcactggtggagatctatatgctactgtgtttgagaatacgctgatgaaacatcatgttgcccttcctcctggttctatggggaaaattaggtacattgcaccagctggccagtatagcttgcaggatacagctctggaactgggattccagggcctcaaaaagcaatttactatgctccagacatggcctgtccggtcaccaaggcctgtttcatcaaagcttgctgctg

SEQ ID NO: 3230 - DNA, 276 bp, Oryza sativa
  Clone ID: PAT_MRT4530_41696C.1
atggagagcaccgagctgaaagtggagatggtggcactgcatgagaagagggtacgaaaatgcctgtccaaagtgaaaggggtggagagggtggaggtggaggggagcctgcagaaggtggtggtgaccgggtacgcgaaccggagcaagatcctcaaggcgctcaggagggtggggctcagggcggagccatggtcgccgaggaacgagctgctcagcgcctacgccgccggcagcctcatggcggccaacaactactaccacaccttcttctga

SEQ ID NO: 3231 - DNA, 2019 bp, Oryza sativa
  Clone ID: PAT_MRT4530_41750C.1
tttccttcctctcctcggggtttttgttcacaaacgagcggctcgcctgcgccgcgtggattccccttcccgccgatccggcgatggattcggcggcgagagcctcgcagtcggcggcgccgccgccgcccggcgccggggtccgcgtccgcgccccgctggtagagtctgtctcatgctactgcagattagatactggtctgaaaactgttgttgatgctagaaagtttgttcctggagcaaagatgtgtatgcaacctgatgtcaaacccaacaagtgcaaatcaaggggctctcgtaaggagaggagccgaactcaagcaccacttttgcctggtcttcctgatgaccttgctattgcttgtctcatacgggttcctcgagtggaacatcccaatcttcggatagtttgcaaaagatggaaccgtctcttatctgggaattactattattccttgcgcaagagaaacgggatggcggaagaatgggtttatgtctttaaaagggaccgtgaaggaaagatatcctggcatgcctttgacccactgcaccagctatggaagtcacttccaccagttccagcagaatattcagaagcattaggctttggctgtgctgttctgagtggttgctatctgtacttatttggcggtaaggatcctctgaggggctctatgaggcgtgttgtattttacaatgctcggacaaacaaatggcaccgagctccagatatgttacggaaacgacacttttttggttcttgtgtcataaacaattgcttgtatgttgctggtggggagtgtgaaggaatacaaaggacactcccgtctgctgaagtttatgatccaaataggaacagatgggcctgcgttgctgaaatgaacaatgggatggtacctttcattggagttgtatatgatggcaagtggttcctgaaagggcttgattcccatcgccaagtgacgagtgaagtctacctaccatcatccaatttatggtcaaccattgatgatgaaatggttaccggctggcggaacccaagcattaccttcaacggaaagctctattcatctgattgtcgagatggctgcaagcttagggtgtatgatccaaacacaggaacatgggcaaaattcatggacagcaagcaccacctgggcagctcgcgcgcctttgaagctgcagcgttggttacattaaatgggaagctttgcatcgtccgcaacaacatgagcatcaccctggttgacatctccgacccaacgatgagcattgagactgacagtgcacgcatgtgggagactgttgctcggaagggccagcacaggtcattcgtggcaaacctgtggtcgaccatcgcaggaaggaacctgaagagtcacattatccattgtcaggttttgcaggtttgaggtcagcctgttgtgaatctgaacataagcagactagcagaaacaatccctccattgaaaggtcaattagattccataccgaaattgtggcagaagaagctcattgcccaaacagatctttgttcattagattaccagaaaacaccaattcagtattctggaaatttgaagctactcataaggtaggagatggatgccgaaaacttttgtgcaaactggaaactgagaagagaacttccttaatagttgcggtgataggggggagaatatgcatcggtggataacatttcactaagttggaatatccatcttcagcctctcactgtcactgatcactgtacttatctatgttgtatcatgccctcttggcatactgcttagtgtgcttaatgttggctctatgttgtagcggcagattagacttgagagtagagaagtaataagcctattggttactgtacttgaaaaatccgtatgtcctggtatcatgtgctgtaaatcttcgtaattacccctccaactctccaagcatttcattgcaccatcctgtctctatttaattttaatgtttagatgatttgagctgcaaaaaaaaaaaaaaaaaaaa

SEQ ID NO: 3232 - DNA, 2377 bp, Oryza sativa
  Clone ID: PAT_MRT4530_42077C.1
ggcagcctccatgccgtgccgcctgcctctgcgcatctggctggctatcttacctcccttttctgcgccgcgtcctcctctctctcctttcccctagggctctagctccaccgcctctcggccaccgccgctccccgccgccgccgccgacgacgcgcgagggagtgtggtgaggactgatgaacttctaaacattgggtatggatggatgtgactgcatcgagccactatggccaactgatgagctcctcatcaagtatcagtacatctcggacttcttcatagccctcgcatatttctcgatcccgttggaactaatttatttcgtgaagaagtcatccttcttcccatacagatgggttttgatccagtttggtgcatttatagtcctatgtggagcgactcatctcataaacctgtggactttcaccacacacacaaagactgttgctatggtcatgacagtcgcaaaggtttcaacggctgttgtgtcctgtgcgacagctttgatgcttgtacatattatccctgacttgctgagcgtgaaaacaagggaattgtttctgaagaataaagctgaacagcttgatagggagatgggcttgattaggacacaggaagagactgggaggcatgttaggatgcttacccatgaaatcagaagcactcttgatagacatacgattttgaagactacacttgttgagctaggagggaccttgggcctggaagaatgtgccctatggatgccatcaagaagcggttcaagtcttcagctttctcatactctccgccaccagattactgttgggtcaactgtatcaattaatcttcctgttgtcaatcaagtgttcagtagcaacagagcaattataataccccacacatctcctttggcacggatccgacctcttgcagggagatatgttccaccagaagtggctgcagtgcgagttcctcttctacatctttcaaactttcaaataaatgattggccagagctttcagcaaagagctatgcaatcatggttctgatgcttccatctgatagcgcaagaaaatggcatgtgcatgagttggagcttgttgaggtcgtggctgatcaggttgcagttgcactttctcatgcagctattcttgaagagtccatgcgtgcgcgtgatctgctaatggagcaaaatgttgctctggatttagctcgacgtgaggctgaaatggctatccgtgctcgtaatgatttcctggctgttatgaatcatgaaatgagaacaccaatgaatgcaataatagccctttcgtccttacttttggaaaccgaacttactcctgagcagcgcttgatggtggaaacagtcttgaaaagcagcaatcttttagcaacactcatcaatgatgtgttagatctttccaaacttgaggatggtagccttgaattggagattaaagcattcaatcttcatgctgttttcaaggaggtaatgagtttcatcaagccaatcgcagccatcaagagactgtctgtgtcagttatgttggcaccagacttgccattatgtgccatcggtgatgaaaagaggctaatgcaaactattttgaatatctctggcaatgctgttaagtttacaaaggagggccacatcacacttgtagcttctgttgtgaaggctgactctttaagagaattcagaaccccagattttcacccaactgcaagcgatgacaatttttatttgaaagttcagattaaagatacgggctgtggcattagccctcaggatctacctcaagtatttacaaagtttgctcaatctcagcctggaggaaacagaggatacagtggtagtggtcttggccttgccatttgcaagaggtttgttactttgatgggagggcacatctggttggatagcgaaggaacaggaagaggctgcacagtaacgtttgtcatccagcttggcatatgcgataatacgaatgcatatcagcagaagctgattcctctagtctggccaagcagtggggatgctgattttgttggtccggtgccaaatgctcctaatgaagagaaaggtcaggcttctctgaaatctcggtatcagagaagtatatgagctactgtaaattgatcgacggcattgtatcaagtagggcctggttagtttgtctctaattttgtgcctagccttgtgatagctggaatatatttgtacaaataatgtacagcagatgggactgcataatgcagctatgcacctgggtacaactctaacttgcgtagtgtcctgtcagcgaaatgtgtattctgggctgttcgtgtgaccatcaaaaaaaaaaaaaaaaaaaaagaaaaaaaaaaaaaaaaaaaaaaaaaaaaaaa

SEQ ID NO: 3233 - DNA, 3797 bp, Oryza sativa
  Clone ID: PAT_MRT4530_42120C.1
gatctcaacaaaactttggatatatagaatgaaccatcgtgtcaaacaatacttacacgaaagctaggcagccctcctggagtaaacatagtaaagaagggctgccagggccaaatagttgcatccagcagttttgacaggacataatcctccttttcaaaaaaaaaaaaaaggccagcttccacaagaacttcagtgatttaggaagcttttcttgctgaattaatgcttccttaacatgtttttcattatcgacattgtaaccaatttcttttgtccgtattcctggatggaatcgatttttactccaaaatttccacataccaaaatctcaatgggatgagatttcggaatgctattcacagctcaaggaccacacacataaactacatgacttacatggcaaaatcggcatctccatcaagtatggaaatgctagtgtttgtttgctgtctttgtatcgtccactggttttcttcatatattaatgataaacagatgggggcttggtgtcactgtgcccgtatatccagttgtttcagagcagacctcatgtcatcagtgccataaccctcaattccaatgatgtttgggctatcaagtgcaacaacatcttgtaaaggataccgcctaacagaatggattctatttgcagatgtgttgaattcacccttaaggatgaccgtcttatgaagacctccaaacaattcttcgtaatctgaatcaccagtttcaccaacaagaaccaccacattttgcaactctatgccccagcgaacagataagtaccttagagccttagaccgtgatgcgtggattggaattacagatagtctggtagcaccatggttatacagagcgtgacaacggagtgactgaattctcatcaacttttgcagctcctttaaaggaggtaaatgatttggattgaccactttaaatgcaagacagtatgttgaagagtgctctggatcttcgaagataacttgtttttcaatcctccctcttctttctaccacggaagaagcccacttcactagatatttccttaaaccttctcctccccaatgatactctatatgtgattggtaactacgatctaatgcaaatgtaacacgggagttgcttggtgtatcaccagtacatgaaggataatacaaatcacttccactattgcatatgaaagcatcgaaatcagtaggaagcatgccagcagacattaatagagaatgtatctcccctattgtcagggaagttgacaacacaaaacctgtcgatcctgacaaattttctttacgtgcagcctcgatagaatttctgacaatgcgaatcagatcttccttactgacagaatctacagcaataacagtgacatgcttccttcccttaataggtgccttaatccggtcttcattgcttgcaaaagcaggatgccttgggccaagagttgatatccttgacaagtaattcttgcaatgttcaggccaagaaaactgatgtatatttttcagcccattctctcggcattttgaccaaagttgtttttcagaaaggagtttatagagtgcatctgcaattgcatgctgatcatggggatcaacaaggagaccattgtccagcacctggtgaatttcaacaggagctccattttttgttgcaattacaggcaaaccatgcatggcagcctctatcaaggtgacaccgaactgttcaaagtaaggcacatttacaaaagcaccctttgttctcactgctaaacggtaaatatcaggaacttccgagtgtttgtgacgctttgggtatgccacttgaccatacaaatcatattcatcaatcaatgtaagtactgatgtcaaaacagctgcactcatattatgcatcttggaaatagcctcacggtttcccattatcaatgttagattagcatgctccctaagtgttcggcactcaccaaacgcatgcccaaaagtagtaatatgcgtttcaggatacatgcgagccattgccagaaccaaagatttcctagggtttttaaagaaccccataatcttcctcgcaagcaaatcctcagaacagtcagataaattaccctgctcttctacatccatcctagtgccagctataacacttgcagatacaacaaccgtacgagccatatagcgaccatagcagttagcaccacgcttgactcttgcacggagtttccttgcaagtatgacctcaaaaccgtcatacaaattccattgctcttctatctcttgcctagtgcttgctataactatttcagatgcatcaagagccaactcctctgcctcaattctacacattattttgtatgtcatgtttatttgctcccttgtctgtctcccttgcttgagaagctcttccaacttatctttcccaagaaaatgccctgtaaagaccatgggaacattaagtgctcctgacagtagagcagcagcaactcctgcactagcataatgaccatgaatcacagcaggccacgccggatgcccacagctgatttcttcacctatggcccttgacatcttcactatatgactgagggcgccatcaacaaattcttgaatgaaaggccagagatgttccttagctagatatttgtcttttggtccaaatggtattcggatgatatatgcaccactattctctcctctttcctgcttaaaattcttgaagcttgttgatgccaaaggttccactggttcaccatagctacgatcaaaatttggcgctaagatctgtcttgtaaaaagatcaacccggtaaactccaggacatgagctcaatgctttagcaagttccacaacatacttgacctgtccgccagtatctgaatcacggccaagctccatgttctcaccacggaccaggccatgaaggctgatcaacactatgtacagcttgtcaactgaactgatcctaggtgtgttcccagttgtgctgtcaccataggcaacagaaggatcaccagcatcctctcccttctcaccttcaaagagatcttccgacatatctgaagtagtctcaacccgtggcctctctgtctctagacggcgtttcaacaagcgattggcttcctccttctccaactccttcttcttcctggcgaggttccagatcctccacgtcatgttctccagcctcgtgttcttctcctgcgggctccgcatcgcgttcgcgcggagccatgtcttgtagaggtcggtctcgtcgtagccggtgatgacctcctcgacgaagtaccgcgcgggggagaagtggccgcgctcgcggaggaggagcgaggggcggtcccccgctccgcctcccccacccaccgccgaggccgaggccgaggcggcggcgcccttgccggcgtcgaggatggcatccaggtagctgttgatccagttgtcgttgccgtacattactcaaaaaagactgtttgcactcccaatcgggagcttgggcattatcaagacctaattggcccagacacacactctcacaatgcggataaggagcttcatggttttagatggtgatggtaatgatgttccaagcatgggggatattgttcatatagtagtaaggtggcaactcgctcacagacaacagggaacacactcaactacaactatcagtgaagtgagcggctcaggaagaaaacctctcaatcaataaggaactggcagagcacgacatggtacactgcgcggtcctcagattcgcggtggtgcaaccatgcatgggcctaaaccacgaagtcatgcgattaagttgcagaagaaagt

SEQ ID NO: 3234 - DNA, 1344 bp, Oryza sativa
  Clone ID: PAT_MRT4530_42195C.1
ccggccgggagccagggcaaatctgatcgatcaagataatcgagcaaaatccatcagagttctaacattcgcgcgtgaatttcgaggttaatttttgaagcttaggatcaatggcttcccaccaggaccaggctagctaccgcgccggcgagaccaaggcccacaccgaggagaaggcggggcaggtgatgggggcgagcaaggacaaggcgagcgaggcgaaggacagggcgtcggaggcggcggggcacgccgccggcaaggggcaggataccaaggaggcgacgaaggagaaggcgcaggcggcgaaggagagggcgtcggagacggcgcaggcggcgaaggacaagacctccagcacgtcgcaggcggcgagggacaaagccgccgagagcaaggaccagaccggcggcttcctcggcgagaagaccgagcaggccaagcagaaggccgccgagaccgctggcgccgccaagcagaagaccgccgagacggcgcagtacaccaaggactctgccatcgccggcaaggacaagaccggcagcgtcctccaacaggcgagtgagcaggtgaagagcacggtggtcggcgccaaggacgcggtgatgagcacgctggggatgaccgaagacgaggccggcaccgacgacggcgccaacaaggacacctctgccaccgccgccgccacggagacgacggcgagggatcactagacgccgtgaatgatttccctttgggtctatttatgtatgttttcacttcaaattcggtgcaagtttgaatttgtttttgtgtcgttttgagtctgtatcgatgctgtatgaagtggtggtcgtcgcaggggaggatttctgacgggtgtgggtgatgtgtactgatgatgttcagttgttttcgtcagagtttctcgtctgtgttctgtttattatggcgtaacaataataaaagtttgggcctaaagcccgcatttgtggtttaaaaaaaaaaaaaaaaaaaaatggtgccattcctgaagttagcattcccatcatcattattcgatatccgcaacagtcgcacgccgtgttatctatttagcactttgcccgtatgtaaattgtatataattattttccttttgtgcatatcgctcatgtaatgtaggtgtactgggttctccaggagctctcctgaggataaggagaggtttcatttttaatatgtgcccccctttactcaagtgagaattgtacatggaagctccatatgaacattgtagacacgcctttattgatgtacatagcaatatcaatggaataaataatagaaggatttgacgcgagactagttctctctcactgcagc

SEQ ID NO: 3235 - DNA, 3416 bp, Oryza sativa
  Clone ID: PAT_MRT4530_4273C.1
agatccacccagcccccgagccgctcgccctcgccctcgccctccggccttggatggtggtggtggtggtggtgggcggagctgcttggatatgcgcttcctcttcgagagcgatgctggctgaaagcgacttgggagaaaatgttgttgagctgatgcaacgttactttcccaccgatatgattcggaggattcgcatgctttctggtaacttgatcaagaaagttgtaatgcctcctggtgcgatctctttggatgatgtggatatagatcaagtcagtgttgattacgtcctcaattgtgctaagaaaggtgaagcacttgaccttggagatgccatccggctttttcatgacagccttgactacccttacgtgaataacagtggaactgtggaggaattctttttacttacaaaaccagagtactctggaccagctccagcgagagaaccaccccctgtccctgctattgcaccatcacctgttgtgataccggcaccaattgtggatccaccaccagttgctgtgcactcaccagtctctaccacaaatttatcaaaatcacaatcatttgattctccaactgagaaggagttaaccatagatgacattgaagattttgaggatgaagaagatgaattcgatagccgaagggcttctagaagacatcaaagtgatgccaatgatttatcattgcggttaccactatttgaaacaggtataacagatgatgacctccgtgaaacagcatatgaaattcttgttgctgctgctggtgcttcagggggacttatagttccacagaaagaaaagaagaaagagaagagaaacaaattaatgaggaaactcggacgtagtaagagtgagagtactcaatcccaaactcagcggcaaccaggtttggttggtttgcttgaaaccatgcgagcacaacttgagataacagaatccatggatattagaactagacaaggattgctcaatgctatggtaggcaaagttggaaaacggatggacaatctcttgattccattggaactactatgctgtatctcaagagccgagttttcagacatgaaagcatatcttcgttggcagaagagacagctaaacatgctggaggagggccttataaaccatcctgttgttggatttggagagttaggtcgaaaggtcaatgagctacgaaacctcttcagaaagattgaagaatctgagtccttgcaaccatctgctgtggaggttcaacgcactgaatgcctaagatcactgagagaagttgctacttctctctctgaaagacctgcacggggtgatcttactggtgagatacactatcagttgcaggaagtggaagaaatcctggagctcctaaaatcaacttggcggatactaggcattacagagacgattcatgatacatgttatgcatgggtattatttagacagtttgtttttacaggtgagcaaggactcttgaaagttgtgattgagcatttgaggaagatacctttgaaggaacagcgtggtccacaggaaagattacacttgaaaagtttgcgtagttctgttgatgctgaggatagctttcaagacttcacatttttccaatctttcctatctcccgttcagaaatgggtggacaagaaattgaatgattatcacctacacttctcagagggccctagcatgatggctgatattgtaacagtggcaatgcttattaggagaattcttggtgaagaaaataacaagggaatggagtcgcctgatcgagatcagattgaccgttacatcacttcttctgtcaaaagtgctttcgtaaagatggcacactcagtagaggctaaagcagacacatcacatgaacatgttttagcatctctagctgaggagacaaagaagcttctgaagaaagatacaactgtgttttcatcggttttgtcaaagtggcacccacagtctgcagttgtttctgcttcacttctccataaactttatggaagcaaattgaaaccgtttcttgagcacgcggagcatcttacggaggatgtggtttctgtatttccggcagccgatgctttggagcagtacataatgtctgtgatggcttctgttgtgggagatgatggtttggacagcatatgcagacaaaagctagctccttatcagattgaaagtaaatctggcacgttgatattacgctgggtaaatgggcagcttgagagaattgaaacttgggttaaaagagctgctgaacaagagacttgggatcctatatcccctcaacaacgccatggggcttctattgtcgaagtctacagaatcatagaagaggtccccatgagaactggagaactaaatagcctctgccgtggttttgacaaggcatttcaagtttacacacaacttgttacaggaccgatagttgatagagaagatttaattccacctgtccctgttcttactcgatataaaaaggagcttggaatcaaggctttcgtaaaaaaggaaatacatgaagttagaacagttgacgagaggaaagcaagtgaaataatacaacttactatgccaaagctttgtgtacggcttaacagcctatattatggtatcagccagctaagcaagctggaggacagcataaatgagcggtgggctaggaggaaaagtgagagcattaacatcagacgatcaatgagtgaaaaatcaaagagtgctgtctcgagtcagaagaatcaatttgatggcagcagaaaagaaatcaatgctgcaattgatcggatatgtgagtttacagggctaaaggttatcttctgggacctacagcagccatttattgataatttgtacaaaaacaatgtttctcaagctcgactggatgctattatggaagtacttgatacggtgcttaatcagctttgtaatgtcattgtggagcaactacgggatcgtgtggttacagggcttctacaagcatctctggatggcctactccgtgtgatattggatggaggtcctacgcgtgtcttctctccaagtgatgccactcttttggaagaagatcttgaaattctgaaggaattttttatatctggtggagatggcctacctcgtggaactgtcgagaatttggtctcacgtgttcgccctgtaatagatctgatcaagcaagagacacgtgtgctcatcgatgacctacgagaagttactcagggcgctaaaaccaatggaatgcgtcttggccttgcgacctggaaatcgtgtccagtatccgctcccctgcttccgtttgctattgttccgcactcaaatcagctattcaaggttttgcccagcttgacccgtagtaaagtatcagccgtgtttattaagcagtatagggttagatacgatttactcgctccagattag

SEQ ID NO: 3236 - DNA, 3324 bp, Oryza sativa
  Clone ID: PAT_MRT4530_4275C.1
atgctttctggtaacttgatcaagaaagttgtaatgcctcctggtgcgatctctttggatgatgtggatatagatcaagtcagtgttgattacgtcctcaattgtgctaagaaaggtgaagcacttgaccttggagatgccatccggctttttcatgacagccttgactacccttacgtgaataacagtggaactgtggaggaattctttttacttacaaaaccagagtactctggaccagctccagcgagagaaccaccccctgtccctgctattgcaccatcacctgttgtgataccggcaccaattgtggatccaccaccagttgctgtgcactcaccagtctctaccacaaatttatcaaaatcacaatcatttgattctccaactgagaaggagttaaccatagatgacattgaagattttgaggatgaagaagatgaattcgatagccgaagggcttctagaagacatcaaagtgatgccaatgatttatcattgcggttaccactatttgaaacaggtaatagtgatgactgttatgtcattatgaagtcttcatgctggtatggctacatacattgggtcaagaaagttattgacaacggaaactgtgctgtttttccaggtataacagatgatgacctccgtgaaacagcatatgaaattcttgttgctgctgctggtgcttcagggggacttatagttccacagaaagaaaagaagaaagagaagagaaacaaattaatgaggaaactcggacgtagtaagagtgagagtactcaatcccaaactcagcggcaaccaggtttggttggtttgcttgaaaccatgcgagcacaacttgagataacagaatccatggatattagaactagacaaggattgctcaatgctatggtaggcaaagttggaaaacggatggacaatctcttgattccattggaactactatgctgtatctcaagagccgagttttcagacatgaaagcatatcttcgttggcagaagagacagctaaacatgctggaggagggccttataaaccatcctgttgttggatttggagagttaggtcgaaaggtcaatgagctacgaaacctcttcagaaagattgaagaatctgagtccttgcaaccatctgctgtggaggttcaacgcactgaatgcctaagatcactgagagaagttgctacttctctctctgaaagacctgcacggggtgatcttactggtgagatacactatcagttgcaggaagtggaagaaatcctggagctcctaaaatcaacttggcggatactaggcattacagagacgattcatgatacatgttatgcatgggtattatttagacagtttgtttttacaggtgagcaaggactcttgaaagttgtgattgagcatttgaggaagatacctttgaaggaacagcgtggtccacaggaaagattacacttgaaaagtttgcgtagttctgttgatgctgaggatagctttcaagacttcacatttttccaatctttcctatctcccgttcagaaatgggtggacaagaaattgaatgattatcacctacacttctcagagggccctagcatgatggctgatattgtaacagtggcaatgcttattaggagaattcttggtgaagaaaataacaagggaatggagtcgcctgatcgagatcagattgaccgttacatcacttcttctgtcaaaagtgctttcgtaaagatggcacactcagtagaggctaaagcagacacatcacatgaacatgttttagcatctctagctgaggagacaaagaagcttctgaagaaagatacaactgtgttttcatcggttttgtcaaagtggcacccacagtctgcagttgtttctgcttcacttctccataaactttatggaagcaaattgaaaccgtttcttgagcacgcggagcatcttacggaggatgtggtttctgtatttccggcagccgatgctttggagcagtacataatgtctgtgatggcttctgttgtgggagatgatggtttggacagcatatgcagacaaaagctagctccttatcagattgaaagtaaatctggcacgttgatattacgctgggtaaatgggcagcttgagagaattgaaacttgggttaaaagagctgctgaacaagagacttgggatcctatatcccctcaacaacgccatggggcttctattgtcgaagtctacagaatcatagaagaggtccccatgagaactggagaactaaatagcctctgccgtggttttgacaaggcatttcaagtttacacacaacttgttacaggaccgatagttgatagagaagatttaattccacctgtccctgttcttactcgatataaaaaggagcttggaatcaaggctttcgtaaaaaaggaaatacatgaagttagaacagttgacgagaggaaagcaagtgaaataatacaacttactatgccaaagctttgtgtacggcttaacagcctatattatggtatcagccagctaagcaagctggaggacagcataaatgagcggtgggctaggaggaaaagtgagagcattaacatcagacgatcaatgagtgaaaaatcaaagagtgctgtctcgagtcagaagaatcaatttgatggcagcagaaaagaaatcaatgctgcaattgatcggatatgtgagtttacagggctaaaggttatcttctgggacctacagcagccatttattgataatttgtacaaaaacaatgtttctcaagctcgactggatgctattatggaagtacttgatacggtgcttaatcagctttgtaatgtcattgtggagcaactacgggatcgtgtggttacagggcttctacaagcatctctggatggcctactccgtgtgatattggatggaggtcctacgcgtgtcttctctccaagtgatgccactcttttggaagaagatcttgaaattctgaaggaattttttatatctggtggagatggcctacctcgtggaactgtcgagaatttggtctcacgtgttcgccctgtaatagatctgatcaagcaagagacacgtgtgctcatcgatgacctacgagaagttactcagggcgctaaaaccaatggaatgcgtcttggccttgcgacctggaaatcgtgtccagtatccgctcccctgcttccgtttgctattgttccgcactcaaatcagctattcaaggttttgcccagcttgacccgtagtaaagtatcagccgtgtttattaagcagtatagggttagatacgatttactcgctccagattag

SEQ ID NO: 3237 - DNA, 1862 bp, Oryza sativa
  Clone ID: PAT_MRT4530_4336C.1
cggcacgtgcgtcccacgagggtcccaccgtcccctcggcttatcccccctcctccccggcctccctcccgccaaggccgccggagcccgtcgccggaggcagctgcagggaaggacgccgtcgccggacacatgcggggttgggcttcccagatagcttgtctcttgctgcactaagctcttccaattttatggcagctcccaagcccattgctcggcttatttcccatgtcattcttgatttagatggtaccctcttaaacacagactgtgttgtaagtcaagtgctgaaaccatttctagtcaaaaatgggaaaaagtgggacagcaagaaagctcataaattagttggaaagacaccttatgaggcagcagctgttgttttagaagattatggactcccttactcaacagaagaatttctctcaatgcttactccaatgttcaatgagcaatggtgcaacataaaagctcttcctggagctaatcggttgataaaacatttgaagagtaatggagtaccagctgctttggcttccaactcaccaagatcaaacattgacgcaaaaatttcctgccatcaaggatggaaagagtcgttctccgcaattgttggtggtgatgaagtagagaaggggaagccatccccagatatatttttggaagctgcaaaacgaatgaatacaaatcctccaaattgcttagtaatcgaggactccttaccaggtgttgcagctggaaaagctgcaggaatgcatgtcatagctgtaccttcagtccccaaaaggactgctgaattcagttctgctgatgaggtgatcaattccctccttgacgtaaagcctgaaaaatggggattgccaccatttagtgattggatcgatgataccttaccaatagaaccatggtttattggtggacctgtgattaaaggatttggccgtggttctaaagtactaggaattccaacagccaacttacctgcagaaaacttctccgacgtactatcagagcatacatcaggggtatactttggctgggctggactttcaacgcgaggtatatttaagatggtcatgagcattggctggaacccttattttgataacacggagaagactattgaaccatggttgcttcacgattttggtgaagacttttacggagaggagctgcgccttgttattgttggttacatacgacccgaggccaactttccttcacttgagagcttgatagagaggattcacgaggatgcaaggatatcagataaggccctgaatttaccattatacgccaagtataaagactcgccgtacctaagaaattccttgaaggaggacaattctgctaacgggaaccagtcagtgatagattccaagtgattcaacgttgtgaagtgaaagacatgaagaattctctttcgcagcgttgttgatgcagaaagagcactactgttcttgtgcttgtactgctgcattatgttccatgaatacttggaacatgctcttgactacaatgagaataccagtaagggtctatgttcgtcagaaagttgagttagaagcagccaactactatcttctcaaatggtcacctactcctagaatggaatgcacaagatgtctgaaaatttgcacgtgtgttgtggctctgaccatgtgaagcttaggctgtctatctaacgttctgaattaacttttctaatatgcattgagattggtatttcacaaaaaaaaaaaaaaacagacgccagacgatcctcctcccttctagaattggattctttttggatggaggggtagaaagcaaataaagctcggttattgttggttaaaaaaaaaaaaaaaaaaaaaaaaaaa

SEQ ID NO: 3238 - DNA, 1286 bp, Oryza sativa
  Clone ID: PAT_MRT4530_43475C.1
cctcctcgctcgccacaatctctctcccggcttcgttcctcctctcgccccgcgactcccgctctgctcctcctcgtcgccgccgccgccgccgccgccgccgccgccgccgctgtgtgtacgactacgacggcgaagagccaggcggggaggaccgatccgccggaggaggaggaggagggagtgggggggcggggagatgggggagggggggcgatgacagcgggcgcggctcggcgcgggcgggatgcggacgatctgcgacgtgtgcgagagcgcgccggcggtgctcttctgcgtggccgacgaggccgcgctctgccggtcctgcgacgagaaggtgcatatgtgtaacaagcttgctaggcggcacgtgagagttgggcttgcagaccctaataaagttcaacgctgtgatatatgtgaaaatgcccccgccttcttctattgcgagatagatggtacatcactttgccttagttgtgatatgactgttcatgttggtgggaaacgaacccatggaagatacctgctcctaaggcaacgggttgaagtaggagataaaccaggtcatatggatgatgttgctatgcaacagaaagatcctgaaaaccggacggatcaaaagaaggcccctcactcagtaacaaaggagcaaatggcaaaccatcataatgtgtctgatgatccagcctcagatggcaactgcgatgaccagggtaacatcgattccaaaatgattgatcttaatatgagacccgtccgtactcatggacaaggttcaaactcacagactcagggcgtggatgttagcgtcaacaatcatgattctccaggagtggtgccaacatgtaatttcgaacgagaagccaacaaataaataccgtaacaccaggatgtacatttcttcggttgctgctatatagcagtagctctccgggaggttggattagctttggtcttcagccaggcagaatatgtgttattacatggtcctcttgtgtcgctagtagtatgattctagtagagctgaagttgaacgagttcatgtcaactcggcatgccatatgccgtggacgctatttatcgtcgtgtactcgtgttgtggttgtaagactggtgtcacatgggccatacgggaagcacagtgggctgtcacttgtgcttttgtggattgctgctgtgcgctattagaaactgttcaaaagattaatagacccatcattttttttcggtgtaaaaaaaaaaaaaaaaaaaaaaaaaaaaaaaaaaaaaaaacccaaaaa

SEQ ID NO: 3239 - DNA, 5622 bp, Oryza sativa
  Clone ID: PAT_MRT4530_43893C.1
atggcggccgaccccgccgtagcgtccgccgtggcggcgatctccgccgtgatggactggcgctcctcccccgacgcccgctccgccgccttcgcgtacctcgaatcggttaagacaggagatgtccgggcattggcgaacacatcatttttattggtccgaaaggaccagtcttcagaggtccgactgcatggtttcaaaatgttgcagcacttggtgagattgagatgggaggaactcagtgttgcagaacgaaatgaatttgctaatttgactgttaatttgatacctgaggttgttggtcctcatgaggagtgggctttgaagagtcaaacggctgcattagtagcagaggtagttagaagggagggagttgctttgtggaatactttactcccatctattgtttcgttgtcaaacaatggtcctattgaggctgagttagttgccatgattctgaggtggcttccagaggatatcactgttcacaatgaggatttagaaggtgatagacgtagggcattgttacgtggtcttactgagtcgttgccacaaatcctgccgctgttatattctctacttgagaaacactttgtagctgctttgagcgcgcacacgaatcagcaaatggagttggctaaacaacatgttgggacaataactgctgtgctgaatgctgccaatgcatatgctgaatgggctcctgtgacagatctcgccaaatatggtttaattcatgggtcttgcatactagctgatgtagcaaggactttgcacttcctacaacagatgctggaatattatcaacactacaagatcacgcttcatttccaatctttattattttggctggtggtcttgagagaaccatcaaaagctaagtctgttgcacgtgtttctagtgacacccctgctgccggtaattctgcatctactggtggtggttcaactgaaagggagaagaaaggggtgtcagtattaatcactgatgaaatgtacagtacaattttggatgttacgttcaaaagaatgcttaaaaaaagtacgagtgcatcttcagggctgttagaactatggagtgaagagctagaggggaagagtgacttctgcaactaccgtgccaagctgctggatctcataaaagtcattgcatctcaaaggcctggtattacagcaacaagcattgtacagagaataaacattgtatttggagatgctaatgaagcaacgaaatcatcccaggatcttgatgcaatggaaggtgcgcagctggggctggaagcagttgttagtgctatattcgatggctcatctgattattcaaagattgaccaggacacaaaattccaaattcacaggatctttgaaggcttacttcagcagcttctttctttaaagtggtcacaaccaaatcttgctgttattcatggtcactatttggattctttgggtcctttcttgagacattacccagatgcagttgcctgtattgtgaataagctttttgaaatattaacatctctccccatcacaattcaggacccttcaaataatttccgtcaagctagactgcagatctgctcatcattcattcgtatatcaagagctgctgataaagcacttctgcctcacatgaagtgtaacagtgtgaatttctttatgaccattgtaaagacatttaagtgcaagcaggtcgtgacaacttggtatcagagccactcaccatggcttccgatactgagtgagttctttgtatcatgggtagcaaatgtgtacatgaacaaaaacattgctgatacaatggcttatcttcaaggagagggtcgcttactacgtgctgagcataaccacctctgtgaagcgtttcttgtcatggcatcctctgcagggattcaacagcaacaggaagtcctggcttggttactagaacctatcaacaaaatgtggacgcaagtggaatggcaaaatgcatacttgtctgacccatctggcttgacacacatgtttgctgacagccaatttatgtggtcaatttatcacaacatcacattatttgagaaggcactcaagaggggtgggtccaaaaaatctgcatcagctccacaagcactggccacaacagtgctgttgcgatgcatacatatgctttgggccgagcccttttctcagtctctggcaggagaagtcaaagcggcaaaaagcatgactgtggcggagcagaccagccttcttggggagacaaataaactcaccaaaggccaggttgcatctgctgatggattgttggatgttcaaagggagggagagtctaaggaaaacaccataaggaactggttacgcgggatccgtgacagtgggtacaatgttataggactatcggctagtcttggggatccatttttccgatgcatagagggttcctccatcactgctgctcttatggagaacgtgcaagctatggaatttcggcatttgcgccaacttatccaccttgttattattcctttggttaaatattgccctcctgaactgtggcggatgtggatatcgaaccttttacagccattatttgtccattgtcagcaagctcttgatttctcttggtccagtcttcttcgtgagggccgggctaaggttcctgataattttggtaatctttctgggtcagatctgaaggtagaggtaatggaagagaaattgcttagagacttgactcgtgaagtatgttccgttctttgggttttagcatcaccaggcttgaatagtggtcttccatccttagaacaacttggacctgccaaccggattaattcttctcttaaggatctggagttgtttgtttccagctctatcactggatttcttatgcttaatgtctccactgctgttcctgcattgaggataactgttgaagtgttcagttggacagatagtgaagcagtcacaaaaattattcctttttgtggtgcattgattcaccttgctgttgcaacaaatcgggctgagttgagtcagtttgttgcgaaagatctattttcttccatattacatggcttatctgttgagttgaattccattacgagttcagaacttgttggactttgtcgagaaatatatatctatctctcagatagagatcccgcacctagacagaacacaactggaagagaggaagaggataagaaggtgacaggaattggaacatcgaaatcgaatctctgccctgcccgtcacccaagcgctgagctggtgcttggcaccgaggtgccgcctctaatggtgatttttagaacactgccaagtagcgctaagcctgccacaaaacaaaaggtagcacccaagaaaactgatgtaagagccattttgcggcccttgaccgtaattaattgccaaaaaaaagacatacaactacgattcagtacagacaatatgaaaagagttgatatggcatcagcgatactgctcagtattgcaatcatggcacaactatcatctatatcagctcagccggctcctggatgccagtcccattgcggtgatatggaaatcccatacccatttggcattggcacagagtgtgctatcgaaccgggcttcgtaatctattgcaacaagactgctgatggatctatgaaaccattccttattaatgttgaggtcctaaatatttcgttgctccatggtcaaactagggcactaaatgccctgtcgacatattgctacaatgatgtaacaaagtcaatggaatctagccgatggtcacttgacttttcaacatggccataccggttctctaatctgcacaataagtttgtagtcattggttgcaacactctttcatacatctacaatggagagtatacgacagcatgtgcatcagtctgcgcaaaagcccctacaaatgactcatgcgatggtgttggctgctgccaaaataacatagccaagggattaaatagttataacgtcacgttcttcactgtgtacaatgattcgtcgaatttgcagtctaacccatgtagctacgcagcactggtggaaacagacacgtttaggttcaaaactgagtacgtaactactatgaagttcaatgagacatacaatggacagcagccggtggtactagactgggcaattgggaaggttggatgcaaggaggcaaacatgacttcttacgcatgccgtagcaaacatagcgagtgtgtagattcgatcaatggacctgggtatctatgtaactgcactcttgggtatcatggaaatccatacatcactgatggatgcatagatgtcaatgaatgtgagcaaaatcaaagcccatgcccaaaaggtgcaacttgtcgcaatacagaaggatggtaccattgttcttgccctgtgggaagaaagttggcaaaggaaacaaacacttgcaacccagacatcagcctgatcataggtgtcagcattggctccattgttctagtgattatcattttcttcgtgcgtataatttttgagagaagaaagcttacagatgtcaagaaaaaatacatccaggaacatggagggctgctattatttgagaagatgaaatcagaccagggacttgcatttaaggtgttcactcaagcagaactagagcaagcaacaaacaagtttgagaaaagccagattcttggacatggaggacatggcacagtgtacaagggaataactaaggataacattacagtggcaattaaaaaatgtgcactaattgatgatagacataagaaggaattcggtaaagaaatgttaatactttcacagattaaccacaagaacattgttaagctactgggttgctgtcttgaggtggatgtcccgatgctagtgtatgagttcattccaaatggaacattatttgatcttattcatggcaagaaccgtactcttcatatccctttcagttctctcctaagaattgttaatgaggcagctgaagggcttgcatttttacattcctacgcaaatccaccaattttgcatggtgacgtgaaaacatccaatatccttcttgatgagaattacatggcaaaggtatcagattttggcgcctccatattagcaccaaatgatgaagcgcagttcgtgacaatggttcaaggaacatgtggatatctggatcctgaatatctacaaacatgccagttgacagagaagagtgatgtgtatagctttggtgtggtcatcttggagatccttactgggcagatgccattgaaacttgaaggttctgagctacagaaaagcttgtcatcaagcttcctattggcaatgaaggagaataatcttgaggccatgctagatagccaaattaaaggtcatgagagcatggaactgctcagtggacttgctgagctagcgaagcaatgcttggacatgtgcagtgagaataggccatcaatgaaagacgtagctgaggagattagcagactaagaaaactttcgaaacatccttggatacagcgtgatagtgagacagagggctatctcagtggaccatcaaccagtaactttgaaattgagcaaagcactgagtacacaaggaaggacgaacaaatgcccataaacccaagcacttcgtattttatccggtga

SEQ ID NO: 3240 - DNA, 974 bp, Oryza sativa
  Clone ID: PAT_MRT4530_44272C.1
cccaggccgacgcacaaacccaaaaacccaaagcttagccaagctactagctagctcctcacttcttccagcttcttacactaatacagctcgagccacttcgtcttctcctctcttgcagcatagtttaagtttgagataggattggcgatagatatgaggccgactggtcgtcgttcttctccgccggtggctgctgctcttgccctgcttctcctcctcgtcctcttcttcttctcccactgcgcctcagctgctcgcccactgccagcatcagcagcagcagagctagtgcttcaggatggcgccaccggcaatggcgacgaggtttccgagttgatgggagcagctgaggaggaagcagcaggattatgcgaggaggggaacgaggagtgcgtggagaggaggatgcttcgcgacgcccacctcgactacatctacacgcagaagaggaacaggccttgaaatcttgaatcataatctccaagtcgatacaaggaggaattaatcagtagtaaacctacataaattaatctactatctgcagcctgttttcaactgcatgtatcagtgtattagtcgatctaggataatattttgcatgtgtactcaagtaaactgtcgtctgtataaccccgttatgtacatggttgtatttctttctccaaagtgttatcgaactctctgttgatctctgatacatctgtatgtgtagcatcagagaaaagatcgagcacttgtgggttatgatctgacgatcgagtgtatgaacagtgctaatggtgtagtaagtttttgcttaattgtcttggacttctcatggtgtgaaatgttcgaacaagcagaacatattccctatatcttccttggtagctggtgcttggtactactaccagcacaaatgttaccagtatgcatgtttcataaagagaaggtataatggattataaatatataaacttgcatttgttttc

SEQ ID NO: 3241 - DNA, 1661 bp, Oryza sativa
  Clone ID: PAT_MRT4530_44581C.1
gttgtggtggtgatggtgaggagcgagttgtagaggaggaggggcaccgatcaaccgggaagctggcggccgggaagtggtgggagcggccagatgacacggccatggccgggatggaccctggcgggggcggcgccggcgccggcagctcacggtacttccaccatctgctccgaccgcagcagccgtcgccgctgtcaccgctgtcgccgacatcccatgtcaagatggagcactccaagatgtcacccgacaagagccccgtgggcgagggagatcacgcgggagggagtggaagcggcggcgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctgagcggcggcggcgccgtcgtcaacgtggcgctgcggcagccgggcgcgtcgccgccgggcagcatggtggccacgctgcggggccggttcgagatcctatctctcacgggcacggtcctgccgcctcccgcgccacccggcgcgagcggcctcaccgtgttcctctccggcggccagggccaggtgatcggcggcagcgtggtgggcccgctggtcgccgcggggcccgtcgtcctgatggcggcctcattcgcgaacgccgtgtacgagcggctgccgctggagggcgaggaagaggaggtcgccgcgcccgccgccggaggcgaagcacaagatcaagtggcacaatcagctggacccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccgttctgacccatgtcttagcatccagttcaaaaattctccaaattaagaatcgcgcagtgcagaagccatagcaatccaatgcagatatgcaagctaagctaatggtacaaaattgcgacatgcatgttggattgttgattggacgatcgacaggcctttgtactgggtgcaacatacgtatgcatctatcatgcatgcgttgcaaattaagatttcaattcatattcatgaggaggtttatcatatacacatattttaacatctgtgggggcaagaagaagctagaggagagttgcaagagcaagctcggaataaaccaaaggtcagtgagattatccaatgttttgtgtttaattctaccaagtgtttttttttttcatttttttctcttttgcattctctaatatggtactatcctattctagtttgtatcttttgatcggtagaaccatgtttctgaaaaactcttgtccccctgccccgcctcccacacatgtgcaacaccagaactgtcttatggtcaaaaaaaaaaaaaaaaaaactcgagactag

SEQ ID NO: 3242 - DNA, 702 bp, Oryza sativa
  Clone ID: PAT_MRT4530_44878C.1
gacctctcccctctcctcgttcctctccgcgccgccgccgccgaaggggagcagcctcggcaggcgaacgacacgggagggtgagacaagacccataaggaccaacgcgtaccacaagcggtatcgagcgctagcttaagagacggaggcacggcaagactgactacaggaccagcactaagctcaccatccgagataacatcatagtcaacacaccgaggttccggttcgctgtgagatttacacatcaagagcatatcacggctcatatgggctatgctaccattgctggtgacatggggatggctggtgcctacttccatgagctgtctcgcgtatggtcttgaagctggactcaccaactatgcggcagcttattgcactggacttgctttcggctcgccgagtgctcaagctcctggggtaggaccaagagttcaagggctatatggacgccgctggggaggactactaggttgaaccagctgatgaaaggcggactttccgtgctctcttggatggtggccttattaagacagccactggccaccgagtctttggtgccctcacgggagctacggatggtggactggacatttctcacagtgacaagagggacgctgggttcaagatggacgagaagcagctcgatgtctgctttcaccgcatgaacatctacagcgggcacgtggctgactacat

SEQ ID NO: 3243 - DNA, 2550 bp, Oryza sativa
  Clone ID: PAT_MRT4530_44906C.1
atggtttctcggtcctactccaacctgctggacctggccaccggcgcggcggaccaagcgccggcgccggcggcgctcggcgcgctccggcggcggctgccgcgggtggtgaccaccgcggggctcatcgacgactccccgctgtccccctcgacgccgtccccgtcgccggggcgcgcaccatcgtggtcgccaaccaccttcctatccgggctcaccgcccggcgtcgccgtcggagccgtggaccttttctgggacgaggacttccttcttcggcaccttcagcactcgtgctcctcccccgccatggagttcatctacatcggctgcctccgcgacgacattccgctggccgaccaggacgccgtcgcgcaggcgctcctcgagtcgtacaactgcgtgccggcgttcctgccccccgacatcgcgagcgctactaccatggcttctgcaagcagcatctgtggccgctgttccactacatgctgccgctctcccccgacctcggcggccgcttcgaccgcgcgctgtggcagtcgtacgtgtcggcgaacaagatcttcgcggacaaggtgctcgaggtgatcaacccggacgacgacttcgtgtgggtgcacgactaccacctcatggtgctcccaaccttcctccgcaagcgcttcaaccgcatcaagctcggtttcttcctccactcgccgttcccctcgtcggagatctacaagacgctccccgtccgggaggagctcctgcgcgcgctgctcaactccgacctcatcggcttccacaccttcgactacgcgcgccacttcctctcctgctgcggccggatgctggggctctcctacgagtccaagcgtggccacatctgcttggagtactacggccggacggtgagcatcaagatcctcccggtgggggtgaacatggggcagctcaagacggtgctcgcgttgccggagacggaggcgaaggtggcagagctgatggcgacttactccgggaaggggagggtcgtcatgctgggcgtcgacgacatggacatcttcaaggggatcagcctcaagctgctcgccatggaggagctgctgcggcagcaccccgagtggcgcggcaagctggtgctcgtccaggacgtcgacgaggtgaagggggagacgtacgccatggtgcggcggatcaacgaggcgtacggcgcgcccgggtacgagccggtggtgctcatcgacgagccgctccagttctacgagcgcgtggcgtactacgtcgtcgccgaggtgtgcctggtgaccggggtccgcgacggcatgaacctgatcccctacgagtacatcgtgtccaggcagggcaacgaggcgctcgacaggatgctgcagccgagcaagccggaggagaagaagagcatgctggtggtgtccgagttcatcgggtgctcgccgtcactgagcggcgcggtgagggtgaacccgtggaacatcgaggccgtggcggacgccatggagagcgcgctcgtgctgccggagaaggagaagcggatgcgccacgacaagcactaccgctacgtggacacccacgacgtgggctactgggcgaccagcttcctgcaggacctcgagaggacgtgcaaggatcacgcgcagcggcggtgctggggcatcggcttcgggctgcggttcagggtggtgtcgcttgacctcagcttcaggaagctcgccatggagcacattgtcatggcgtaccggagggcgaagacgcgcgccatcctgctcgactacgacggcacgctcatgccgcaggcgatcaacaagagcccgagcgccaattccgtcgaaacgctgaccagcttgtgcagggacaagagcaacaaggttttcctctgcagcgggttcgagaagggaacactccatgactggttcccctgcgagaaccttggcttggcggctgagcacggttacttcctgaggtcatcgagggatgcagagtgggagatttccattccccccgcggactgcagctggaagcagatcgcggagccggtgatgtgcctgtacagggagaccacggacggctcgatcatcgagaacagggagacggtgctcgtctggaactacgaggacgcagaccctgacttcggttcatgccaagccaaggagctcgtcgaccacctcgagagcgtgctcgccaacgagcccgtctcggtgaagagcaccggccattccgttgaggtcaagccacagggcgtgagcaagggcctggtggcgcggcggctgctggcgagcatgcaggagaggggcatgtgcaccgacttcgtgctgtgcatcggggacgaccgctccgacgaggaaatgttccagatgatcacaagctccacctgcggcgagtcgctggcggccacggcggaggtcttcgcctgcaccgtcggccgcaagccgagcaaggccaagtactacctcgacgacacggcggaggtcgtcaggctgatgcagggcttggcctccgtctccaacgagctggctcgggcggcgagccccccggaggacgacgacgaatga

SEQ ID NO: 3244 - DNA, 2868 bp, Oryza sativa
  Clone ID: PAT_MRT4530_44907C.1
atggtttctcggtcctactccaacctgctggacctggccaccggcgcggcggaccaggcgccggcgccggcggcgctcggcgcgctccggcggcggctgccgcgggtggtgaccaccgcggggctcatcgacgactccccgctgtccccctcgacgccgtccccgtcgccgcggccgcgcaccatcgtggtcgccaaccacctccctatccgggctcaccgcccggcgtcgccgtcggagccgtggaccttctcctgggacgaggactccctcctccgccacctccagcactcgtcctcctcccccgccatggagttcatctacatcggctgcctccgcgacgacatcccgctggccgaccaggacgccgtcgcgcaggcgctcctcgagtcgtacaactgcgtgccggcgttcctgccccccgacatcgccgagcgctactaccatggcttctgcaagcagcatctgtggccgctgttccactacatgctgccgctctcccccgacctcggcggccgcttcgaccgcgcgctgtggcagtcgtacgtgtcggcgaacaagatcttcgcggacaaggtgctcgaggtgatcaacccggacgacgacttcgtgtgggtgcacgactaccacctcatggtgctcccaaccttcctccgcaagcgcttcaaccgcatcaagctcggcttcttcctccactcgccgttcccctcgtcggagatctacaagacgctccccgtccgggaggagctcctgcgcgcgctgctcaactccgacctcatcggcttccacaccttcgactacgcgcgccacttcctctcctgctgcggccggatgctggggctctcctacgagtccaagcgtggccacatctgcttggagtactacggccggacggtgagcatcaagatcctcccggtgggggtgaacatggggcagctcaagacggtgctcgcgttgccggagacggaggcgaaggtggcagagctgatggcgacttactccgggaaggggagggtcgtcatgctgggcgtcgacgacatggacatcttcaaggggatcagcctcaagctgctcgccatggaggagctgctgcggcagcaccccgagtggcgcggcaagctggtgctcgtccaggtcgcgaacccggcgcgcggccgcggcaaggacgtcgacgaggtgaagggggagacgtacgccatggtgcggcggatcaacgaggcgtacggcgcgcccgggtacgagccggtggtgctcatcgacgagccgctccagttctacgagcgcgtggcgtactacgtcgtcgccgaggtgtgcctggtgaccgcggtccgcgacggcatgaacctgatcccctacgagtacatcgtgtccaggcagggcaacgaggcgctcgacaggatgctgcagccgagcaagccggaggagaagaagagcatgctggtggtgtccgagttcatcgggtgctcgccgtcgctgagcggcgcggtgagggtgaacccgtggaacatcgaggccgtggcggacgccatggagagcgcgctcgtgctgccggagaaggagaagcggatgcgccacgacaagcactaccgctacgtggacacccacgacgtgggctactgggcgaccagcttcctgcaggacctcgagaggacgtgcaaggatcacgcgcagcggcggtgctggggcatcggcttcgggctgcggttcagggtggtgtcgcttgacctcagcttcaggaagctcgccatggagcacattgtcatggcgtaccggagggcgaagacgcgcgccatcctgctcgactacgacggcacgctcatgccgcaggcgatcaacaagagcccgagcgccaattccgtcgaaacgctgaccagcttgtgcagggacaagagcaacaaggttttcctctgcagcgggttcgagaagggaacactccatgactggttcccctgcgagaaccttggcttggcggctgagcacggttacttcctgaggtcatcgagggatgcagagtgggagatttccattccccccgcggactgcagctggaagcagatcgcggagccggtgatgtgcctgtacagggagaccacggacggctcgatcatcgagaacagggagacggtgctcgtctggaactacgaggacgcagaccctgacttcggttcatgccaagccaaggagctcgtcgaccacctcgagagcgtgctcgccaacgagcccgtctcggtgaagagcaccggccattccgttgaggtcaagccacagggcgtgagcaagggcctggtggcgcggcggctgctggcgagcatgcaggagaggggcatgtgcaccgacttcgtgctgtgcatcggggacgaccgctccgacgaggaaatgttccagatgatcacaagctccacctgcggcgagtcgctggcggccacggcggaggtcttcgcctgcaccgtcggccgcaagccgagcaaggccaagtactacctcgacgacacggcggaggtcgtcaggctgatgcagggcttggcctccgtctccaacgagctggctcgggcggcgagccccccggaggacgacgacgaatgagcacccatagggcgcgcgaggcgtgccatggaaaggattaggcagtgcggtgcaccggagagcctcgtttagttccccccggtttgagcgtttgatgggtcgtagttgctagttaggtgtacatgatttcctatgattcttcagggtattgtaccgtacggagtagtgatttagtccttggttagagcatcatgaattggtttgtcatcagtaagagagtattattgatctagtaaagctcgggttaccgcaacaattataaaaataccccaccccccccccccc

SEQ ID NO: 3245 - DNA, 433 bp, Oryza sativa
  Clone ID: PAT_MRT4530_44970C.1
gtggaatggcggtagcatatatcacgccaagtgattatttgttttggttccggtcacacacagctaaagagataaagtggggtggtgcaaagcatcatccagaggataaggatgatggacaacgaatgcatccacgatcatcgttcaaggcatttcttgaagttgtgaagagtaggagcttaccatgggagaatgcggagatggatgcaatacattccttgcagctcatattgcgggactctttcagagattctgcagagggcacaagtaactcaaaagccatagtgaatggccaggttcagcttgaggagctagaattacggggaatagatgagcttagctcggtagcaaaggagatggttcggttgatcgagacagcaacagtacccatctttgcagtagatactgatggatgtataaatggttggaatgc

SEQ ID NO: 3246 - DNA, 863 bp, Oryza sativa
  Clone ID: PAT_MRT4530_45342C.1
ccgcccgcccgtccgcccctcttcttctccttcgactttgttcgactcccctccttcccggcagaggagaggagaggagaggagaggactcatccatcatcatcaatcaacgccatgacgagctcctcatctccttcccgaaaggcgctgagcaagatcgcttgcaatcggctgcagaaggagctcgccgagtggcaggtcagccctccctccgggttcaagtacagggtctccgataacctccaaaggtgggtaatcgaggtcaccggagcggcgggcacgctctacgccggcgagacataccagctgcaggtcgacttccctgagcattatcccatggaggcgcctcaggtcatttttctcaacccggcgccgatgcatccacacatttacagcaacgggcacatctgtttagatatactgtatgattcttggtcacctgcaatgactgtcagttcggtctgcatcagcattttgtcaatgttgtcaagttcaccagcaaagcaacgccctcaagacaatgaccgctatgttaggaattgccgcaatgggaggtcgccgaaggagaccagatggtggttccatgatgacaaagtgtaagaggaactagttggcacttttgccattcagtaatcgtaataccttgaaatctcttgcaaggggaaaatgagatgaatgtaggcttactgttaagcatcactctattggaccaccaagcttaactgctgggttggtttgtacatgagctgcctgcacacatgtcaagtcatgaatataatattaccataaatgattatacagaataagcaagtgtaccatgctgattctctgatacgatcgagcacaaaaagaatagcgtattg

SEQ ID NO: 3247 - DNA, 1103 bp, Oryza sativa
  Clone ID: PAT_MRT4530_45422C.1
tttttttttttttttttttttcgcctgaacattactccaatccaactccaatagaaaacttataagctcctggcagagcatgattccggtaagtttttgcttctacctcataaaacctgcataagaacatgtatttctttctggattatttccgtgaaaaggttaaagcaacaattctttattttctaaggacgttgcccaacgatttatactctacaacttatgaattgttttcatgtcgatggcctcctccagagtcccttgctcaacatgatcccaccatctcatgaggaagttgtcaacaaccagcctaaaccaaggggacagcttaatgccgccttcaccagcatctgccttcttgagcaactccttcagctcatcacgattcacgtacttgacgtcggccacttcttcaggattcgggctgagctccacatcacgaaccatgaataggaggtagtccagttcatgttcgccccattttccatcagatggagccttgtaaagcatcctcccaagaggaatgaattggtcaacaggtagttcttcagcttgtattcccagttcatcgaatagcttccgctgtgctgcatttctgacccctaggcttttatcttcaatgagctcggactcgcggtatagagggtggctacagcaagtgtttgtccagacaagtggaaatgtcacttttgtagcagacctttgctgaagtaacaattcatatttggagttgaaaagaaaaacactgaacgctctgtggaggacatgaccagaatttatcttttccatgagatggcagttatacttggaatcatggccaatgacgttgtcctgttcgtccactaaaatacactcgtcctcgaacatgagccgctgctggacggcgtccatcccggcgtcggcggcttccgcggtgccggccttccccatcaccgcggcggtggcggcgaaggaggacgaggacgacgacaggccgcggagggcgaggccccgcccaaacggggaccgagggcgggcggaggagcgcgcgacgccgaggccgagggacgcggaggcggtcgagagcagcgcgagggagcgcgccgccgccgccatcggagggg

SEQ ID NO: 3248 - DNA, 3519 bp, Oryza sativa
  Clone ID: PAT_MRT4530_4549C.1
atggcggataatggtaatgcaaagccaggtggtgggggatctggagcttatacaatcaacctagataacttcagtaagcggctgaaggtgttctatgaccattggaaagagcataattctgatctatggggttcttctaacgctattgcaattgctactccacctccgtctgaagatcttcgttatttgaagtcgtcagctctggacgtctggctacttggatatgaatttccagaaaccataattgtcttcatgcacaagcaaatacatttcttatgcagtcaaaagaaagcaaatctcattggcaccctcaagaaggcttcaaatgatgctgttggtgctgatattgtcttgcacgtgaaagctaagaatgacagtggtgttggcttaatggaggacatagtgcgtgctgtctgtgctcagtcaaaatcagatgacccaattgttggtcacatcgcaaaagaggcacctgaggagaaggtgattgatgaagagaggaaagtgacacactcttcattgatggatgagacagaaaaggctattcttgatcctcttaaggtcaaagtgaagttgaaggctgaaaatgttgacatatgctatcctcctgtatttcaaagtggagggaagtttgacctcaagccaggtgcctcaagcaatgatgattatctttactatgactctgcaagtgttatcatatgtgcaattggggccagatatggaaattattgctccaatatggccagaacatttctgatagatgctactcctgcacagagcaaggcgtatgaaactcttatgaaagctcatgaagctgctctagaagcattgaagccagggaatcggatgagtgcggtttatcaggctgcagttgacgttattgagaagaatgcccctgaactactccctaatctaacgaagtctgctggtacaggaattggtcttgaattccgagagtctggcttaaacttgaatcccaagaatgaccgtatcataaaagcaggaatggttttcaatgtctcccttggtttgcttaatcttcaagcagaaacaaagagtgagaagacaaaacaatactctcttttgttggctgatacatgtttagtgccattggagaacttaacagcatcatgctccaagcttcttaaggatgttgcttattcgtttaatgacgaggatgaagttcttcctgtcaaaaaggtggaggttaatgcaaaggaggcattgccaccaacaaaggccacacttaggtcagacaaccaggagatgtccaaggaagagctccggagacaacaccaggctgaacttgctcgccaaaagaatgaagagactgctagaaggcttgctggggttggctctggttctggtgatgggcgtggtccctcaaggtcatcaaatgagcttgttgcatataagaatgttaatgatgttccatatgcaagagagttggtcatacaagtagatcagaagaatgaagctgtcctcttacctattcatggcagcatggttcctttccatgtttctactgttaagagtgtcacaagtcaccaagacaaccgcacttgcactatccgcatcttcttcaatgtgcctggcatgccattctcaaacgatagcaatctgaagtcgcaaggggctatctacttgaaggagatcacgttccgctcgaaagatccacgacatagcagtgaagttgttccgcaaatcaaaacgttgaggcggcaagttgcttcaagggagtcagagagagctgaaagagccacccttgttactcaggagaaactccagttggcaagcaacagaaacaagccagtgagactttctgatgtgtggataaggcctgcatttggtggacgtgggcggaagcttacaggaactcttgagtcccatgtcaatggttttagatattctacttcaagggctgatgagcgtgtggatatcatgtatgggaatgtaaagcatgccttcttccagccagcagaaaaagaaattattacactccttcatttccatttgcacaatcatattatggttggaaacaagaagacaaaggatgttcaattttatgttgaggtgatggatgttgttcagactcttggtgggaataggagatcagctcttgatcctgatgaaattgaagaagagcagcgtgagagggaccgaaagaatagaataaacatggatttccagaactttgtgaacaaggttaatgatcactggtcgcagccacaattcaaggggctggatcttgagtttgatgtccctcttagagagcttggattccatgcccggcgacgacggcgccggctaccggtgcggcggtgcgacgtctgccacttcgacctgcgcacgtgctgcgcgctcccgccggccaccctggagaacgacatgttcgaggtcagcgcgttcgcgttcctcgccgagccgccggcggcgcccgccgccgcgggcggcaggatctgcgacgcctgcggcgacggcgtgcgcggcttcgtctaccactccgacgacccccgacctcgacctccacccatgctgcgcgttcctgcgcaggcgcgtcgtggtgcaggacggccgccacttcgagctccgcaagcgcgcgcagccgcgccggcctgtgcggcgagaggagcggccgccgccgcaacttctgggcgtaccggacctacgacgacgacggcgaacccgtgtacctgcacatcgcgtgcgtcaaggacggacaccgcgggcggtgcgcggcggcggtgtggcggcgagatcgtgctggtgagctcgtcgccggcgatggacggcgtgctgcagagcgtgccccggaggaggacgccgcggagcggcgggttcgagaggttttgcaagattgttaacgtcgtcgtgagcgtcatcatcgcggtcatattcgggagtcccatggcgatgataagcgcggttgcagggcccgatgggaggagccgagctgctgcgtcggcgccgtcgtcgtcgtcgtcgcccgtcgtcgtcgtcggcgccgtcgtcatcgtcgtcgctcgtcgtggacgtgggagaggagggagccgcaggcgcgcggacgtggggagaggaggggagctggcggcacgcggtcgtcgtcgtcgccgaggagggagccggccggcggcggaggtggggagccagcggcgcgcggacgttggagaggagggagccggctggtggcgcatggacgtggggagaggaggggagccggcgtcgcggtcgtcgtcgtcgccggcgcatggaggcggcgtcgcggtcgtcgtcgtcgttggcggcggaggtgggaagccggtggcgcgtggacgttggagaggagggagccggccggcggcgcgcggacgtagggagaggaggggagccggccggcgtcgcggcgtcgcggcgtcgcggtcgtcgtcgtcgccggcggcggaggtggggagccgaggagggagccagccgcagcggagtcaaacgtggggcacggatatctacggctacacttattttgggacggagataatatctccttag

SEQ ID NO: 3249 - DNA, 3358 bp, Oryza sativa
  Clone ID: PAT_MRT4530_4550C.1
atggcggataatggtaatgcaaagccaggtggtgggggatctggagcttatacaatcaacctagataacttcagtaagcggctgaaggtgttctatgaccattggaaagagcataattctgatctatggggttcttctaacgctattgcaattgctactccacctccgtctgaagatcttcgttatttgaagtcgtcagctctggacgtctggctacttggatatgaatttccagaaaccataattgtcttcatgcacaagcaaatacatttcttatgcagtcaaaagaaagcaaatctcattggcaccctcaagaaggctgcaaatgatgctgttggtgctgatattgtcttgcatgtgaaagctaagaatgacagtggtgttggcttaatggaggacatagtgcgtgctgtctgtgctcagtcaaaatcagatgacccaattgttggtcacatcgcaaaagaggcacctgaggagaaggtgattgatgaagggagaaaagtgacgccttcttcatctatgcatgagacagaaaagactattcgtgatcctgttaaggttgaagtgaagttgaaggctgagaatgttgccatatgctatcctcctgtatttcaaagtggagggaagtttgacctcaagccaggtgcctcaagcaatgatgattatctttactatgactctgcaagtgttatcatatgtgcaattggggccagatatggaaattattgctccaatatggccagaacatttctgatagatgctactcctacacagatcaaggcgtatgaaactcttatgaaagctcatgaagctgctctagaagcattgaagccagggaatcggatgagtgcggtttatcaggctgcagttgacgttattgagaagaatgcccctgaactacttcgtaatctaacgaagtctgctggtacaggaattggtcttgaattccgagagtctggcttaaacttgaatcccaagaatgaccgtatcataaaagcaggaatggttttcaatgtctcccttggtttgcataatcttcaagcagaaaaaaagagtgagaagacaaaacaatactctcttttgttggctgatacatgtttagtgctattggagaacttaacagcatcatgctccaagcttgttaaggatgttgcttattcgtttaatgacgaggatgaagttcttcctgtcaaaaaggtggaggttaatgcaaaggaggcattgccaccaacaaaggccacacttaggtcagacaaccaggagatgtccaaggaagagctccggagacaacaccaggctgaacttgctcgtcaaaagaatgaagagactgctagaaggcttgctggggttggctctggttctggtgatgggcgtggtccctcaaggtcatcaaatgagcttgttgcatataagaatgttaatgatgttccatatgcaagagagttggtcatacaagtagatcagaagaatgaagctgtcctcttacctatttatggcagcatggttcctttccatgtttctactgttaagagtgtcacaagtcaccaagacaaccgcacttgcactatccgcatcttcttcaatgtgcctggcatgccattctcaaacgatagcaatctgaagtcgcaaggggctatctacttgaaggagatcacgttccgctcgaaagatccacgacatagcagtgaagttgttcagcaaatcaaaacgttgaggcggcaagttgcttcaagggagtcagagagagctgaaagagccacccttgttactcaggagaaactccagttgacaagcaacagaaacaagccagtgagactttctgatgtgtggataaggcctgcatttggtggacgtgggcggaagcttacaggaactcttgagtcccatgtcaatggttttagatattctacttcaagggctgatgagcgtgtggatatcatgtatgggaatgtaaagcatgccttcttccagccagcagaaaaagaaatgattacactccttcatttccatttgcacaatcatattatggttggaaacaagaagacaaaggatgttcaattttatgttgaggtgatggatgttgttcagactcttggtgggaataggagatcagctcttgatcctgatgaaattgaagaagagcagcgtgagagggaccgaaagaatagaataaacatggatttccagaactttgtgaacaaggttaatgatcactggtcgcagccacaattcaaggggctggatcttgagtttgatgtccctcttagagagcttggattccatggtgttccatataaagcttcagctttcatcattccaacttcgacttgtttggttgaactaatagagacacccttcctggtggtgaccctgagtgagatagagattgttaatttggagagggtgggctttgggacaaagaactttgacatggctatcgtgttcaaggatttcaagaaggatgttcttcgcattgattccataccatcaacatcacttgatgcaataaaggagtggcttgacacgactgacctcaagtactatgagagcaggctgaaccttaactggcgtcctattctgaaaactatcatcgatgatcctcagaaattcattgatgacggtggctgggaattcttgaatatggaagcaagtgattcagaaacagaggaaacagaggaatctgatcagggctacgagccttctgatgctgagcctgagtctgaatcagaagatgaagattctgacagcgagtccttggtggaatcagatgaggatgatgaggacgattctgaagaagactctgaggaagagaagggtaagacctgggaggagctggaacgggaggcaagcaatgcagacagggagaatggtgcggagtcggacagcgaagaagagaggaggcggcgcaaggtgaagaccttcagcaagtcccgtccaccaccggagcgcagcagcttcaagggaggaccctcaaagaagccgaagttcaggtaaatctaacggtgcttcgccaggcctggctgcttcctgaatgcgcgccctttttgaggggcatggtgtgcttggctgtaagcagaagcgctcctagctgtttctctagatcattacgacactttgtttccgtagtagcgtactgcagttagctgaaagggcggtcggactttggtgaactccatagttgatgaaatgaactgtaaagactcttgccatctaggggaaacccaagttgattcattagttgtatcctcattgatgtaatgttttgtttcctgggtagaatgttgacctccagaatgtataatatttatgttggcggacgtatcttgtgcagatggcaatgctgcagcctcagttgtgt

SEQ ID NO: 3250 - DNA, 1709 bp, Oryza sativa
  Clone ID: PAT_MRT4530_45989C.1
ggagatagcaaccccacgcgtcagaagacgcagcatgcgagcaagcaagagcggttttagccatcaaagccgaaagccatccgggcattcgctctcccctcgctgctagctagctttgcttgctaatctagagctaagcaccaaatggtcctgattgttcttctcgcttctgaattgttgtgacctgtaactacaaaggcatagttaggtagatatagaaagagggggggagaggggccggaggccggagcggcgggggcggcggcgagatgaagctccacttcgtgctcaggttcctgttcggccccgtgccggtgtacttctcggcgctggccatcctcatcctgctgacgaacgcgcagtacttcgggctggtgggcgtcaccgttccccgcgcgacgaagctggcgtcgtcggcgccggtggtgagcgtgatgaagtactgcgacatcttccgcggcgagtgggtgccggactccgacgcgccctactacaaccacaagacgtgttacatgatccaggagcaccagaactgcctcaagtacggccgccccgacctcgaattcctcaagtggcggtggcgcccctccggctgcgagctgccccgcttcgaccccgtgcagttcctacagttcaaccgtcacaagtcgctcgccttcgtcggtgactcgctggctcgcaaccacatgcaatccctgctctgcctcctctcccaggtggcgtatcccaaagacatgtcggcgaacccgacgactcagaacaaggtgtaccactacagggggtacaacttcaccgtcagcatgttctggtcgccgttcctggtgaaggcgcgtgagcccgaccacgacgggccggcgcacacgggccactggagcctgtacctcgacgagcccgaccagtcgtgggtgtccgagatctcgcggttcgactacgtgctggtgtccgccgccaactggttctccaggccgtcgctcttctacgagaagcggcggctggtcgggtgcagcttctgcagcaggcagtacggcgtgccggacctgacgctctactactcgcagcgccgggcgtggcgcgtggcgctgaaggcgatcaacgacctggagagcctccgcgggcgggtgatcgtgcggatgctgtcgccgatgtcgcacttcgagaacgggacgtgggaccagggcggcaactgcaagcggacgcagccgctccggagcaacgagacggtgatggaggggcgggacctgcacttctacacggcgcagatggaggagtaccgcgccgcggagaaggtcgcggaggccaagggccggcggatgatgctcatggacgccacggcggcgatgctgatgcggcccgacggccaccccagccggtacggccacctgccgaaccagaaggtgcagctctacaacgactgcatccactggtgcctgccaggccccatcgacatctggaacgacatgctcttccagatgctcctcgtctaacgcgatcgatcgccaattcgccatcggtaaatgcgacttctactgcacagacaggattgctcttgctgttgtttcaaagcagttttgacaaggatttattcgaacttccccaatagattctttttttctctctcttttcccttcatttcctttcatttttcgtttatgctgacgcgaatttttaatggatcgtcaccggaaagagtgaacgaaagtgtgcctccg

SEQ ID NO: 3251 - DNA, 1626 bp, Oryza sativa
  UNSURE (1)..(1626): unsure at all n locations
  Clone ID: PAT_MRT4530_45999C.1
  unsure (1)..(1626): unsure at all n locations
cggaattacccggnngtcgacccacgccgnntccggtctctctcaccaacaaacacgtacgactttgaacgcaaagtcttggcgccactcgatcgatcactctctgctcatcaggtgtttgtggaaagtgcagagatgggggagaacggtgtggtggcgagcaagctgtgctacccggcggcggccatggaggtggtcgccgccgagctcggccacacggccggctccaagctgtacgacgacgacggccgcctcaagcgcaccgggacgatgtggacggcgagcgcgcacatcatcacggcggtgatcggctccggcgtgctgtcgctggggtgggcgatcgcgcagctgggttgggtggccggccccgccgtcatgctgctcttctcgttcgtcacctactacacctccgcgctgctcgccgactgctaccgctccggcgacgagagcaccggcaagcgcaactacacctacatggacgccgtgaacgccaacctgagtggcatcaaggtccaggtctgcgggttcctgcagtacgccaacatcgtcggcgtcgccatcggctacaccattgccgcctccattagcatgctggcgatcaagcgggcgaactgcttccacgtcgaggggcacggcgacccgtgcaacatctcgagcacgccgtacatgatcatcttcggcgtggcggagatcttcttctcgcagatcccggacttcgaccagatctcgtggctgtccatcctcgccgccgtcatgtcgttcacctactccaccatcgggctcggcctcggcgtcgtgcaggtggtggccaacggcggcgtcaaggggagcctcaccgggatcagcatcggcgtggtgacgcccatggacaaggtgtggcggagcctgcaggcgttcggcgacatcgccttcgcctactcctactccctcatcctcatcgagatccaggacaccatccgggcgccgccgccgtcggagtcgagggtgatgcggcgcgccaccgtggtgagcgtcgccgtcaccacgctcttctacatgctctgcggctgcacggggtacgcggcgttcggcgacgccgcgccgggcaacctcctcaccgggttcggcttctacgagcccttctggctcctcgacgttgccaacgccgccatcgtcgtccacctcgtcggcgcctaccaggtctactgccagccgctgttcgccttcgtcgagaagtgggcgcagcagcggtggccgaaatcatggtacatcaccaaggatatcgacgtgccgctctccctctccggcggcggcggcggcggcggaaggtgctacaagctgaacctgttcaggctgacatggaggtcggcgttcgtggtggcgacgacggtggtgtcgatgctgctgccgttcttcaacgacgtggtggggttcctcggcgcggtggggttctggccgctcaccgtctacttcccggtggagatgtacatcgtgcagaagaggataccgaggtggagcacgcggtgggtgtgcctgcagctgctcagcctcgcctgcctcgccatcaccgtcgcctccgccgccggctccatcgccggaatcctctccgacctcaaggtctacaagccgttcgccaccacctactaa

SEQ ID NO: 3252 - DNA, 985 bp, Oryza sativa
  Clone ID: PAT_MRT4530_46101C.1
ctagccgcacacgcgagcggagccagaggaggagacggtagcggcacacgcgagcggagccccagctggagacggacccacccggctccaccacggctccagctctctccactctcactccccgattcgccggcgagcaggcggcggcggcggaggcaccatagctcaaggcttcctctccgctccgcaggtaccaagatgaaggtcaagattcttcagtggcattcggtggcttcttggacatgggacgcccaggatgaaacctgtggtatatgcaggatggcattcgacggctgctgccctgattgtaagttccccggcgacgattgcccgctcatctggggctcctgcaaccacgctttccatctccactgcatactgaagtggggtcaattctcaaacatccagaccaaagatgaaggtcaagattcttcagtggcattcggtggcttcttggacatgggacgcccaggatgaaacctgtggtatatgcaggatggcattcgacggctgctgccctgattgtaagttccccggcgacgattgcccgctcatctggggctcctgcaaccacgctttccatctccactgcatactcaagtgggtcaattctcaaacatccacaccactttgcccaatgtgccgtagggagtggcaattcaagggctaatggcatcaaccaaagatgattaattgtgttcgtgtagactagtacaaaagcaatcatgtaacatctagcaggttgtgtatattttttccctgtaattcctaacttcatcaaagcatctctccctttgaggagcaactgatagaccctaaccatgtgaccccatggatcagtggcatggaattcctttggtgttttcaggttgcttgaatttctgggaagcttcctgttaggctgtgcctggtcacctggccttgctgccttgcatatgataagctgtatcccagtgaggcttgactcggagtaaactagtgccat

SEQ ID NO: 3253 - DNA, 1324 bp, Oryza sativa
  Clone ID: PAT_MRT4530_46195C.1
ccggccggagacacgcgacgggcgctcattggctggggtggggccttcctagcggccccgggcgtctccccgcgtgggcctccccccaaaatttccgacgccagagcgcgaggagacgcacacagagacttggcatttgtagagtttttagatttatagatagcaaagatgtcggcacaggcggagctttcccgtgaggagaatgtgtacatggccaagctcgctgagcaagccgagaggtacgaggagatggtcgaattcatggagaaggtggccaagacggttgactctgaggagctcaccgtggaggagcgcaacctcctgtctgttgcatacaagaatgtgattggagcccgccgtgcgtcatggcgcattatctcctccattgagcagaaggaggaaagccgtggtaacgaggaccgtgtcacactcatcaaggactaccgtggcaagatcgagactgagctcaccaagatttgcgacggcattctcaagctgcttgaatcccaccttgtcccctcttccactgcccctgagtccaaggtcttctacctcaaaatgaagggtgactactacaggtaccttgccgaatttaagaccggggctgagaggaaggatgctgctgagaataccatggtggcatacaaggctgctcaggacattgctttggctgagctgcctcctactcatccaattaggcttgggctagctcttaacttctcagtgttctactatgagatcctcaactcgcctgatcgtgcttgcaacctcgcaaagcaggcttttgatgaggccatctcggagctggacaccctgagcgaggagtcctacaaggacagcactttgatcatgcaactcctccgtgataacctgaccctgtggacttcagacatctcggaggacaccgcggaagagatcagggaagctccgaagcgcgactccagcgaggggcagtaaagccggctttatgtgccctagaagcttgtagctagtgctttgctactgtgtaatgacacctatgtggctgtgattgttgtcgggaaatctggggctcccccgtatgtgaggttgctagcgatggttttgcagtctcgcctttaagctactcgtagcagagcaggtgggggtctgtggagccaggcctggttgggggtgggggagcctcttgaactgcttggtggcacttcctgtttttctgtttgcctttttattggtgtttattgttatggtcaatcctgtgtctaaaaaaaaaaaaaaaaaaaaaagaaaaaaaaaatatagaaaaaactccaacatacccatccctccagcccggggatccact

SEQ ID NO: 3254 - DNA, 368 bp, Oryza sativa
  Clone ID: PAT_MRT4530_46419C.1
ttgatttgtcggacggcggcggcacccctgcgagggaactaactagataggccggccattgagacggcggccggggacaggtacacccgcgggggcgggacgcgctccacagcgtgctgcgcggacaggtccatgctcgcagcaactacaggcccaaggcctggagaccgtcgagcacgttctacggcaagtcgtggagggttaacacggggaggtgcgctgcgtgtgggaggcattgcaaggaagcaagccggacggggctagcacccgagcgagatctgggacagcatggaggagtttctgaccaaggagacgccggataacaacctcatcaggctgctgatcagcatgggggaggcgatgaggac

SEQ ID NO: 3255 - DNA, 221 bp, Oryza sativa
  Clone ID: PAT_MRT4530_4653C.1
ccggaaaaagccaaggttccataaatattgctccacttgtccaaagcccagaaaaaaatccattggtccatgacccggagagggccatcccccccacttatttggccccccaaagggcaaggctgcaaaaaaaatcaagcaacccaagctgaactcacggccccacctgtcagcctttaactggccgaggcccgagactcttgttaaaaacaggaaccccc

SEQ ID NO: 3256 - DNA, 2709 bp, Oryza sativa
  Clone ID: PAT_MRT4530_46959C.1
gtacagcggtatagagagagagacacagagagagagagagagagagcagcagcaggtagcaggtcgaggagggtttgtggccatggcgatcctgtcggatgtggccaccgaggtgctgatcccgatcgccgccatcatcgggatcgggttctccatcgcgcagtgggtgctggtcgcccgggtcaagctggcgccgtcgcagccgggagcgtcgaggagcaaggacgggtacggcgactcgctgatcgaggaggaggaagggctcaacgaccacaacgtcgtcgccaagtgcgccgagatacagaacgccatcgctgaaggagcaacatcgttccttttcaccgaataccaatacgttggcgttttcatgtcgatattcgcggtggtgatcttcctcttcctcggctccgtcgagggattcagcacaaagacccacccctgcacatacagcaaggacaaggagtgtaagcctgctctgttcaatgccctgttcagcaccgtctccttcctgcttggagccatcacctcagtggtttctggcttcctcgggatgaagattgcgacttacgcaaatgcgcggaccaccctggaggcgaggaagggtgttggcaaggccttcatcaccgcgttccgttcgggagcggtgatgggattcttgctggcatcaaatgggcttctggtgctttacattgccataaacttgttcaagatgtactatggcgatgattgggagggtctctttgagtccatcactggctatggccttggtggatcctcaatggctctgtttggaagggtgggtggaggtatctacaccaaggcggctgacgtcggtgctgatcttgttggcaaagttgaaaggaacatccctgaagatgatcctcggaaccctgctgtgattgctgacaatgttggagacaacgttggtgatattgctggaatgggatcagatctgttcgggtcgtacgctgaatcttcctgtgctgcccttgttgttgcttccatttcttcctttgggatcaaccatgatttcactgggatgtgctacccgctgctggtcagctccatgggcatcattgtctgcttgatcaccactctctttgccactgacttcttcgagatcaaggccgtgaaagaaatcgaaccgtcactaaagaagcagctcatcatttctacggctctgatgactgttggtattgcactggtcagttggttggcgctcccatacaaattcaccatcttcaattttggtgaacagaaggaagtcactaactgggggttgttcttgtgtgtttcgatcggtctatgggctggtctgatcatcggatacgtgacagagtactacactagcaatgcatacagccctgttcaggatgtcgcagatgcttgcagaactggtgctgccaccaatgtcatatttgggcttgctctaggatacaagtctgttattatcccaattttcgctatcgcgcttggtatctacgtcagcttcaccattgctgcgatgtacggcatagcagtggctgcccttggcatgctgagcacaattgccactggactgtccattgatgcttatggtccgatcagcgacaacgccggtggtattgctgagatggcagggatgagccacagaatccgcgagagaaccgacgctcttgacgctgctggaaacacaaccgctgctattggaaagggttttgccattgggtcagcagcactggtgtcccttgcactgttcggcgccttcgtcagcagagccggggtgaaggtggtcgacgtcctgtcccccaaggtgatcatcggattgatcgtcggagcaatgctcccgtactggttctccgccatgacgatgaagagcgtcggcagcgcggcgctgaagatggtggaggaggtccggcggcagttcaacaccatccccgggctgatggagggcacaggcaagccggactacgccaactgcgtcaagatctccaccgacgcctccatcaagcagatgatccctcccggcgccctcgtcatgctcacgccgctcatcgtcggcaccctcttcggcgtccagaccctctccggcgtcctcgccggcgccctcgtctccggcgtacaggtcgccatctctgcgtcgaacaccggtggcgcatgggacaacgcaaagaaatacatcgaggctggggcgagtgagcacgcgaggtcgctggggcccaagggatcggactgccacaaggcggcggtgatcggcgacaccattggcgacccgctcaaggacacgtcgggcccgtcgctgaacatcctcatcaagctcatggccgtcgagtcgctggtgttcgcgccattcttcgccacgcacggaggaattctattcaagctcttctaggagagagagatttaaaattcgatcgaatttgaggacggacggagattttcgaataataactagaccacgggatcatgtgggctgaaaaaaaggaacctctgcaaataatgttgctttggtggtagtgggacactatctctacgatttaattttgtctcatgtaggttttgtaatttgtttttaacttgctgcgtcgttttcagtttctgtctgcctgagccctgaggcatcgtgaacttcttttagctgatgtacggcttgtataaagtgaccagatggttttcatctgcagtttatgtgcatatttttgtcatcttaacattgtcgcgcccgatgat

SEQ ID NO: 3257 - DNA, 1081 bp, Oryza sativa
  Clone ID: PAT_MRT4530_47006C.1
gccaagacgacgacgacttgggaattcatttgcatcggcaacgacgatgaagctcgccgtggtcgccgtcgcggcgctcctcctcgccgccggcgtcgcctccgccgatgaattcgacttcttctacctcgtccagcagtggcctggctcgttctgcgacacgcaggctgggtgctgcttcccggacaccggcaagccggcggcggagttcggcatccacggcctgtggcccaactacgccaagtgccgtcccgccgccggcgccgtcgccgacgacgacgacggcgtggtggagatggtggtcgacggcggcgccgccgtcgagcgccaccaccggcggcggcagaagtgctggccggagtactgcgacgacggcaacaagctgcggccgtgggagatcaaggacctcgtggcggagctcgatgcgaactggccgacgctgtcgtgcaagggcggcaagagcttcgagttctggagctacgagtggaagaagcacggcacctgctcgggcatgggccagcacggctacttcgcggcggcgctggagctcaagaagcggcacgacctcgccgccgtcctcgccggcgccggcatcgtcccctccgacgacgagagctactccctcggcagcatccgcgacgccatcgccgccgccacgggcgcggtgcccaacctcgagtgcaaccgcgacgccgccggcgagacgcagctgttccaggtgtaccagtgcgtcgaccgctccgggaagaagctcgtcgactgccaactcccgatgcagggcaagtgccgcgacaaggtcaagctgcccacgttctagctagctagctcccccgtcgccatcgtcgccggcgagagctcgccgtcgccggcatggcggcgcgccggcggctggctggtcttggatgtctgatggatgtcacgtgcgtttgcgttgttgcgtggtgcggttttcagattacgagagattcgaggatttgtccagttggattgctacatgtgtacgttacatttggcactatctgctgacttgctgaacagttgaataataacatatcaagttttaccagttgaaaaaaaaaaa

SEQ ID NO: 3258 - DNA, 661 bp, Oryza sativa
  Clone ID: PAT_MRT4530_47125C.1
attcggctcgagcatttggtgagaacatggtgatgtctgagctagtggagtgctgcaaggagttggatgaagtgcatcatgctttggccgggcataagaaggaggcagcatggcggttaagcagggtggagctgcagttggagtctgagaaggccgggcgaaggagggagaagatggaggaaatcgaagcgaaaatcaaagctctgagggaggagcaaacggctgcattggatagaattgaagcagaatatagggagcagttggcagggctgagaagagatgctgaaagcaaggagcaaaagttggctgaacaatgggctgcaaaacacttgcgacttactaagtttctagaacaggtagggtgcagatcaaggctcactgaaccaaatggaagatagagtgacatcaatcattcacaaattgggaaaatctagtttgcttttacttattattatgtcttgaatttatatgatatgaactttatagtcatagtagttttgttcctgtcatttttctaaaatatgttgttacatatggttattgatatcatccctatcttttcatacaacttgaggacttgcattagcggttgagttatgtttaaatataacatcctttatgaaaaaaaaaaaaaaaggacaggccgccaaatagtgagctc

SEQ ID NO: 3259 - DNA, 1251 bp, Oryza sativa
  Clone ID: PAT_MRT4530_47568C.1
tttttttttttttgtttttcgattcatcgtttttctctcagttagtaccacgattcttcaacgactcaagttccaacaaatgcaagaacctcgcgggcattacagacgaaaaaaaccccgtaaaaacttcatccatatgcacccaccatcaataagtccaaccaaaacgaaacctaagagcttacgcaatctttatctcttctagttcctgctggttaaagcgaccatccttcttgtgtttttttttcaagaaaatcatcgaaaggatgatacttttatatagaacacaggtaacgaattacagagcaactaatccccctgtccatcatacacaagtgcaccttcttagttttagcatcggtacaagcacaattaagcatctaattcagatcctactagagatcaacgcaacacctaggcatcctagaacactactactactacacaacatatcatccatccatccactgcatccacatccaccgccgccgccatcgccgggaagcgtcagaatctagttgtcatcgtcgccggccgccgccttggcgctgccgccggccttcttggggaggagcaggttgtggatgttgggcatgacgcctccgctggcgattgtgaccgtgccgagcaggcgggatagctcctcgtcgttgcggacggcgagctggatgtggcggggcactatgcgggtcttcttgttgtccctcgccgcgttcccggcgagctcaagaacctcagcggcgaggtactcgaggacggcggcgaggtagaccggggcgccggcgccgaccctctcggcgtacttgccggccttcaagaaccgggcgatcctgcccacggggaactggagcccggccttggagctccgcgacatggccttcttggcggcgcccgagccgatcgccttccctctcccggccatggctaaaccaaaccaaatcaaccaaccaaaccctccggtagtagtacggaatccgcgggcgaggcgacgaagcaacagcagcagaaaaatctgtggagaaagtgcggcgacgcagcgagcgagcgagcgagcaatcagtatgtgggctgatccgggccgggtcccccctccaccccgttgattcccctgtcgtgtggagcggggcagtgttcttggttcaggcagtggcgttgttgttagtggtggtgatgatgataaggtggagtagcatttgagaggagagcatgcgagtgagtgagtgcgaccccacgcgtccgcccacgcgtccg

SEQ ID NO: 3260 - DNA, 329 bp, Oryza sativa
  Clone ID: PAT_MRT4530_47854C.1
ttgttgtttttttttttttttttttttttttttttttttttttttgaccataacaataaacaccaataaaaaggcaaacagaaaaacaggaagtgccaccaagcagttcaagaggctcccccacccccaaccaggcctggttccacagacccccacctgtttttgtacgagtagcttaaaggggagactgtaaaaccattgttagcaaccttacatacgggggagccccaaatttcccggcaacaattacagccccataggggtcattacacagtagcaaaggacttgcttcaagcttttagggcacataaaggcgggtttactggccc

SEQ ID NO: 3261 - DNA, 2910 bp, Oryza sativa
  Clone ID: PAT_MRT4530_47879C.1
cggcacgaggacttgtgctgtctatttgtcaaaaatgtacactatacaatgtaaataggaaatttaagaggtttggagatcttgtgttgcctggcatcatcctgccatataaatactagattcttgtgaagcagcaaattatcacgacctgtggatctcacccatatatgtgaaaataggaattggtgtatttgtatctgactctgggggataactaggtgttgatatatgtcatctagcaagaggttcaagctggacctccatcacaccagaaggacttgattctgaattcctgtctgtactgtcaggatgcaaaagatcaactgaatcgtcttcctcggtgttacctaacacccagtgccctctagagcttgtgtcgccgctcctccgtttgacctctttatactccaagtaaagtgttataactatagcagaaagcacccacagcatcaaggcccaagtgagctcctctacattctcgctatcatacctatggcctaaatgcttcattccagtgaaaagtgccacaattccgactatgattgccgacctgcctgtgataacatgaaggtattcccagaggacacgattccaggatgaagcctccccattagctggtctcttgggccggaagtaggcatttagtggctgaagacctgccaacagcagagccgtgacaccaaatttaacatgcactgagctgacataaaaacctctgagttcagctgcagcgaaaaggacaccaaggaacattatagcaattcctgagtattgcagatagacatgtatttggtaccacccgtcacctttcaagttcttcaaataccgggcagccagtattccaccaggaagcaagatgccccaggcaacaaacatcataaacccatgaacagccagaacaggacgcaagtcctgttctgcctcagcagaacctctcaacaaaagcacacgtatggggcgactgcttgtgatagaatgcatgttactatctgtaagactgttacctgaccagcttgcacccatagcccaaacgaccttaaggggcgtggttggatcaataatgttcttacactctacccttccactacaggaaggcctaagaggacgagtaaactcaaatgtaataatgccattttctgacctacacctgacgtaggttaagttctcagatgttgggtggatgcccgctgcactctttccatcaatccagtaactcttgactcgcccaactccatcattgccaacccagccaacataagcataactgttcagcatgccactcccgaacccaacagcaaggtacccacttttcttctcacctcgagctgctatagatatagaatcatgggacagagtccagaacagagtaacctgctgatcatccaaaaggacgctgctattatacatgtcactaaggcctccatcaacaacttgaactttccaacccatcttcggttcatacaatgactggtagtagactagatcaggtgtattccgatcaggcagccaaagcagctctgtaggagttgctggtacaccatgagcatcccggctgccagcatatatgacctctgttttattccgcagtgtagcattccccccaattggatccgacgtgatgtaaagtgcaacatcatgcccagcctgcactgagaacttcactggcacacctctctcaaccttcagcagaggagcctccttcttgttgatgtaaatcaccttgtcagggtttggtgggtttgggtagcggacggctggagcagatgtcaccaccaggggtgtctttgcatccgcgatgatcctctcctgatcctccttgttgtcagcatccaatggtccgttgcagctgtccaccgtttccgacaaattcacccttgcaaacccataggttgtgtccctcggccccccatggttctgcgggaggtagtgtggcctcagagtatccggcggccgcagcttcccaatggcccagacaaccgccatctcctccgtggcactcaccagcacatcatacttggtatccccagtgtcaagcttcctctgatacctcacgaaagacactccatcccgccggtgaccgtacaccagcaatgaatcattcttcccctcatcataaaccttgtcagggcacacaccagataccggcgattcatcggtccccagcgtgcactcgctgtagtcggttatgtagtagtcctcggcgaatggcataccttcctcggtgaatccggcgacggcaacatcggaatggatcatggcgggagaattggccttgggatcagcccacccgaacgccatgtagtactcggagcccacggcggcctcgaggccgatctcgactgtgccggcggaggcattgagcgtccaacggagacggtacttgttctcggcgagagggaggcagttgtcgaacatggtgggaacaggctccggcgacggcgagggcgaggcgacgccggaatcatcggtggcgttggaggcggaggcggaggcggagacggggaggaagacgtggccgaggtcggaggaagtgtcggggtcgaagagcgcgaggaggggcgggagcggggcggagaaggggagcaggagggtggcgttgcggaaggtggagttgagcgggtggggcgagaaggcgcggcccgcggcgaggtcggcgagggagtccccccgcgccgcccagaagcgcgcggagggggaggccgcgaggaggtcgaagcgggtgaggcgcagcgcgcaggagtcgtcgtcggcgaggcggaccgtgccgcggagctggtgctgcagcatggtgaagtccgcggcgaagggcgcggtgtggttggcgtgcgggcacacggcggccgacgacgacgccaccagggccccgatcgcgaccgcgagtacggcgaggcggagggcggcggcggccat

SEQ ID NO: 3262 - DNA, 1041 bp, Oryza sativa
  Clone ID: PAT_MRT4530_48062C.1
gtcgacccacgcgtccgtccccttctccttctctttcccctcggcggcggcggcggcttctcccttctcttctctctctcgcatcgcctactcgttcgttttccctcgaggaggagcagaggcggcggcggcggcggcggagcggacatggctgaggtggaggcagcgccgattgcggcggcggagaccccggaggtggcggcggcggagggagcggcggcggcgaaggcgccgcacaagctgcataggcagtgggcgttctggtacgacatccagtccaagcccaagcccggcgccgcgtgggggacctcgctccgcaaggcctacaccttcgacaccgtcgaggagttctggggcttgtatgatcagattttccgtccaagcaaggtgacagtaaatgctgattttcatttattcaaggctggtgtagaaccaaagtgggaagacccagagtgtgcaaatgggggcaaatggactgtgccatgtagcaggaagaccacccttgagaacatgtggcttgaaacgctgatggctctgattggagagcagtttgatgaaagtgaggaaatttgtggagttgttgctagtgtccgccagagaggagacaagcttgcattgtggactaggactgccagcaatgaagccgttcaggtaaacattggcaagaaatggaaggagattgttgactacaatgataagatggtctacagcttccatgatgacgccaagagggagaaaccaagcagaggtggacggtacaacgtgtaagtcaccgcaaaacgttgcagcttggatagtggccatcgagtggtgtgccgataccggcgcctgttctttacagcctcagctagtgttgttgtccgaggcaatttttccgacctattgtgttgctttcctctctgatagcttatggtaaaagatacaaagatgttgaggagtttgtacgccacttaattttgctcgtaacatacattgacaatcaagaggagccatggcattgcgatctgcttaaaaaaaaaaaaaaaaaaaaaaaaaaaaaaa

SEQ ID NO: 3263 - DNA, 965 bp, Oryza sativa
  UNSURE (1)..(965): unsure at all n locations
  Clone ID: PAT_MRT4530_48097C.1
  unsure (1)..(965): unsure at all n locations
cccaagcgtccgcagaaactaccatcaataacaggactcctgcacttcatacatggccactgccagctctataaacaagaggtttagcctcgccggtgccacggcgcttgtcaccggtggcagcaaaggcatcggccgcgccatcgtggaagagctggcgagcttcggcgcgacggtgcacacctgcgctcggaaccaggcggagctgagcagatgccaggaggagtggacggccaagggcctcgccgtcaccgtctccgtctgcgacgtggcggtgcgcgccgacagggaggcgctcgccggcagggtgtccgccatgttcgacggcaagctcagcatcctggtgaacaacgctgggacggcgtacctgaagccggcggcggacctgacgccggaggagacgtcgaggttgatgacgaccaacttcgagtcgtgcttccacctgagccagctgttctaccctctcctcaaggactccggaagaggcagtatcgttaatatctcgtccgtcgcttctgtcctcgcgttccattctcttcctatctactcggctgccaaaggagcaatgaaccaagtcacaaggaacctggcttgtgagtgggcgagcgatgggatcagagtcaattccgttgcaccgggctacatccaggcgcctctcctggctgccttcgtggccggcaacgatttcgcacaggttgagttcaaccgtcttcctttgggccgtctcggtaaacctgaggacatctcgtcgttggtggcgttcctgtgcatgcctgcggcctcctacatcactggccagattatatgcgtcgatgggggccgtttgccggccgtcaccttgaagtattcaaaacagccccaaacgaggncgacaaagattacttgcacaaaccttgtagatggcataaaaatcgagccggtacggatgaaacctattgggagggcttcaactggagaccacaaag

SEQ ID NO: 3264 - DNA, 833 bp, Oryza sativa
  Clone ID: PAT_MRT4530_48394C.1
cagtctgttcctcgtttcttcaaccactcaagtgccaaacacagcaagatcatcgccgggattacatctgagataaatagccaaaaatttcaccatattcacagccatcaatcaggccaccaaaacaaaccaagaactaagcaatttttttcttgtttcttcctactgcttaacgcaacaacacaccttggtccaaaataaacagctaaatatcctactagtgcataagacaagatgacgaatgcaggcggcggcggcggcggaggaggaggaagggggctcagttgtcgtcgtcgtcggcgtgggacgccttggatgacccggccttcttggggaggaggtgctggtggatgttgggcatgacgccgccgctggcgatggtggcgccgccgagcagcttggtgagctcctcgtcgttgcgcaccgcgagctggatgtggcgcggcacaatgcgggtcttcttgttgtccctcgccgcgttcccggcgagctccagcacctcggcggcgaggtactcgaggacggcggcgaggtagacgggagcgccggcgccgacgcgctcggcgtacttgccggccttgaggaacctggcgatcctcccgacggggaactgcagcccggccttggagctcctcgacgtcgccttcttcgcggccccggcgccgatcgccttcccgcgtcccgccatatcactcgccgacgagaggagaggagaggcgcacgcgctacacaaggaagaagaagaagaagccggcggcgagaaggggcagcggcagcggcggcggcgctaggtcaagaggcggcggcggcgtggattcgcgcccacgcgtccg

SEQ ID NO: 3265 - DNA, 590 bp, Oryza sativa
  Clone ID: PAT_MRT4530_49221C.1
cgccagcatggactcggccgggttcttcaccttcgtggtcgcgaggcgcaaggaggtggacgcgctccgcgccgagctccccgacgcgctcaagcgctgcgtcgatccggcgaggttcgccatggacgcggtctccgaggtgttccccatcgacaagcgggcggtgaggtcccccaccgacctggcgtgggcgtgcgtgctcatcctggaggcggtggtgccgtcgctggccgatccggacccggagatcggggcggcgcgccccatggtgccgcaggcggcgcgcgagagggcgcgcgggatggcgagggagtggaaggacgcggccgagaagaagggcggggtggagggcgccaagccaccggatgcgcacgcgttcctgcagcacgtcgcgacattcgcagtcgcagagaaggaggacaaggagctctacaggaggatcgtcgtgagcttctcgtggcggaggcagatgccgcgtctcgctatcacactcggcctcgaggatgagatggatgatatcattgaagagcttatcactaaggggcagcaacttgatgctgtgaactttgcatatgaggctggtcttcagg

SEQ ID NO: 3266 - DNA, 1133 bp, Oryza sativa
  UNSURE (1)..(1133): unsure at all n locations
  Clone ID: PAT_MRT4530_49446C.1
  unsure (1)..(1133): unsure at all n locations
attcggctcgagcatgcagaagagatcggcgcgnnncatnngcctcnatcatttcaaaggagnccgaaggcactctcctgggcatgggtaaccctctcctcgacatctccgccgtcgtcgatgaagacttcttaaaaaaatatgatatcacctcgaacaatgcgattcttgcggaggacaagcacaagcctatgtatcaagaattggctgagaaatataatgtggagtacattgctggaggtgccactcagaattcaatcaaggttgctcaatggatgctccaagttcctggtgcaacaagttacatgggtggcataggaaaggataagtttggggaagagatgaagaagaactcaaagcttgctggtgtaaatgttcactattatgaagatgaaactacacctactggaacttgtgctgtttgtatagttggtggtgaaaggtctcttgtggcgaacttagcagctgccaattgctacaagtctgatcatttgaagagaccagaaaattgggcactagttgaaaaggccaagtatatttatattgccggctttttcctcactgtatcaccagattccatccagttagttgctgagcattctgctgcaaataacaagatcttctcaatgaacctttctgctccttttatctgtgagtttttcagggatgtacaggagaaagctctaccgtatacggactttgttttcggaaatgagactgaagcaagaacattttctaaagttcatggctgggagactgataatgtcgaggagatagctgtaaagatttcccaatggccaaaggcatcaggaacacacaaaaggataacagttatcacacagggtgcggatcctatttgtgttgctgaggatgggaaggtgaaaaagttccctgtgaaacttttgcctaaagagaaactagttgatacaaatggagcaggagatgcatttgttggaggatttctttctcaattggttcaggagaagcccattgaagaatgtgtgagagctggctgttatgcagcaanatgttatcatccaaaaggtctggcgtgtacggtacccagaagaacgcctgattttctattgaggtgtttctcctcggtgtcgtgttccccattatagaaagttttg

SEQ ID NO: 3267 - DNA, 296 bp, Oryza sativa
  Clone ID: PAT_MRT4530_49943C.1
cggcacgaggggtcacgtggagaaacaaaatctgtggctggtgattcttcaacgcataacactgtcgagggtgagagaaagaaatcagcagctgcaaagtatccaggtgattcacagcagcattcactttccttctccaggcaagataacaagtcttatgtgcctcctttccttagtggaagcactaatgatagctcatcccgcaccttgagcctggttgggtcagaagcttcaaatggcttcagtctaggaggcaaatcaggaaatacatcggccccggcagctacatcagcggc

SEQ ID NO: 3268 - DNA, 1607 bp, Oryza sativa
  Clone ID: PAT_MRT4530_49986C.1
ctagaagccattcatctccagaaggtaagttcgcctcttcatcagcgccttcacagcaaacttgaatggtccatcaaatgctccggagacaaatgcatccgtttccttgcggctagtatgaccgccattgcttccctcgggtgagggcttgatagcgaccaacgttgcaccttgcaacgcaatgccgccaggaagctcaagatatggagcgtatttgagcttcatgttgcatgctggaacctgagtcctgttagaacatgctgaggccgacaactggttctccctaaattccttaagctgctccgctcccatggacaatgtgccctggccatcagcatcggtcagtaccaagcttgtaagagtgggatgatccttgataattgaccgaagaagataatgtctcgttgatgccgcaatcagagagctgattgtccacacgacgcggagtttcaaccctccattggtatagaaggattccggcatgcttccattgtcctccgaatacagctcatgctctgcaccaacaggcttgcggtcgacctgagtacccccaagaatcacacaattctgaagcgtactcccatactccgctcgccatttcaggagaactccctcctcagtccccacatcccccgagggcagctccacccgcagattccggatgtgcgtgaagttccggagcacctgcgccggcgagtgctgcgcgagctgcgggaacagcggccgcccagcaccgttcgggccgcgcatgctgtggaacggcttgatgatcgtgaacagcatcatcttgaggaaatgcgagaggatgttcctcggcttcggcgaggacaggttaagcgcgtcctcagcttcgccgtcgaccgtcacgacgcggtcgatcttgacatagacatcatggacgaggggcacgagcccgtagaaccgcttcgacacggcggagcaccggccgagcgagcgcacatcctcgacattgttgaggatcaccagcacaagcgagtccggcagccggtcgaattggtcggcctccagcaccgggtcggcatggattcgagccattggaaaccgcccgaaatggagaaatggccctaaccccccccccccccccctcccccccgcgcgaggttgcagagaaatggagcactaatctttgcaacagaaatgccacgaacagaagctgctgctcctcctcgaccttgtcctctccgaatggctcacgcaaccatctcagacaccgcgccaccaccaaatcaaccgcgagggccaacctttcgccgcccacacgcgtccggatccgacgccgacgagcaaccgtacggtaccgaaatcgcgaaatcgggagaagggtcgcgccgttttctcaccggaatcgagagtccccccctccacgcgcagctcctctccgaccagccggagatgccgaaagagcttcgatcttggaggccggtgggggcgaatcggacgggattagggtttagggagaggggaattggggatgagatgttcttgttcttgcctctccttttctttcgttttcgcgaagaagaagaagagagtttctctgggcgaagtgcttctcttcctcgtggccgattcctgcagcccgggga

SEQ ID NO: 3269 - DNA, 559 bp, Oryza sativa
  Clone ID: PAT_MRT4530_50367C.1
gcacgagggcatgtcacagagacagaacagattagtgaaatgatgaggcctccagcagcaaggggtgaaagaaagcggaaagtaatggccagtgtcgatacacatgatcatggaaacactgagttgcctgacagcaatgagaatgctgatgaatcactcaggtcaccagagaatggtgagaggctagccagtggatcaggctgtgttgattctaatggtgatgttgaaaaaaagaagatgccattggcaagttgcagctctggatccaaaaagcagaaaagaagggttgaagctacaagcccggccgaacatggtgaggacgcgccatctgctccaaagttggtggagaacagcagtagctcaaagaagaaaggtaaaaagaagccagctgctccagaggctgtcacggatgcagttgttgtagatgaaccagctcctgtcttgccagaagtaaatgtggtagtggtagaacctgagaaaccaaagaaaaaatatgtaccaatcacaccaactatccacactgggttttcattctctattgtgcatcttctaactgctg

SEQ ID NO: 3270 - DNA, 2086 bp, Oryza sativa
  Clone ID: PAT_MRT4530_50542C.1
gcacaagcgacgagattttcgcccccgcttcggattaaaaccctagccggctaaacctgctccgctcccccccgccgccgccggcgccgccgccaccaccactgccggagagagagagagctgcctgggaggagcagcctcggtgcgcgcgcgcgcgctaatcccctcctccactctccgtcgccgccgccgccgcagccatgatctgcgcaatctccggcgaggtgccggatgagccggtggtgtcgaagaagtccgggcttctcttcgagcggcggctcgtcgagcgctacatcgaggaccatgggaagtgcccagtcaccaaggaggagctcaccatggacgacatcgtggcggtgaagaccaacaaggttgtgaagcccagacaattgcaggctgcaagcattcccggactcctggggatgttccaaaatgagtgggatgctatcatgctttctagttttgctttggagcagcagcttcatacagcaagacaagaacttagtcatgcgctatatcagcatgatgctgcctgccgtgttatagctagattaaagaaagaacgagatgaagccagagcacttttggctcaagctgagagacagattcctgcatcgatggcaggagctgcacctacagctgttgtctccaacgggaaaagagcatttgaagatgaagttggaccagacgggaagaagattcgtcctggtatcaaccctgtgatgattgatgaactaacagagtgtaataccatgctctctgcgcatcgtaagaaacgacaggttcctccaactttggcatcaattgatgcaattgagagatatacccagatctccagtcatccacttcacaagacaaacaaaccaggcatcttatctatggatattcatccttcaaaggacattattgcaactggtggcattgatacaaacgcagtgctttttgacaggccatccggtcaaatcttgtgcacacttactggtcactcaaagaagataaccagtttgaaatttgttcctcgggatgagctctttgtaactggatcagcagataagactgttaaaatttggcaaggaagcgaggagggaaattacaattgcatccatacattgaaagatcacactgccgaggttgaagctgttacagtccatgcgactcagaagtactttgtgactgcttccaaggataatacttggtgcttctacgatattccatcaggatcttgcctcacacaggttggcgagtcttcaggacaagagggatatacatctgcatctttccacccagatggtcttatcctggggacagggaccactgaagctgttgtcaaaatttgggatgtgaagacgcagtcaaatgttgcaaagtttgaggggcatgttggaccagtgactgctatgtccttctctgaaaatggttacttccttgcgactgctgctctcgatggagtcaagctttgggatcttcgaaaattaagaaactttaggacgatatcaccttatgactcagacacgccaacaaattctgtggaatttgactttagcggaagttatctagctgttggtggttcagatacaagggtttaccaagtagcaaatgttaagcttgaatggaatcttgtcaagaccttaccagatttgtcaggcacagggaaagtgacaaacgtcaagtttggcaccgatgcgaagtacattgccgtaggttctatggatcgtaacctacggatatttgggcatccgggagaagatgatcaaatggacgacgcaaagccatcggaagagtgatgaaaccaattgtacttcatttggcctgcgtaaattgctccctgtttgtgtgttttgacggtggatgagctggctgagattggaggcacataacaacgggagacgagaagttccttgcaggagcaatttggtgggctttggtcgatgtaaacaaatttgacattgttattgtatttgtaggccttactacctaatgaggatacggtttgttttggagatgaatacaatgctgaagtgctcgacttgcggacatgccaatgaaatctagaatgtgtttaaatttgtggttacgtaatgtcccc

SEQ ID NO: 3271 - DNA, 341 bp, Oryza sativa
  Clone ID: PAT_MRT4530_5060C.1
gtgttgcgggcatgggcatgggagaggttgcagaggacatatacacctaagatgggaccgtggacctaaagggcggcccgggcaccaggatgaacaccggcacctggcatgcctgccgctacattctatgtaacgagtgctgcaagaggctgggctactatggcatgagcaccaacctggtgatctacatgaagacgcgggtcggtcaggagagcgccattgtcgacaacaatgtcaccaactggtcggtgactagatacatgactcgccttgacagtgccttgttggctgatgcctacatgggcaggttatggaccattgccagctctatgagcatctac

SEQ ID NO: 3272 - DNA, 1503 bp, Oryza sativa
  Clone ID: PAT_MRT4530_50714C.1
gtggatccccgggctgaggaatcggcagaggcgtcgctttctaattttttcttttctcccaccctctctctctctccggtctccactccctccgctcctccgctcctcgcctcttttacccgctcttccccccgatctccccggactcccacagccgcagcgaacaaatcccgcgcgggttgggaagagcgagctcgtgaggagagcagagggaaagcgcgagggggaaggaggaggaaaggtgcacaaggtcagactaagtttgcgttgaagaacaaaggagaggaaaaatgtcgcctgctgaggcatcgcgtgaggagaatgtgtacatggcaaagcttgccgagcaggctgagcgttacgaggaaatggtcgaattcatggagaaggtggcaaagaccactgatgttggtgagctcaccgttgaggagcggaacctgctttctgtggcttacaagaacgtgattggtgctcggagggcatcgtggaggatcatctcttctattgagcagaaggaggagagccgtgggaatgaggcatatgttgcatcaattaaggagtaccgtagcaggattgaaactgagctcagcaagatctgtgatggtatccttaagcttctggattcccaccttgtcccatctgccactgctgcagagtccaaggtgttctacctgaaaatgaagggtgactaccacaggtaccttgctgagtttaagtcaggagctgagaggaaggaagcagctgagaacactcttgtggcatacaagtctgcccaggatattgcactcgctgacctgcctacaactcacccgataaggcttggacttgcactgaacttctcagtgttctactatgagatactgaactcaccagaccgtgcttgcaaccttgcaaagcaggcgttcgacgatgctattgctgaactggacactcttggcgaggagtcttacaaggacagcaccttgatcatgcaacttcttcgtgacaatctgactctctggacctctgacaatgcggaggatggtggtgacgagatcaaggaagcagcgaagcctgaaggagagggccactaatctgtcctgaagtctatttctgagtccatttactcagctacctgctgtattactggatcataagatgtactaggatcaattgctatgtggaatcataagattagggctgcgtatgtcaaaatgtgtcgagctgaagtacccagtggacacagtttatgtgcactacattgcttccgtgacttatttactagttaattagcaactttcaaccacttcctgtatttgcagcacattattagtatcgctgtattagcgttttccatgggctggttatgattgagaatacaggccaggcattgcatgtcctttatttgtaagctcgatgtggacacgttggaattcgtgcttttcttattgtcatgagagttgagatgatgtttggattggcggcatcctgtccgtccaagggtcaatgttatttttgaaggtt

SEQ ID NO: 3273 - DNA, 1623 bp, Oryza sativa
  Clone ID: PAT_MRT4530_50741C.1
cccttgccgtccagattttcgctcacctgttcccctcctccgccctctccccaactcgccattttccccgtcttccacagtgacaaccaccaccccacgctttccccttcctcctcgcgatccagcagcgggagagatggatcggccgccgccggatcagcagcggcagaagcaggcgccgctcttctcgccgtaccagatgccccgcttccgcctcaaccaccgggtggtgctggcgccgatgacgcggtgcagggcgatcggcggggtgcccggcccggcgctggcggagtactacgcgcagcggaccacccagggtggcctgctcatctccgagggcaccgtcgtctcgcccgctggcccggggtttcctcatgtccctgggatatacaatcaagagcagactgatgcatggaagaaggtggtggatgctgttcatgccaagggaggcatctttttctgccagttatggcatgtaggcagagcttctcaccaagtataccagccaaacggtgctgcaccaatatcctcaactgataagccaatatcagcaagatggagaatactgatgcctgatggctcctatggcaagtatcctaaacctaggcgcctggcagcatcggaaatacctgaaattgtcgaacaatatcgtcaagccgccattaatgccattgaagcaggttttgatggcattgagatccatggtgctcatggctatatcattgatcaattcctaaaggatggaatcaatgaccgcactgacgagtatggtggctcactttccaaccgctgccggttcctacttgaggtaactagggctgtggtttctgccattggagcagaccgagtcgcggtgaggatatcaccagccattgatcaccttgacgcctatgattcagaccccattaagctcggcatggccgttgttgagcggctgaatgctctccagcagcagtcagggcggctcgcctacctccacgtcacgcagccacggtacaccgcctacgggcagaccgagtctgggcagcatggcagtgccgaggaggagagccgcctgatgcgcaccctccggggcacgtaccagggcacattcatgtgcagtggcggctacacgcgggagcttgggttggaagcagtggagagcggcgatgccgacctggtgtcgtacgggcggctcttcatatcaaacccggacctggtcgagcggttcaggctgaacgccgggctgaacaagtacgtgcgtaagacattctacacgcccgatcctgtcgtgggttacacggactatccgttcctcggacagcctaagtcgcggatgtaaatgtactgcgggataagtaaatcaaggatacgattgtgtattgtaaggaaaataaagggcaacggtgaggtgatttagcttatttttgggacctaatttgacggtaatttattctttcaccaaatctgatatgatccattgctgattcagtagctactctagcctatgtaaaccttgggtcatcagcacagattgtatctatatgtgtattgcataatgtttcatatcagttgtctagcagatttatgcatcgtaccagttagtaactgttattttgatgggaaaaaaaaaaaaaaaaaaaa

SEQ ID NO: 3274 - DNA, 2021 bp, Oryza sativa
  Clone ID: PAT_MRT4530_50815C.1
cccacgcgtccgcccacgcgtccggtagcaaaagaaccgactcatctttttcctctcacttcctccgtttacttcacaatctttagattgtttaactacaaatgatcaccaacagaattcaatccgcagctaccttttgttttcctttctagtttctacccatacgataccaactcggttcttttgctacctcttaatctgtttacagagcaatctataatgcataattaactacaaataaacaaccaatggaataaatcagcacctacaacctcacacaatgtcacagctcttcttccattgctgcccacgcgtccgttcgttcgctgattcgctctcgtccccttccctctcctctctcgctcgctcctcttccgcggcgcgcgcgccggcgactcgccgcgtcgggccggccgacaaccgccgcgagggagaagccccctccccttggggggcacccatgacgtcgtgcgggtgcctggtgctcgagaaggtggaggaccacggcggcgaggcggcggggagggggagagggaggctcgcgcagggtggcggcggcggcggcggtggctgcggatcgtgcgcgggggagtggaggagccggtcggagaccatgttccccatctacgtgatggggagctcgcgggccagctccgccgcggcggcgcggggcatagtcgacgccgccggggaccccatatgggaggccgtcaagtcggaggccaagtctgaggcagagaaggaacctattttaagtagcttcttgtacgccagcgtactatctcatgactgtctcgagagggcgttgagtttcgtccttgcaaacaggctcgaagatccaacattgcttgcaactcagttaatagacattttcaatgatgttatgatgaacaacaaagatatacgccgttctattcgccttgatgctcaggcctttaaagacagagatcctgcctgtgcacaatacagttgggcattgttgtacctcaagggttaccattccgtgcaatcctataggatagctcatgtattatggaatcaaggtcgtaaagttctggcattggcactgcagagccgtatcagtgaggtttttgcagtggatatacacccagcggccagaattggagagggaatattgttggatcatggaacgggtctagttattggtgaaactgccattgttggaaactgggtttcattaatgcagggtgttacacttggtggtactggcaaggaaaatggagatagacaccccaagattggtcagggggctcttcttggagctggtgctactatcctcggcaacataaacgtaggcgaaggtgccatgattgctgctggttcccttgttttaaaggatgtacctccccacagtatggcagtaggaaaccctgcaaaggtagttgggtataaagataaggaagacccttctttaactatgaaacatgatgccagaagagattattttgagcatgttgccgttagtttttcagatgacaaagctaatggaagtgttgtgaagtaaaaaaaggttcgatgatgtttggctggcagttcaaaggaatagcatatgtttcgacatttcttcccagaggacagcactgggtatctgattatgcaagggtgcttctcttttttgcccaggtacccatggtcctgaagctccccagttatattttctcgtggcctttggaccgctgtaataatgtgatgtttatttttctggttactttgtaaggactatgtactggtagtggagaccagtacatagttgctactggtagtagagaccagcagcaactatgtacttcagaatacaagctttcttttttgaatcccagtagcatcagcgtagtgcttaagacttagtgcaagctttcttttctgaatcagtagcgtgaagtatattctacagtactagcctattaggtaaagatgtttttcttttgatgtactaacccatcagaaaaaaaatgttacatctggatgggataataaaaaaggaggcaattgttaaattc

SEQ ID NO: 3275 - DNA, 404 bp, Oryza sativa
  Clone ID: PAT_MRT4530_5101C.1
cccacgcgtccggcatcaagctgtcgcttacactacatactatgtcacagaagaggagaaggaaggggttgccaaaaagctcgatgaagctaaagcctgggtgaaaccatggatggtcttcaaggagctgcatgagttcacgcctgccaatgcctgtgcaaatgcctaaggcccatgtggtttactatgtgtatcaagttatcaagaagatggggaataatttggtgtggatcttgctattggacatgataattatccacatggtaatatgggttggatatcaggatctcacacgataatttgggctggatatatagctaccaaagacattacctatggcgtatttcaacgtggattagtactaagcaagaatgattgcctggtgtatttactacaaatattgc

SEQ ID NO: 3276 - DNA, 376 bp, Oryza sativa
  Clone ID: PAT_MRT4530_51172C.1
atagagggcagagacacctatgatacgtcattatatcacgtttcaagcataaacaggtcacggcaatattatagaccttcaagcgctcgctacatgcgaatgacaaacactacagcgtagcagaacacccatcctgcatgtggatatactactttgttggatatctggacaggagtgctcagatcaaactgcgttacggctgttgagaccttatggcatatgacttgcatggcaatgaacaaggaacgcaatcgagtgcgtgtgatccagaaatggttgccactgtttgcaaaggctcatctgagcagctgcagtggcagcatttttagaccagatagctattctttgctgttcgccacccagactaacaactggt

SEQ ID NO: 3277 - DNA, 775 bp, Oryza sativa
  Clone ID: PAT_MRT4530_513C.1
cacgcgtccgtgagcctcgaagaaataatcccccggtagggagcatatcgctcctccgctgctgtctcgcgcgagcgtccgccgcctcgtctcggtgaagaatcgccgcctcccaccctctgcgagcgccgccgccctccccaactccggcgacgactattcccaagggtgcagtggaagtgtaaacagtttctgtggaaggacagaaaaggcattcatttgctaaatggcatcaaagcttcaagccttttggaaccatcctgctggccctaaaactattcatttctgggctccaacatttaaatggggtatcagtattgccaatgttgcggactttgctaagcctcctgaaaagatatcctatcctcagcaagtcgctgtggcttgcactggagtcatttggtctcgctacagtatggttatcacaccgaaaaactggaatcttttcagcgttaatgttgcaatggctggtacaggcttgtatcagctttctcgtaaaataaggaaagattacttttctgatgagaaggatgctgctgcatcactggaaggataatgacgacagattagattaaccgacctacagcctttgagccagtctcagttcactctggagtctggacgtactgcagatatctctggctttacccaagacaagaacctgttgtttctttctgtatttcttctacacccactgctggagcagttgaaaatattgtccccaaaatccaaataatgcttttttgcattttgtgaaaataatatgcatatactc

SEQ ID NO: 3278 - DNA, 2494 bp, Oryza sativa
  Clone ID: PAT_MRT4530_51503C.1
cggacgcgtggggaaaaaaaaagagaggccacgaagagagctcagctgctgcctctagcttacttggtgataaggaggaggaggaggaggagggcaccgacatggccgcagccacggcgtacaccgtggcgctcctcggcgccaccggcgcgcgcgtccccgccgctccacgctccgccgcgcttctgccgcgccgcggcggcgtgctccaaccgctgcgcctccaggacgcgccgcgactgtccctgctgcacgagccagctgaaaaaaaaagagaggccacgaagagagctcagctgctgcctctagcttgcttggtggtaactaggacactgacgaggacagcaacggcctgcccctctctttccctcgccattaagttttctcgtccggcggcgtcacccctgcgaattaactaactagctaggccggccatggagacggtggccgcggccagctacacccgcggggcggcgacgcgctcgccagcgtgctgcgccgccatgtccttctcgcagtcctacaggcccaaggccgctagaccgccgagcacgttctacggcgagtcgctgcgggttaacacggcgaggtcgctgccgtctgggaggcagtccaaggcggcgagccgggcggcgctcagcacccggtgcgagatcggggacagcctggaggagttcctgaccaaggcgacgccggataagaacctcatcaggctgctcatctgcatgggggaggcgatgaggacgatctcgttcaaggtcaggacggcgtcgtgcggcggcaccgcctgcgtcaactccttcggtgacgagcagctcgccgtcgatatgctcgccgacaagctcctcttcgaggctctggaatactctcatgtctgcaagtatgcgtgctccgaggaagtcccggagctgcaagacatgggtggaccagtcgatggtggtttcagtgtagcattcgaccctcttgatgggtccagcattgtcgacacgaacttcacagttggaaccatatttggtgtctggcctggtgacaagctgacaggcgtcaccggtggagaccaagttgctgctgccatgggcatctatggccctcgcactacttacattatcgctctcaaagattgtcctggaactcatgaattccttcttcttgatgaaggaaaatggcagcatgtcaaggacaccacaaccattggagaggggaaaatgttctctcctggtaacctgagggctacatttgataatcctgaatatgacaagctcatcaactactatgtcaaggagaagtacacattgcgttacactggaggaatggttcctgatgtcaaccagatcatagttaaggagaagggcatcttcaccaacgtgacgtctccgacagccaaggccaagctgaggctcctgttcgaggtggcgccgttgggtttcttgatagagaaagccggcgggtacagcagcgacggcaaacagtcggtgctggacaaggtgatcaacaacctcgacgagcggactcaagtggcctacggttccaagaacgagatcatccggttcgaggagactctctacggctcgtcgaggctcaccgccggcgccaccgtgggcgccgccgcctaatcttttgctgcaacgcgagcccagtgtctctgcaggcctcaaaaacgctgaaactgcagtcgttttagactcccatcctgtaatgcagattgggttgtagttgaagtgggacttgaaactgcaaagttatactcctttttgcaaggtacccgtttttttccccttttggtgtaaacagttgcatataaaggtaaattcgcatttctgttttgccactaagcaacaaaaaaaaaaaaaaaaaaaaccgcgtcagggccgcctccgacgacacctccacctcggccagcggcgacgagctcgtcgccgacctcaaggcaaagtgggaggcgatcgaggacaagccgacgttcctcctctacagcggcggcgccgtcgtcgccctctggctcaccaccgtcgtcgtcggcgccatcaactccgtgccgctgctccccaagatcctggagctcgtcggcctcggctacaccggctggttcgtctaccgctacctcctcttcaaggagagcaggaaagagttggcgaccgacatcgagaccttgaagaagaagatcgctggaacggagtaattaagcagctgcatttgtccggggaagttttggggggtgactctctagagtgcttgctgctgcttcctctgtgtgatgtttgtatatctctacgagaatatgttctgctcccatgtgcagtaacagcgtagtgcaaaaactgtatcaaacctactatcagttgtttcttcgaaattcaaaacaatttcttcgctttcttgttgcgtggaagtgttcatataatctggcgtatgacaatgagaatatatatctcggagaatggttgatcgactcattagaaaagaattgcaaatgagttgatgataaacatctctg

SEQ ID NO: 3279 - DNA, 1071 bp, Oryza sativa
  Clone ID: PAT_MRT4530_51616C.1
atgtggaggctgaaggtggcccagggcggcggcgctttgttgcggtcgacgaacggcttcgccgggcgagcggtgtgggagttcgaccccgaccacggcacgccggaggaccgagccaacgtcgagagggtgcgccgcgacttcaccgaccaccgcctccgccgcccggagtccgccgatctcctcatgcgcatgcagtttgcaagagaaaacaatcaccaacgccgtggtgatcgtattccaccggccgtcaataagcttggcgagaaggagcaggtgactgaagaaactgtgatggcttccttgaggcgagctctcgatgagttctcctctctgcaagcagatgatggccactggcctggcgacctcagtggtgctatattcatcatgcctgtcttgatattttctttgtatgccactggatcactggacactgtcatatcatcagaacaccggagggagatatgtcgctacatctataaccatcagaacgaggacgggggatggggcatgctaatcttgggatcaagcacgatgtttgccacatgcttaaactatgtcaccctgagacttatcggcgaggagccaagcaatgagcaattagctagaggacacgcctggatcatatcacatggtggcgccacccttgttccgcaatggggaaagatatgtctgtcgtttatcattagaggcaaattctggggcccgacccgcgtggtgtacgtgccgatggcctatctgtacggcaagaagttcgtggggcccatcacgccaaccatactggcgctgcgagaggagatatacacggacccctaccacaccattgactgggcccaagcctgcaacgcatgctccaaggaggatttggtctgcccgcgcacgctgctgcagaatgtggtgtggacttcgctctacaagtgggtggagccggtgctaggcagcaggccgatgaacaagctgagggagagagctttggatagactcatggagcatatccattacgaagatgaaaactcacagtacctctgcctatgtcctgtcaacaagggcaagaagtggaggcagaggtag

SEQ ID NO: 3280 - DNA, 1238 bp, Oryza sativa
  Clone ID: PAT_MRT4530_51694C.1
tctgcttctccaattttccaagcctgcctccaagcgcacgccacgatcttctagaagcgattcgcgcgcgccgccgcctcctcccctccccttccccggagcgaagccgccccgccgggggggatgtcgccggcggcggacagcgcggcgtcgaagcggcaggcggagctgctcaagcaggagggcaacgccttcttcaagaaggaccgcatcagcgccgccatcgacgcctacaccggggccatagctctctgcccaaaggttgcagtatattggaccaaccgagcactttgctacaagaggcggaatgagtgggttagggctgaggaagattgtagaacagctattcagcttgacagccactctgttaaggcacattacatgctcgggcttgcacttctcaacaaggacgaattggccgagggaataaaagaactagagaagtcgttggagcttggaaggggtgcacatccagcaagttacatggttgaagagatctggcaagagctttctaaagcaaaatacatagaatgggaaaatttatcaagcgaacgagtccgtcaattgcataagctgaaggaagcatgtaaagaagctcttaggaattataacagccttgacaatcctcctgcatatgtccccgaggaacagctaaatgagcttgaggaagtttttcggaatgccaggaagtctgatattccaacagaagttcctgatcatctctgctgcaaaattactcttgatattttcagagacccggtgataaccccaagtggaatcacgtatgagagggcggtgattcttgatcatcttcatagggtggggaagtttgatcctgtgacccgtgagacacttgaaccacaccaactggttcctaaccttgccatcaaggaagctgtccatgcatttttgagtgaacatggttgggcttacaggatgagatgactactttgaattacacctgggcttggagctttggaggcaacatttcagattgcaatatacatgtttcggttagtcaacttaaatgtgtcattttgtttatctttacatatttattggtggaaaaggttttacctgggatggctgtgtacagattccccttctctagctatccctcctctctactctgttcatgtgtaatgcttggtatcagattatcacttatccacagtaaaagaaaattaaagtggctgtcatactccttgttctctgattattggtttttggcgcactcg

SEQ ID NO: 3281 - DNA, 1520 bp, Oryza sativa
  Clone ID: PAT_MRT4530_51807C.1
cggctctgcaggcttcgttcgctcatcgcgtctcgactccactactgtggttgcatatactactacacttgcagttgcatccagagcccgccccgcgtctctactcgctccgccgcgccgtcgtctctcccgacttcggcgacaagcgagcgacgcaggccaccgcgcgcggttcgttttcgcgagggaggccgccgccgaccagccgccatggtctcgccggacaccatccgcacggccatcggcgtcgtaggcaatggaaccgccctcgtgctcttcctctccccagtgccgacgttcatacggatctggaagaaggggtcggtggagcagtactcggcggtgccgtacgtggcgacgctgctcaactgcatgatgtgggtgctgtacggcctccccgcggtgcacccgcacagcatgctggtcatcaccatcaacggcaccggcatggccatcgagctcacctacatcgccctcttcctcgccttctccctcggcgccgtccgccgccgcgtcctcctcctcctcgccgccgaggtcgccttcgtcgccgccgtcgccgccctcgtcctcaacctcgcccacacccacgagcgacgctccatgatcgtcggtatcctctgcgtcctcttcggcaccggcatgtacgccgcccccctctccgtcatgaaaatggtgatccagactaagagcgtggagtacatgccccttttcttgtccctggcgtcactggtcaacggcatctgctggactgcctacgccctcatccgcttcgacctctacatcacgatccccaacgggctgggagtgatgttcgcggtggcgcagctgatcctgtacgccatctactacaagtcgacgcagcagatcatcgaggcgcgcaagcgcaaggaggccgaccatgtcgccatgaccgatgtcgtcgtcgactccgccaagaacaacccctcctccggcgccgccgccgccgccgccaacggccgctactagctcacgccgccctctttacttcaccagctagccagtcactcaggaggcatggccaccgatgaggccttcatgacttactagcaaagtggagtactacctttagctaagccgtcccaaagggatattactacatgtctcaaattaattagctaatctaatcaccatcaccctgcctaatccgctgctgttaattagtatggcagagagcaaaagaagaacaaattgagctgcacttcttatatgtactctcaagtgcagtgctactattgtcagtcccattgggggtaatttactgtcttatttacaggaggagggcctggctgctcttgttaaaaacagctagccctgccttttcttttttcaatatcatcatcatgccgtgcttttcgatctaaaaaactgtaatttttccttgctttttcttgcctttctgtacctgccgtaatgtaccttggaggccatccagatggtgttggggattatgatacctggaaaatgaagaaaaaaaagatttaaaaaaaaaaaaaaaa

SEQ ID NO: 3282 - DNA, 1411 bp, Oryza sativa
  Clone ID: PAT_MRT4530_51828C.1
tggggcaccatgactgttcacccggcctatctgacaattctatgtctaaggaagatgctatgtcaactggtgattcaacggaaagccttgatattgattgccttgatgatggggactccgaagtggtatcttccttgcaacatttggcagatgataagcttcatatttctgacaacagggatgttgcaggtgtggcatccaaatggacgaagcatggttgtaattcagtagaaattgattatatcgtcgacattgacaacaaccatgaggatccacagctgtgtgcaactcttgcttttgacatttacaagcacttgcgagtggctgagcagaccaagaaaaggccttcaacagattttgtggaaaccattcagaagaacattgacacaagcatgagggcagtgttaatagactggcttgtggaagtcacagaagaatatcggcttgtacctgaaaccttatacctcactgtcaattacattgaccgtaagtatgaagagatatgcccaccccaagtagaagagctctgctatatttctgacaatacatacactaaggatgaggttttgaaaatggaagcttctgtcctgaaatacttgaagtttgagatgactgcacctacaacaaaatgctttttgaggagatttctacgagctgctcaagtatgccatgaggctccagttttgcatcttgagttcctagctaattacattgcggagctatcacttctggagtacagcttaatttgctatgtaccgtcacttatagctgcgtcttctattttcttggcgaagtttatccttaagccaacagagaatccttggaattcaacactttcattctacacacaatacaaaccatccgacctatgcaattgtgcaaaaggactacaccggcttttcttggttggccctggaggcaaccttcgagcagttagagaaaaatacagtcaacacaagtacaaattcgtaccaaagaagtactctccaccatcaattccatcagagtttttcgaagatccaagcagctacaagcctgattaactccagttactccctgaagtctttcagtggaggtgtgcacgcttttgccaccaagatggtacgaggcaacttaccccgtgggatgtgttgaaccttgtgttagcagattggtagattgtacatcgtagatgaagtggtagagctgtacatcaagttggcctcatttgtgtatgcacggcaagtgcatttctctggcggcggcttgcttacaaccacagtgcataaagctgctagtcctttcctactctatccattttgcttgctccaagcttgtttgatatgattttaccgtgttactgtaaacaaatggatatgctggataagagataaatgcctgagggcaagtgaagtaaaaaaaaaaaaaaaaa

SEQ ID NO: 3283 - DNA, 2149 bp, Oryza sativa
  Clone ID: PAT_MRT4530_52012C.1
gtcccttgtggtgttttttttttttttttttttttttttttttttttttttgtagattgcaaatcaataggcaaacttagctcctttataaaattcccaacaaacataaggttagggatctaccagaaagcaaaatctgccgacgtagaccctaaacacaaccggggagtaattactcgtgcaattaacttagcttaatctccctctaggctctagtagtttcagtttcagtagtactgtagttttttcaccagctgaatctgacccacagcagcaacgaaccagagcgcaagaacacaacgcatttctgcctctttttttttggctggaaatggatatattccccaagcgtgacaacaacttttgacggccactgtgcgtggctagtccccccccctcccgccgtaattaaaggctctgaaacgtaactggttctgcggttcgtcaacggtcgggcaacatcacgctgtatgtgaccgcgaccatccggtcccccgccgcgcggtcggcggcggcggccaccacctgctcgtacgccgtgccgtcgtaccgcggcagcgcgttctccccggcgagcccgacgcccgccgcgcgcgccgcgggcggccacctgcctgacgagcgcctcgggcatgcactgcgcctcctgcggctgctcgtggtcgcgcatctccacgcaggtgaagttgagcacggcgccgtggcgcgccagcatgcgcgcgatcgggaggtagccgtcgcggtgccgcgtgttgtagtaccccgccgtgagctccggcgcgtgcgaccgcgtgccgtagtgccagtggatgccggccaccttgaccgagatcttggcgccggcgccgtcgccgaacacggacgtcgcgcccgacagcacgcgctcgccgtgctccagcagcatctgcgaataccacgacaggaagaactcgccgtactcggtgctccacccgccgcagtcgccgcggaagaacaccgtgtcttccggccagttgttgtagccgccggcgtccgtcggcccgccgtggccccactccggcttgcccctcgcctccgccgccgccttcaggctgctacgcatgtacctgtcgttgcattggaaggcgccgatgccggggaacctccaggtgccgttgctctccgggtaggacgggtaccgaagctcgccggcggggcccatgccgacttggatttcgacgatggtgtcgccgaggaaggaggcgaagtggtcgcggaaggcgcgcatgaagtcggtgtagcactcgacgggcgtgcggcccttgaagacgggcatggcgtcgcagccgagggagatgtactcgaagttgcggcgtccccattggtcggtgtaggcgaggtcgttgtccttctccatctcctccaccacccacctcgggagcgggatgttgacggagtcgccgacgttgccgccgcactggtggaaggacatgacggcctggaccttgaggccggtcttgcgggccatctccatgagctccacgtagccgtcgaagttgtaccggccggggccctcgctctccacgatgccccaccacacgtccaccatgatcccctccacgccggcgctcttcagcgccgccaggctcgccgccaccgccttcctccggttcagcgcgctcccgcacttgctcaccgtgtccagcggcatcatcacgaacaccggcacgccgttcctcctgctgctcgccgccgccgccgccacgtgcctggccaccgcccggcacgccaccggctcgcacgccgcctgcctcttcatcctcaggctcgtcgtggccgacgacgacgacgacggcatggcgaccaccgaagcagctcgccgcgcatcaccggcggtcgcgaagcacgctgccgccgcggcgctctgagccaagttcaaggccatcgtgtagaaaatcttaacccgaaaatcgaatccccaacaaaacgcgggaaacaaagaagtgatcaacagatgaaccaccccaaaaggaaattgttttttttttttcttttttgcgatcgacacagccttgatccgaacagaactgggagagatcggattattgggaggttggggattgggaatatatctaaagccaaaaaaaaaaaactaaaattattaaaaataattattcaatgtggggtgaaa

SEQ ID NO: 3284 - DNA, 1914 bp, Oryza sativa
  Clone ID: PAT_MRT4530_52053C.1
gagcgtccggcacgagggagttaacgctatgcggccctctccgcgccttgaacgctctctctctctctccctccccgattcgattcaattcgcgacgcctccgtgaaattctccaaagccagcttgccctgtagccgcgtgctccggccatggcgttcttcaggggcctgaccgcggtgtcgaggcttcgatcccgcgtggcacaggaggccaccacgcttggtggtgtgcgatggctgcagatgcagagcgcatctgatcttgatctcaagtcccagctgcaggaattgattcctgaacaacaggaccgcttaaagaaacttaaatcggagcatggaaaggtccaacttggaaatataacagtcgatatggtccttggtgggatgagagggatgactggaatgctttgggaaacatcattgcttgacccggatgagggtattcgttttaggggtctctcgattccagagtgccagaaagtgctgccgacagcagttaaagatggggagcctttgcctgagggtctactttggcttcttttgaccggaaaggtgccaaccaaagagcaagttgatgctctatcaaaggaattggctagtcgttcgagtgttccaggtcatgtgtatgaggcaatcgatgctctccctgtaactgctcatccgatgacccagtttaccacaggagtgatggcacttcaggtggagagtgagtttcaaaaagcctatgacaaaggaatgtcaaaatcaaagttctgggagcctacctatgaagattgcttaaatttgatagctcgccttccagcagtggcttcaaatgtttaccggaggatttcaaggggtatgaaggcaaatttttcacacatgcttgggtttgatgatcccaaaactttagtttctttgcctgtatactcacaatggaccactgatcatgaaggtggaaacgtcagtgctcatactggacatctggttggaagtgctctgtcagacccttatctttcttttgcagctgcactgaatggtttagctggaccgttgcacggcctggctaatcaggaagtgttgttgtggatcaaatctgtaataggtgagactggtagtgacgttacaactgatcaactcagagagtatgtgtggaagacactaaaaagtggaaaggttgttcctggctttggtcatggagttctacgtaagaccgatccacggtatacatgtcagagggagtttgctttgaagtacttgcctgaggatccacttttccaactggtctccaagttgtatgaagttgtgcctcctatcctcactgagcttggcaaggtcaaaaacccatggcctaatgttgatgctcacagcggagttctactgaaccactttggattatctgaagctcggtattacactgttcttttcggagtttcaaggagcattggaataggatctcagctcatttgggaccgtgctcttggcctgccgctcgaaagaccgaagagtgtcaccatggagtggctggagaaccactgcaagaaggttgctgcttgaagctacacacgcctacacggctgcgttttttttttttttttttttactctttgagcatctttgatgctaataactgagcataaactcgaaagagttagccgcattttacccttttttcccccgggccaataaacaagaggaagatgctctcagctggtaggattttgtaaccgtcgtcagttggtatgctcaaagtttatctgccattgggcaacaatgtgattagttttattttgcttagagctttttttttgttcgttgctgaacaactttttcgagcattttaagtttgctcgagttaatataccaattgctggttacggtacaaaaaaaaaaaaaaaaaaaaaaaaaaaaaaaaaaaaaaaaaaaaaaaaaaaaa

SEQ ID NO: 3285 - DNA, 509 bp, Oryza sativa
  Clone ID: PAT_MRT4530_52055C.1
tttcttgaaaggtgccaaccaaagagcaagttgatgctctatcaaaggaattggctagtcgttcgagtgttccaggtcatgtgtatgaggcaatcgatgctcttcctgtaactgctcatccgatgacccagtttaccacaggagtgatggcacttcaggtggagagtgagtttcaaaaagcctatgacaaaggaatgtcaaaatcaaagttctgggagcctacctatgaagattgcttaaatttgatagctcgccttccagcagtggcttcatatgtttaccggaggatattcaagggagggaaaactatagcagctgataatgcactggattatgcagcaaatttttcacacatgcttgggtttgatgatcccaaaatgcttgagttgatgcgactatatataacaatccacactgatcatgaaggtggaaacgtcagtgctcatactgcacatctggttggaagtgctctgtcagacccttatctttcttttgcagctgcactgaat

SEQ ID NO: 3286 - DNA, 2008 bp, Oryza sativa
  Clone ID: PAT_MRT4530_52057C.1
gaaaatgaatcgtacttgtaaatttaacaacagaaaggaaatgaagaaatgtgccataatccacaactggtatgttaactcgagctaacttagaaggctcgaaaaagttattcatcaaaggataaagctctaagcaacttaaactaatcacattgttgcccaatggcagattaactatatgagcatcctaacagcgatggctacaaaaatgtaccagccgatcgagagcatcttcctctagttattggcctgggaaaaaaatattaaaatgtggctgaacgtttcgagtttatcctcagttattaacatccaagatgataattgttagaagaattaacagcagcggtgtaggcgtgtgtagcttcaagcagcagccttcttgcagtggttttccagccactccatggtgacactcttcggtctttcgagcggcaggccaagagcacggtcccaaatgagctgagatcctatgccaatgctccttgaaactccgaaaagaacagtgtaataccgagcttcagataatccaaagtggttcagtagaactccgctgtgagcatcaacattaggccatgggtttttgaccttgccaagctcagtgaggataggaggcacaacttcatacaacttggagacgtagaactccatgaccaaagccaggaacaacctacgaatgaatgtgtcatggcatactatctttccactttttagtgtcttccacacatactctttgagttgatcagttgtaacgtcactaccagtctcacctattacagatttgatccacaacaacacttcctgattagccaggccgtgcaacggtccagctaaaccattcagtgcagctgcaaaagaaagataagggtctgacagagcacttccaacctttcctaatgcattaaaaggccatactgatacaccaggattttccagatgtccagtatgagcactgacgtttccaccttcatgatcagtgtggattgttatatatagtcgcatcaactcaagcattttgggatcatcaaacccaagcatgtgtgaaaaatttgctgcataatccagtgcattatcagctgctatagttttccctcccttgaatatcctccggtaaacatatgaagccactgctggaaggcgagctatcaaatttaagcaatcttcataggtaggctcccagaactttgattttgacattcctttgtcataggctttttgaaactcactctccacctgaagtgccatcacccctgtggtaaactgtgtcatcggatgagcagttacagggagagcatcaattgccttatacacatggcctggaacactcgaacgggtaaccaattcctttgatagagcatcgacttgctctttggttggcacctttccagtcaaaagaagccaaaggagaccctccggcaaaggttctccacctttaattgctgttggcagcactttctggcactctggaatcgagagacccctgaaacgaataccctcctccgggtcaagcaatgatgtttcccaaagcattccaatcattcctctcatcccgccaaggaccatatcaacagttatgtttccaagctggaccttcccatgttctgatttaagtttctttaagcgatcctgttgctcgggaatcaattcctgcagctgggacttaagatcaagatcagatggactctgcatctgcagccatctcacaccaccaagcgtggtggcctcctgtgccatgcgggatcgaatcctcgaaaccgcggtcaggccccggaagaacgccatcgccgcctgcaggggtggaccggaggcggaagggaagcagcaggacgacggcacccgccgccgctcctagcgaggaggagagacctcctccgggatccgaggccgggagggaagacggacggggagattgcctcgcttgggcaccgccgcgatgcgatgcgatgcgatgctcgccgtcgccagcgatggagatcgggtcgacggcggcggcaaggagagcggacgcggg

SEQ ID NO: 3287 - DNA, 1391 bp, Oryza sativa
  Clone ID: PAT_MRT4530_52242C.1
agcacacgcgcgcacacgcacgcacgcacgtacatcgcgcgcgccacgccacgccacgccgcggtcacaccgttccaagccactctcacacgcacgcgcgtcgccgccactacactctcatggctttcacggtcaaggcgtcgtcgccgtcgtcgccggctgcttcttcttcttcttcctcggcgccagctaagctcggagcggcgccggggagggtcgcggtcaggaagctcaccgcggcggcgacgtcgcttaggctcgatcgggcgcccgcggcgccggcgacggagcgcgggctgtcgtcggtgtcgcggaccatgtcgaggctgatggagaaggggaagacggcgttcatcccgtacatcaccgccggcgacccggacatggggacgacggcggaggcgctgcggctgctcgacgcgtgcggcgccgacgtcatcgagctcggcgtgcccttctccgacccctacaacgacggccccgtcatccaggcctccgccgcgcgggcgctctccgccggcgccacgatggacgggatcatgtcgatgctcgcggaggtgacgccggagctgtcatgcccggtggtgctcttctcctatctcggccccatcgtccggcgaggtccggccaacttcaccgccgcagccaaagaagccggcgtacaaggtctaatagtacctgatcttccttacctagaggcatgctctttcaggagtgaagttatcaagaacaacctagagctggtgctgcttactacaccaactacaccaccagacaggatgaaggcaatcacagccgcctcaggaggatttgtttacctggttagtgtcaatggagttacaggatctcgccaagacgtgaacccgcgtgttgagcatctccttcaggagattaagcaggtcactgacaaagctgtgtgtgttggctatggcatatcaacccctgatcatgttagacagatagcagagtggggtgcagatggggtgatcattggcagtgcaatggtgaggcagctgggtgaagcagcttctcccaagcaagggctgaaaaggctggagaagtatgctaggagcctgaagaatgcacttccatagaagctataaaaacaagttgctaaataatggcatgagagattaattaattaatctcttggtgatgactagctacatgcataaaagggaagctgaagctgcctttctcatagtctcatagttaactgtaccgcaaattagcactagaaagtgttatagataataagtgatgtataggcatccagatccttggggactgtaaaacacctcgtctgtgtagaggtcggatgttaattcttcggttgttcgaagaaaataattgctgcaaattgtgtgcaaaactggaagcttcgccccttc

SEQ ID NO: 3288 - DNA, 1498 bp, Oryza sativa
  Clone ID: PAT_MRT4530_52965C.1
ctcgaaacacaagaaacaaccggagaaactgagcccggccgaccgcaaggacagcaagctattagccatcctcgcatggatcccaacgatgccttctcggccgcgcacccgttccggtgggacctcggcccgccggcgccggcgcccgtgccaccaccgccgccaccaccgccgccgccgccgccggctaacgtgcccagggagctggaggagctggtggcagggtacggcgtgcggatgtcgacggtggcgcggatctcggagctcgggttcacggcgagcacgctcctggccatgacggagcgcgagctcgacgacatgatggccgcgctcgccgggctgttccgctgggacctgctcctcggcgagcggttcggcctccgcgccgcgctgcgagccgagcgcggccgcctgatgtcgctcggcggccgccaccatgggcaccagtccgggagcaccgtggacggcgcctcccaggaagtgttgtccgacgagcatgacatggcggggagcggcggcatgggcgacgacgacaacggcaggaggatggtgaccggcaagaagcaggcgaagaagggatccgcggcgaggaagggcaagaaggcgaggaggaagaaggtggacgacctaaggctggacatgcaggaggacgagatggactgctgcgacgaggacggcggcggcgggtcggagtcgacggagtcgtcggccggcggcggcggcggggagcggcagagggagcatcctttcgtggtgacggagcccggcgaggtggcgagggccaagaagaacgggctggactacctgttccatctgtacgagcagtgccgcctcttcctgctgcaggtgcaatccatggctaagctgcatggacacaagtccccaaccaaggtgacgaaccaggtgttccggtacgcgaagaaggtcggggcgagctacatcaacaagcccaagatgcggcactacgtgcactgctacgccgctccactgcctgcacgaggaggcgtcggacgccctgccgcgcccctaccaagccccgccgcgaagaacgtggggccgtggagccaggcctgctacgcgccgctcgtcgacatctccgcgcgccacggattcgacatcgacgccgtcttcgccgcgcacccgcgcctcgccatctggtacgtgcccaccagactccgccagctctgccaccaggcgcggagcagccacgccgccgccgccgccgcgctcccgccgcccttgttctaagctcgccggagactctgctgctgttcccgcgccgccacggcgcgtgggagtttcctgtggtgttgggccgtgttttcgttgtaaggcagttaggtcgttctaagctattcgatgggccgatcgaggatgcgtcgtcgtgtaggaactcgtcgtgtacccatgtttgcgatctggatggcccatttgtttagctgttaccatgttaaattcgtttcctttatttatgaaatggtaaatcctaaatgtcgtg

SEQ ID NO: 3289 - DNA, 1932 bp, Oryza sativa
  Clone ID: PAT_MRT4530_53245C.1
gcccagcgccccgagccggccccgcctcccccgaatccttccctcaacttcccccaaatagccccatctctttggccatccgagcgggtcagctgccggcgagttggctcgtctccggcccgggaagggatggcaagggggagcggggagggaaggaggcatgggcagcggcgcctgggaacccagcagcgagaagcacggcgccaccggggcggcgatccggagggtggcggcggggggtcggccccaagcgaaccgtcctacctgcgcggcgagggggccgcggccctgctcaagacgtccatcggcacctccatcggcgcgacgctgccacataacgagcaccacccccgcaacaatgccatccccccgcacgaccgccgcgggccgagcccggccgcacgcggcgccggagcctccaccggctcgtcggggtgaagggccaccgctgtttccagccaggccggcggtacctagtcttgcgtgcggcggccggtagtcccgcaggttctctccaatcgttgcgtgcggcagttagggtgggcagccgcctgtaatgagggcttcgttcctgcacctgatgccggtttcgcttgagcattcaggagttgggatggccgaataacgagaggcttataaggaattgccaattttaggtcttcgactgggaaaatctaagctgagacatcgcggcgtacttaagatcgcccgacgaaaacgtaatacggcttcactggaaccaaaaacgagcaaggcccgcggaagacggtctccaccatgagcgccgtctccgcgccctatccccacgcgccgcaccctctacagcctagcgggctgatcgattttgtctccctgcgccatctctcccatgtcgtctggtcgtgcgttcaagtcttgtactcaggaacgggcgcttccaaccactcctcaccaagtcaaagtttcttcctcgcgaccggcggcgagcggcggcggcggcgatgtctgggagaggcaagggcggcaaggggctcgggaagggcggcgcgaagaggcacaggaaggtgctgcgcgacaacatccaggggatcacgaagccggcgatccggaggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggattcggcggctaggcgaggcgatgcgaggccacgcgattggatagggattcgattagtgccatgttcttcagttcgtcgtagtagcctagcctcttctcctgtagctgttgtttcatctcgtctcctgttccttcattaattagggatgtatgaactactggttcgttcgttcgaatggaataggaaatctgcagtgatttaccctctaaaaaaaaaaatataaatatgtatcggtcagatctttgcatgtaaattagtactcctagaagcaaataataataataattaataaagagaatgggggttatttatcaaaaaaaaaaaaaaaaaaaaaaaaaaaaaaaaagaaaacaaaaaaatacaaaaagacaagaataatgagctatatcgcccaacattcggccctcccgcgcctgtcccgagtgtcctgccttacggggatgggtcctcccttcagcgccgttgcgcgcacgggggggtaccctcgccggtatgctgctgtgactccgttcgcgtgctgctgtgtttgtcttccctccccggtcgcctctccaatcccttgtttggttttccctggtttctgattttatgtactttcgctgttctggtttctttgtattttatgctaattagctttattgattatcgtctt

SEQ ID NO: 3290 - DNA, 877 bp, Oryza sativa
  Clone ID: PAT_MRT4530_53246C.1
acactcctatgggcgattgggaccctcgaggccggccgggacaagcaaaatccccaaatcctccagatcgtcttcgtcttccacctcgagctcttacgcatcgtcagccatgtcgggccgcggcaagggaggcaagggtcttggcaagggcggcgcgaagcggcacaggaaggtgctgcgcgacaacatccagggcatcaccaagccggcgatccggcggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagttcccggccccctgtgctcgatccagatctgatgccgttagcgttgcttagggtttcgttgcggaaattgtactacttcgttgtttctgcttgtgcaaagtgaatggatggttggattaaatgaatcaaaaaaaaaaaaaaaaaacccgcggccagcgccagggccgcaccctctacggattcggcggctaggcgaggcgatgcgaggccacgcgattggatagggattcgattagtgccatgttcttcagttcgtcgtagtagcctagcctcttctcctgtagctgttgtttcatctcgtctcctgttccttcattaattagggatgtatgaactactggttcgttcgttcgaatggaataggaaatctgcagtgatttaccctctaaattcagttgcaatctcttgccgtgctatgtgaacgttttgcaacctgcattgttctagttggtgac

SEQ ID NO: 3291 - DNA, 1098 bp, Oryza sativa
  Clone ID: PAT_MRT4530_53248C.1
atgcctcaggtcctccccggggggtcccttttatatcgcagtcttgtccgagtaagactcttcccatccgtagacttcgtgaaggatttccttagtgtacgcgggaagtatccatatgcgcgtggtgaaaaaaatctctcaaaggccaaacgccaagtccctactcccatagtcccatggccgcgccgcaggccaaatttggcggcgcctgcaggtcaaaattttgagctggccgcctctcagaccacgaaaattcccactatcccgccaaatcaccgatccgcgcctcacgccacgtcaacgatccgctcctccccccgcgatccagatcctcaccgtccattccctcccccatccaacggcagccgcctccccactccatcctctcgtccccttttaaaaccccctcccctttcttccccaaatcccactccaatcaccaccacctcttctccaattccactcgcttttctctctctctcgtgcgtcgagccaccggaatcgtcgtcgtcggcggccatgtcggggcgcggcaagggaggcaaggggctcggcaagggcggcgccaagcgtcaccggaaggtgctccgcgacaacatccaggggatcaccaagccggcgatccggaggctggcaaggaggggcggcgtgaagcgcatctccgggctgatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgattccttccttccttccttcctggtggcgtgcgggtggtggtggtggtgtaggagctagggtttcgatgggattcggggggaatttctgctttgtgttggcttctgtgtagcgactcttctgtttaaatgaattcgatgaatctgaactgaagatttggttcccctgtgattccgtcattttatatttctgtttcctgtgatgtgaatttgtgcgaagttcgtgaaactgcctttcggatgaaaaaaaaaaaaaaaaaatatgcggcc

SEQ ID NO: 3292 - DNA, 1268 bp, Oryza sativa
  Clone ID: PAT_MRT4530_53359C.1
ctaggcgaaaaatggcttgagccttgtgtttgtggtgccattcatggcgtgatggcctttggccgcccataagttagcaccattacaaactccttggcaggggagcctatcatggtctgtgttgtctgtgttgatcgccccctcaaccacacctctactaaattgcacaggggttgtgtagggttcactggctgcccgcagcaatttatttcgaccttgatgtaattgactgagttcaataaaagtttccattatctctgcctcgttaggaaggccaagcttctgcatgaggtacttctggattgacgaggcaggtatgtttccatcttttattcgcaaataatgggaaggtatctgtggtaaaggtgggtctccttcctgttcaaatgatgcaacaagtgaaaaccatatagaactgaatttcttttcgttttgtgtagctgcagcttcaggcttactatcagattgggcatgaagttctctcctccgtccagtcctttggtttttcctttttagcaaaggtacatctttcttatcatcctctattttggatttctgcatatattccctagactttgttttgttaacagatgtgctcccaggagagtcactaagttgctctctcttaacaaatggactctgtgaacttgatcgggaggactttgtcctgtttgcagcttctaccaaacaatttaaaggtctccagagctcatcagtcttatcggccaggtccttgcgatcaccttcggtatctttattggaggaatggttcgatgcctctgcgtttgatgacatctgtcttcttgtttgtggcactttgcccaaattagtgggcaagcttgaattctgagcatgcttttcaccattatcaatttcctttttcacaggatcatcaataccaggaccaaggccacgcaaggcagcagctttcctggtaactgctcttgtccgtcgccctgtcaagcctgtcggtgttactgtaggcgtatcaactaccagagaagagatagatctctctttccttttactgggaagtaaaacaggagctgctacttcgtcagcactaatcttctttcttttgaatggaaatatttttgaccttacatcttgtagattgtgatcagccctaagcttttcaactggagtgcagccaagatcaattttacatactgggcaggattctacctcctcatcattcaacttctcatatatacactttctgcaaaaggtgtggaggcactcggagacggtggtggcgtcgcggagga

SEQ ID NO: 3293 - DNA, 2442 bp, Oryza sativa
  Clone ID: PAT_MRT4530_53617C.1
atggcgtgctcgtttctctgcaagccatggctgccattaacggagagcgcgaagcccgctcgctcgccggcgccgtcttcccgcgcaagaacggtggtgcagcagctcgccgtcctcttactactgctcggcggcgtcggcggcggcggtggcgcgctgcttgccgcggccgcgtcgacgacggacaccatcctccccggcgagagcatcaccgggaaccagacgctcgtgtccaagaacggtgagttcgagctcgggttcttcaacccgggcgtcgggatccactacttcctcggcgtccgcctcaggaagctcgcggcgtacagccccacgttctggattggcgacagggtctacgtcgtcgacctgcctcgcgccgcgctggagctcttcggcgacagcctctacatcaaggaggacggtgccagcctctggtggtcgtcgccgtcgtcctcctcctcctcctcgggcggcggccgcggcggcggcgcggccgtcgccgtcctcctcgacaccggcgacctcgtggtgagggaccagaggaactcctccctggtgctgtggcggagcttcgactaccccggcgacgcgctgctgccgggcgggaggctggggctcgacgtcgccaccggggagaacgtgtcgctcacgttcgaggggttcacccacaacggcagcctccgggccgacgcgagcaggaggaacgggttcgtgctcaccaccgacggccgcgacacccgcggcgcgttcccggactggatggtgaccacccaagacaacggcggctcgctggtgctcaaccacccggacgccacgaactccaccgagttcctgcagctcaaagtcgggcaggtcagcctggtccggtggtcgggcgccgacgccggctgggtgcctcgctggacgttcccctccggctgcaagtccggcggcggcttcttctgcggcgacttcggcgtctgcacgacggcgaccggcggcgaatgccggtgcgtcgacgggttcgcgccgtcggacacgaaggagtgggggctcggttacttcgtcaccggctgctcgaggtctctcccactcagctgcgacgccaacggccagaccgagcacggcgactccttcgccattcttgacaatctccaaggcctcccttacaacgcgcaggatgagccagcgaccaccgatgaagattgcagggaagcttgcctgaacaaatgctactgcgttgcatactcaactgaaactggatgcaagctctggtattacgacctgtacaatctgagctcagctgataaacctccatacagcaagatctatgtccgattgggttccaagctcaagagcaagaggggattggccacaagatggatggtgctcttggttgttggatcagtagctgtagcttctgcaatgttggcagtgttgcttctatgcaggtacaggagagacctgtttggatccagtaagtttgtagtagaaggatctctggttgtctactcatatgcacagatcaagaaggcaacggagaatttctccgataagctcggcgaaggcggattcggaagcgttttcagaggtacattgcctggatcaaccactgttgttgctgtcaagaatctcaaagggctcggctacgcagagaaacagttcagagcagaagtgcagacggttggaatgatccggcacactaatcttgtccgtctcttgggattttgtgtcaaagggaacagaaagttgctggtctacgagtatatgccaaatggatccttggatgctcatatcttttcacaaaagtccagtcctttgagttggcaagttcgataccaaatcgcgatcggcatcgcaaggggtctagcatatctacacgaagagtgtgagcactgcatcatacactgcgacattaaacccgaaaacatactactcgacgaggaattccgccccaagatcgcggatttcggcatggcaaagcttcttggacgagaattcaacgcggcacttaccaccatccgaggtaccaggggctatctcgcgccagagtggctgtatgggcagccgattaccaagaaggcagacgtgtacagcttcggcatcgtgctgttcgagatgatctcagggataaggagtactgtcacgatgaaattcgggagccatcggtattaccccagctacgcggctgcgcaaatgcatgaaggagatgttctgtgcttgctggacagtaggctggaaggaaatgccaatgtggaggagctcgacatcacctgcagagtcgcctgctggtgcatccaggacagagagggtgacaggccatcgatggggcacgtcgttcgcatgttggaaggtgttgtggacacggagatgcccccaattccagcttcgtttcagaaccttgtggatggtgatgacagtgatatatacgaagaaaactggcgtttgaggacccaagattag

SEQ ID NO: 3294 - DNA, 1913 bp, Oryza sativa
  Clone ID: PAT_MRT4530_53892C.1
ggacaagactccagccgccggagagccagtgtctgcttgtgtgagagagagcgacgcggcgccgacgcccgatgcgtttctgtttccgagcgggtcgggcccgcgctcgcgcccgctggcctggaccgcctcctcgctcccctcctgtcgttgcagcgcgggtcggtcgggggcgaagtagttgttgagggggatgatgatgacgagcggtcgcccgagcggcggcgccggcggaggtcggtacccggttcacggcgtggcagtggcaggagcgggagcgccaggcgctcatctacaagtacatggcgtcggggactcccatcccctccgacctcaccctctcccctccgccgcagcttcctcctcgactccgccctcgccacctccccttccctcgctttccctccccaaccttcactggggtggggttgctttggcatggggtttgggcggaaggcggaggacccggagccagggcgatgccggcgtacggacggcaagaagtggcggtgctccaaggaggcgtacccggactccaagtactgcgagaagcacatgcaccgtggcaagaaccgttcaagaaagcctgtggaaatgtccttggccacgccgccgccgccgtcctcctccgccacctccgccgcgtcgaacacctccgccggcgtcgcccccaccaccaccaccacctcctccccggcgccctcctacagccgcccggcgccgcacgacgcggcgccgtaccaggcgctctacggcgggccctacgccgcggccaccgcgcgcacccccgccgccgcggcgtaccacgcgcaggtgagcccgttccacctccagctcgacaccacccacccgcacccgccgccgtcctactactccatggaccacaaggagtacgcgtacgggcacgccaccaaggaggtgcacggcgagcacgccttcttctccgatggcaccgagagggagcaccaccacgccgccgccgggcacggccagtggcagttcaagcagctcggcatggagcccaagcagagcaccacgcctctcttcccgggcgccggctacggccacaccgcggcgtcgccgtacgccattgatctttcaaaagaggacgacgatgagaaagagaggcggcaacagcagcagcagcagcagcagcagcactgcttcctcctgggcgccgacctccgtctggagaagccggcgggccacgaccacgcggcggcggcgcagaaacctctccgccacttcttcgacgagtggccgcatgagaagaacagcaagggctcctggatggggctcgaaggcgagacgcagctgtccatgtccatccccatggccgccaacgacctcccgatcaccaccacctcccgctaccacaatgatgattaatctcttgaagaagccaagaagtgatcaacacgcggaagaaatcaacagcttctttcacggcgtgcgagctgcatgctcatgctccaggatcgatcgatcgatcattgcatctccaaactaatcacgcttcgatctttcaggacttcatcaatgacaggccgaaacctcctacgagttctctgatgatattcttattttttttcccacttcttttcgttgagctttttgtaatgttgcttcgagtgttactcctacattttctccgaaatggcctcagaatgatgcggtcgggctgattaattaggttagactcttcctgaaccaactaggaatagattttctgcctggttcctgtcagtccttgtaatatctgcagcagcttgtgagacaagcgtgttcgcttttgtgaacgccctttttcttctttccgattcctctgcctgtgatagtactcgctccgcgaaaaaaaaaaagagcaaaccgtggattcttgtgtcaaaaaaaaaaatcaaaaaaaaaaaaaa

SEQ ID NO: 3295 - DNA, 2742 bp, Oryza sativa
  Clone ID: PAT_MRT4530_53979C.1
ccgggctatgtggcatctgggcagcggcagctgcagcttctcctccccactgagcccttttgtcctcactcgcagggatcggagaggggtgaagatgtcgggtgctgctctcgtcgcaatcgcggcctccatcggcaacctgctgcagggatgggacaatgccaccattgcaggtgctgtactatacataaagaaggaattcaagctagaaagtgagcccactgtggaggggctaatcgtggccatgtcactgattggtgcaaccatcatcacaacattctcagggccggtatcagactggatcggccggcgccctatgctcattctctcttcaattctctacttcctcagcagcctcatcatgctatggtccccgaatgtctatgtgttactgctcgcacgccttatagatggattcggcatcggcttggctgtcacacttgtacctttgtacatctcagagacagctccttcagagatcaggggtttgctgaatacactgccacagttcagtgggtcaggagggatgttcttgtcctactgcatggtgtttgggatgtcactgttgccgtcacctgactggagaattatgcttggtgttctcgcaatcccttcgttgtttttcttcggattgacaatattctatctgccagaatcaccaagatggcttgtcagcaaagggcggatggctgaggcaaagaaggtattacaaaaattacgtgggagagaggatgtctcaggagaaatggctcttcttgttgaaggtttggaggttggagctgacacttccattgaagagtacatcatcggaccggctatagagccagctgatgagcatgttgttgatggcgataaggaccaaataacactgtacgggcctgaagagggccaatcatggattgctcgaccttccaagggacccagcattcttggaagtgtgctttctcttacatctcgtcatggcagcatggtgaaccagagcgtgccacttatggatcctatagtcacgcttttcggcagtgtccatgagaacatgcctcatgctggaggaagcatgcggagtacattgtttcccaactttggtagtatgtttagtgtgacagatcagcaccccaaggttgatcaatgggatgaggagaaccttcatagggatgatgaggaatacgcgtctgatggtgctggaggtgactatgaagacaatgtccacagcccgttgctgtcccgacagaccacgagcgcagaagggaaggacattgcacaccatgctcatcgtggaagtgctctgagtatgagaagaagaagcctcttggaagagggtggcgaggcggtgagcagcactggcattggtgggggatggcagcttgcatggaaatggtcagagcgagaaggcgaggatggtaagaaggaaggaggatttaaaaggatctacttgcaccaagaggaagtgccaggatcaagaaggggctcagttatttcacttcctggtggaggggacgctcctgaaggcagcgaattcatacatgctgccgctttggtaagccaaccagcactttactccaaggatatcattgaacagcgtatgtccggtccagccatgattcatccatcagaggcagctgccaaaggttcaagctggaaagatttgtttgaacctggagtgaggcgtgcgttgttagtcggtgttggaattcaaatccttcaacagtttgctggaataaatggggttctctattacactccacaaatacttgagcaagcgggggtggcagttctcctttccaatcttggcctcagttcagcatcagcttccatcttgatcagttctctgaccaccctactgatgcttcctagcattggtttagccatgagacttatggacatctctggaagaaggtttctgcttctgggcacaattccagtcttgatagcatctctagttgtcttggttgtgtccaatgttatcgacctgggtacagtggcccacgccgcactctccacaatcagcgtcatcatctacttctgctgcttcgtcatgggattcggtccgatccccaacattctgtgtgcggagatcttccccactagggtccgcggcatctgcattgccatctgcgccctgacattctggattggtgatatcatagtcacctacagcctccctgtgatgctgaatgccatcggcctagcaggtgtctttggtatatacgcagttgtttgctcgattgccttcgtgttcgtcttcctcaaggtccccgagacgaagggcatgccgctcgaagtcatcaccgagttcttcgctgttggtgcaaagcaaatgcaggctacaaaggcctaattcttcagcaactctgctttcaatctttatataacactgtaaattggaatctgcaagatcacaccatgaggctggaggagctttttgagttgtaaatgagagaagaggattgctattcatgctccttatgcaagggaaaagagttcattactggcacagggcagctgtaaagtaggaaattttcatgttattcatgtccacttcttgtttatttagtactgtgttaggtaatgttgttattcatcagtagttgctgctagggatgttcaaaaataagcttgctaatctgattttgagctactatgttggggttcataataaagtaaattttctgtgtcacaaaaaaaaaagtagcactttgttgtaaattgtatggggaagttaatttattaatgttcccgctcttt

SEQ ID NO: 3296 - DNA, 1832 bp, Oryza sativa
  Clone ID: PAT_MRT4530_54020C.1
acgcccacgcgtcacggccacgcggtgcgcccacgcgtcgcggcactgttcccgcgtccgccttcccttcctcctccacctccacctcctcgtcgcgatccaaatccgaatccggccatggacgccggggcgcagccgccggacacggagatggcggaggccggcggcgggcagcagccgcctgctgcggctgcggcggcgggggcgggggcaggggcggggatgatggagaacatccaggcgacgctgagccatggcgggaggttcatccagtacaacatcttcgggaacgtgttcgaggtcaccgccaagtacaagccccccatcctccccatcggcaagggcgcctacggcatcgtctgctcggcgctcaactcggagacgggggagcaggtggcgatcaagaagatcgccaacgcgttcgacaacaagatcgacgccaagcgcacgctcagggagatcaagctgctccgccacatggaccacgagaatattgttgccataagggatatcatacctcctccacaaaggaattcattcaatgacgtttatattgcatatgaattgatggatactgatctgcatcaaattattcgctcaaatcaagcattgtcagaggagcactgccagtatttcctttatcagattctccgtggcttgaagtatatacattcagcaaatgtccttcaccgagacttgaagcccagcaacctacttttgaatgcaaattgtgacctcaaaatttgtgattttggacttgctcgtaccacctcagaaaccgattttatgactgagtatgttgtcacaagatggtatagggcaccggaacttctgttgaattcctctgaatatactgcagcaattgatgtgtggtccgtgggctgtatttttatggaactcatggatcgtaaacctttgtttcctggaagagatcatgtccatcaattacgtctactaatggagctcatcggaacgccaaatgaggctgatctggattttgtaaatgaaaatgcaagaagatacattcgccaacttcctagacatgcaaggcagtcctttcctgaaaaatttccacatgttcatcctttagcaattgatctggttgaaaagatgctgacatttgatcctagacagagaataacagttgaaggtgcccttgcacatccttacctggcatcactgcatgacataagtgatgagccagtctgctcatcacccttcagctttgacttcgagcagcatgcattgtccgaggaacaaatgaaggatctaatctaccaagaaggccttgcgttcaaccctgattaccagtagctggtgttctatttcagccttggattgattctattcatatggagttttttcctcctgcgccacaaaaggtcgccgacagtgatcactagttgtaaataattgcctcacctgaaaaatcctccctggttcaaagctgaaggtgttgttctaagagtagaaatgtactttgtgatcaagttcctgggtagctgctatgccattcttatgcttatgtatgttgtttaatgtgggatttttttccatcttaaatgtttttagtcccttttgtaagaagagttagttcatgaacgatgacggcctaaattctgcggttatcatcaaattccccattttcttgtcaaaaaaaaaaaaaaaaaaaaaaaaaaaaaaaaaaaaaaaaaaaggaagaaaaaaataaaaaaaaaaaaataaaaagaaaatcaaaggaaaaaaactaaactataaaaaaattgtaaaataaatgaaaaatcttttacagaaaatttttaaaaactgttacctgagagggggggtgtttt

SEQ ID NO: 3297 - DNA, 1939 bp, Oryza sativa
  Clone ID: PAT_MRT4530_54118C.1
cagaaactatagaggaagaagaagtcccggttagtccaccggcaaaaccggatactgcaaagccagatgctgcggagatagaagctagtgatagggggatcattggttgggggcgaacaacgagacgttgtcgcagaccgaggtgtccatcaggctacaacatttctgccgcatcttgaaaagatgccgacagaaaacatcggactatatttggatttgtagtagagatcttgatggagtggtataagaaggtaagtatagccatgagtgcacatacctcgttggcctatttgggctcccaactttcatgctttggggttgagacatggtgtacatttttaataagaaattcttaaattagttcataagatatttctgcccccccattgtattaagctgttcccatgatgggagcaaaggtagaaggtgacaattacatgcttggatattatgccatgggggatttcaacatggatgcaaatgagacgcctgatgatatgctgcagtggtttgcagatcttgctttatcaagcactgatgaccacgttgagcaagcagaagcccatgattgcgtgaataattccagtgatgatggtctggattcatttgaatcgttgacactgaagctggaagagaccaagattgatgagtactggagcaggccacaggctcctgaaataccaaatgatgaacaagcaggattatcagtgaaccttctcactaagccaaaacgaggccagcaaaggaggaggcggcagaagcgcgattttcagaaagatatcttgcctggccttacatcacttgcgagacctgaaatcatagaggacattcagttacttgagggcatcggcggtgaatcgatgggatggcggcggcgggagggcggcggcgccgtcgccggcgcggcctcgaggcttcggttcgcgccgtcctccaaccacctgctcgtctcctcgtgggattcggggctgaggctgtacgacgcagacgcgtgcgagctccaaccccgatcgattttatccccccgccgggcaccctagtcgccggatcgcgtctctcccatcctctcgcgcatcctcctccgactacctcggttgggttttgggggcggctggagatgtcggactccgaggagcaccacttcgagtcgaaggccgacgccggcgcgtccaagacctacccgcagcaggctggtactattcgcaagaacggtcatattgtcatcaagaaccgcccatgcaaggttgttgaggtctccacctccaagactgggaagcatggacatgcaaaatgccactttgtggccattgacatcttcaatgggaagaagcttgaagatattgtgccctcctcccacaactgtgacgtcccccacgtgaaccgtactgattatcagctgattgacatttctgaagatggatttgtcagcctcctgactgaaagtggaggcactaaggatgacctgaggctccctagtgatgaggctctgcttactcagatcaaggatggattcgccgaggggaaggatctgattgttaccgtgatgtctgccatgggtgaggagcagatctgcgctctgaaggatattggccccaagaactagaataccttgttaccgtgtttggctacctgtctggtcgctttaagtttggagctggtcttgagattatatataaacttttgatttgagcgtaagttaagaagacatatgggccgttgttccatcttgcggtttataccgaatgatttggatgtacctttgctatatgtaatgctattttgaaccagtagttttacagtctttatggttatttatatacaatgttctttgggttatatgcaaaatttcttgtaatccaaactaaaaaaaaaaaaaaaattttatgagtgctctttgacttaaaaaaaaaaaaaaagccgcaaaaaataaaaaaacaca

SEQ ID NO: 3298 - DNA, 1977 bp, Oryza sativa
  Clone ID: PAT_MRT4530_54608C.1
atgctgcatctagcgtctatatctgcgcagcctaacccttggtgcaaaaaacaatgtggtgatgtcaaaatcccttatccgtttggcattggcactggatgtgctattggtgaaggctttgagatcatttgcaacaggaatgctgatggaattgaccagccattcaccggtaacatcgaagttctagacatctcagtggtttacggtcgaagccgagtattaggctccatcaccacaaactgctacaactccagtacaggatcagcgaatgtcaattcctggtggatggatttatcaacatcgccataccgtttctctgatgcgtacaacacgtttgtagtcattgggtgcaatacgctcgcatatatctacaacggactgaacagaacatcatatacaactgcatgtgcatcagtgtgcggaggaccagaagacctgacaaatggttcatgcctcggagtgggctgctgccaaaatgccaatgccatacccaagggtttaactcgccaagatatctatttgtatactatttacaatacttcagaatcagatagttggaagttcaacccatgcagctatgctgcactggtagaaacagagtcatttagtttcagcacagagtacataactaccatgaggttcaatgatacctatgaggggcagcagccgctagtgctggactgggcaataggagatgtgtcttgcgaggtggcgaaaaacatgacttcatatgcatgccatagtgggaatagtatctgtattggctctgttgctctagtgatcaccattttcttcatgcgtttgatgtttgagcgaagaaagcttacagatgtcaagaaaaaatattttcagcaacacggaggactgatattatttgataagatgaaatcggatcagggacttgcatttaaggtgttcactcaagccgaactagaacatgcaacaaataagtttgagaaaagccagattcttggacatggaggacatggcaccgtgtacaagggtataacaaaggataacattacagtggcagttaaaaaatgtgcattgattgatgataggcataagaaggaatttggtaaagaaatgttaatcctttcacagatcaaccacaagaacattgttaagctgctgggttgctgccttgaggtggatatcccaatgctagtgtatgagttcatcccaaatggaacattatttgatcttattcatggcaagaaccgtacgtttcatatcccttttagttctctcctaagaatcgtcaatgaagcagctgaagggcttgcatttttacattcctatgcaaacccaccaattttgcatggcgatgtgaaaacctctaacatccttcttgatgagaactacatggcaaaggtgtcagattttggagcctccatattagcactaagtgatgaagaccaatttgtgacaatggttcaagggacatgtggctatctagatccggaatatctgcaaacatgccgattgacagacaagagcgatgtttacagctttggtgtggtccttttggaggtcatgactgggcagatgccattgaaatttgaaggtcctgagattcagaaaagcttgtcatcaagtttcctactggcaatgaaggagaataatcttgaggccatgttggacagtcaaattaaagatcatgagagcatggaactgctaagtgggcttgcagacatagctaagaaatgcttagacatgtgcagtgacaataggccatcaatgaaagaggtatctgaggagcttagcagactacgaaaattttcaaaacacccttggatacaacgtgatactgagatagagagctttctcagtggaccatcaactagtaacctagaaactgagcacagctatctcagtggaccatcaaccagtaactttgaaatcgagcacaacaccgagtatagaaggaaggatgaagaaatgcccataaacccaagcacttcatactttatccgg

SEQ ID NO: 3299 - DNA, 1337 bp, Oryza sativa
  Clone ID: PAT_MRT4530_54679C.1
agaacacggctggttgtttgcccgtagtgcttttcctttcaggcaagttaataacttattccaccttcggcgtctatcagtttttgaactgcttgctactgaggttactgttcttttgatggacacaaaccactgttcttgtagatattagagagcacacagaagacggaataatatatgtccaaagtgcttttaaatagtgaagctatgtcatctccatataattccccatgaaatattgatagggtatatgtagacatgaaggaagtgttcgtatggctggatcatcactagaattctgttatttgaccctgatacttactatgaggccatgctgatgaagaacatagcaatcttacttgctcttcttagaagcctcgtataggtagctcacgataactacagctgcagcaacagctaccccgacagcactctgtgcgagtacagcaccagttgaaagatcagatttcgtagatgcagggccgctgctccgtggagtgaagccaagttcagaaagcttcttgtgcgattcagcgtagtccttgaagaaggtgtcttcatccctggcataaagatccacatagcgtctaaatgaaggatcttccaacaatgccttgtcagttgggagcttcagaagcccctcagattcccccttcagtagctcaagaaagtacgaattgtcaaacttcagaggctcctgagtccatgcgccttcaaatccagacctttcaggatgtgcccttcccagagtgtgacccccagataaagctactatatctttgtctgataagcccatccggtaaaagatgtccctcaagtgcagtgcacctttcttagcatcaggaagacgcccttcacgggggcaaactgacgaatcacgtcttccaggaatgaactcaacagttggacccccagtaacttcaactgcaacaactccagcaagctgataaaggtcagcatatgtgatcttagggctcttggctttaataggctcgagaagatcaatagcaatctttagaccagcatttgaaccgtgagtgtactcttcctcgtatctaattgaaccatttgcaccaccagtttttgtgttcacgtcataagtgcccgcgtcatgccatgcgaggcggagcatgatgggcgcgcatcccttggaggagatgagggcgcggaggtggcggcgcgccctgtcgacctggcggaggtactcggcgtccacgaccggggcggccatggcgtggcgtcgcgtcgccggcgaggttggaagccctagagagatcggccgcggcggcggagcggagcggaggcgtgcggcgtcaagccaagcgtgtggtgtgact

SEQ ID NO: 3300 - DNA, 1248 bp, Oryza sativa
  Clone ID: PAT_MRT4530_54995C.1
acgcgccgcgaggcacgcaaccgagtcgagactagacaaggggagcagccgccgcgatccaagtcctcctccgccgccgccgacgccgccatggatccgaagctggtggaggtgacgcagctcttctcccgcttcaaggcagccttcgccaggaacgacttcgacacctgcgtagacctgctgtcgcagctcaaggtccgcctcaccaagttccccagccttcctccatcatttcagcagacaccgaatgcagtggaagagctgaaaattgcgagggacatctatgagcatgcagttgttctgagtgtgaaaattgaagaccaagatgcatttgaaagggacttttgtcaactcaaaccttattacatggatacatgcggcataattccaccatcaccacaggagtatccaatcttgggtcttaatcttctaaggctgttagttcagaacagaattgcagagttccacactgagctggaacttctgccggtcacagcacttgaaaatccttgcatcaagcatgcggtggagcttgagcagtcatttatggagggtgcttacaaccgagtgttgagcgctcgccaggctgtgccccacgaaacatatgtgtacttcatggatcttcttgccaaaacagtcagagatgaactggctggttgcagtgagaagggttatgattatatgtcaatagctgaagcaagacaagtgctgatgttcagctctgacaaagaattgcaccagtacatcgcagaggagcaccctgaatgggaggtaaaggatggttccgtcttcttccagaaggcgaaggagacccagccctgcaaggagataccatctttgcaggttatcaaccaaacgctcagctatgctagagagctggagcggattgtatgatttgttaatgaatatcatttgagatcatttgggacggcatgttcatgctatgtacacatcaggtgtcacggttgagatgcgcatgttgcagctttgaacgtttgagatgcccatgttaccttatgatactttttttaaaaatttcatttaatgggctaaaaaaaaaaaaaaaaaaaagctgaacagtaactctgatcgtgttttgatatgtcagttcgtgatcaatttactttgctgaatagctgtcctgaaaatgttcagtattagtcgtgaattgcaactgcaaactgttgggcttatgatgatgaaatgagatcgtacttattttgatgatcaaaaaataaaaaaaaaaaa

SEQ ID NO: 3301 - DNA, 4499 bp, Oryza sativa
  Clone ID: PAT_MRT4530_55252C.1
ggaaaaatggggtgcccatgcggccctgcccaatagcgttgctgtacctttcagctttataatctcgcccctcgcgagagagactccccccatcctgcagactcgccccactctcttgctcagctcctcctcttcatccagtcctcaaaactctctctgatctctctctcttgctgaaaattctccgcacactccggtgggcttaagcggtggcggcgtctcgcctgggtgggcgagatccctctcttgctcgtccgcaaggtcgctccccctgcgagtccaatctactgacgagctgggaggagcaaaggagggggcaattggagctccgctcggttccaattcagccccaattttgagccccccggctgcggggttcggccagttgagacgccatgtatcgggtgaagagcgagagcgactgcgagatgatccatcaggagcagatggactcgccggtggccgacgacggcagcagcggggggtcgccgcaccgcggcggcgggcccccgctgaagaaggggccatggacgtcggcggaggacgccatcctggtggactacgtgaagaagcacggcgaggggaactggaacgcggtgcagaagaacaccgggctgttccggtgcggcaagagctgccgcctccggtgggcgaaccacctgaggcccaacctcaagaagggggccttcaccgccgaggaggagaggctcatcatccagctccactccaagatggggaacaagtgggctcggatggccgctcatttgccagggcgcactgataatgaaataaagaattactggaatactcgaataaagagatgccagcgagctggcctacccatctatcctaccagcgtatgcaatcaatcctcaaatgaagatcagcagtgctccagtgattttgactgtggcgagaatttgtcaaacgatcttctgaatgcaaatggtctttacctaccagattttacctgtgacaatttcattgctaattcagaggctttaccttatgcaccacatctttcagccgtttctataagcaatctccttggccagagctttgcatcaaaaagctgtagcttcatggatcaggtaaaccagacagggatgctaaaacagtctgatggtgtgcttcctggattgagcgataccatcaacggtgtgatttcctcggtggatcaattctcaaatgactctgagaagctcaagcaggctgtgggttttgactatctccatgaagccaactctaccagcaagattattgcacctttcgggggtgcacttaatggcagccatgcctttttaaatggcaatttctctgcttctaggcccacaagtggtcctttgaagatggagctcccttcactccaagatactgaatctgatccaaacagctggctcaagtacactgtagctcctgcgttgcagcctactgagttagttgatccctacctgcagtctccagcagcaaccccttcagtgaaatcagagtgcgcgtcgccaaggaatagtggccttttggaagagttgattcatgaagctcagaccctaagatccgggaagaaccaacagacatctgtgataagttctagttcttctgtcggtacgccatgtaatactacggttcttagcccagagtttgatatgtgtcaggaatactgggaagaacaacatcctggtccattcctcaatgactgtgctcctttcagtggcaattcattcactgaatccacccctcctgttagcgctgcatcgcctgacatctttcagctctccaaagtttccccagcacaaagcacttcaatgggatctggagagcaagtaatggggcctaaatatgaacctggggacacttcacctcatcctgaaaacttcaggccagatgcattgttttctgggaatacagctgatccatcagttttcaacaatgccatagcaatgcttctgggcaatgacttgagtatcgattgcagacctgttcttggcgacggtatcatgttcaattcttcctcgtggagcaacatgccacacgcctgtgaaatcctgcaaacctgtgtcaccagcggcagcgatgacgcaaggatcggccaggtgtcaggccatacagagataggagttgtgatactgcaacaggctgagagttcttctcctgatgcttccatgactgacattgcacctattcttgatgagattgacccgctcttgggtgcaagctctactcatcctgatacaattccaaaggatgattcggacactgattcacatgtttcctcacaggatcatcaaactgatgatgatagtaatgatgaaactgacaataatgatgctaaagagaatggtgaggaaaagaataaagaacaaggaaaggaagctgcatttatttggacagcagatgatgaaaaaaatctgatggatcttggatattctgagatggaaagaaaccgcaggttggagcttttgatggccagacgaagatccaggaagaacataagaagaagcggcaattctggctcagcaccctcagttctgcatacaaggaaaaacccattcgatcttcctcttgatcagtccaatgatggtgatgtttctgcagataataatgaggaccacaaggacctcgatgaaaaagatttgcccaatgagcatgggtctccagctctgcagagacaggatagcgaccttgcggatgttggaagtgaatgctcggatggcatcaactccgtggatgttgaattagacaacagtgacattgatgatcgtgagattgctctacaacactttgtctttgaaagatcacaggaaagagaagcatatctttcctcaacaaaaggaaagggtcctgaagatgattacctgctcagttcagttgggaactccaagacacttcatccagtagctgacctgtttagctgggaagatggaaatggtgaaagcagccttggtgttaactcttcccataacatgtcagttgaattctcggactgggtttcatcccccaagccaattgcagagcatgattcaggaccagagaaccttcaggagtttcttaatactgaagttgcatcaagttcaaagacaattgttctaggcgcaagaaatccagctgaaaataatggaaatgttgattccatatcctattcaaacaatgaaatgccttcagataacttgggtcatgggtccatggagttcccatctgaattttgtaatgaatcactgccagtaatatctagggacttgcaccctatccctgaagagagggttgtcgagaacttcaatgtgcaagaaaagcatgaagcagaagaaacagctgcaggatatccacttgattctgatgatgatgctgataaaatctatcctgagcccatggaggacaatgtaattgatgaaagtttcctatcagaactggatgcggtaggagatttccgggtagaagcaacaagatcggaccagcagatgcctgatgttgactcccatattgataataacacttccaatggtgttgcagagagctccttgattagccctcagatttcaagtaacatattttcaaatatgaaatatgccagtatgctcgaacatgaggagaattctccattggttgatgacctaaatggcaccggtcctgaatttggttggtcattaggagcatcttatgatgaccctgagcagactgtctacaatccgaggcgacggattcttggagcaagtcgttttgaagaaactaacacagagatgaagccactatttgatgagacagaagcatcttttgtcaatgcaccaatagaagcaaacttggtagttggaccaagtaaagtggatgttgctaatgagtctgagttaactaaaactgatacaaacatgatcgttcttgatgccaattctctggaggatatagagacggcctttaaacaagcaagcaatggcgttgttgagtccaccgtggacaatgaaaccccacaggagcacacaactgctgctatgaacagttccttcgaagaaaacgaagacaagcatggatgcggtgatactgtaaaattcaccatgcatgatgagcttccagaaggaacacatattgaaggtaacacagttggagatggtaaagagcctgaaccaatggggattacaagcagcatggatgtcattgatgcaaaatccatcgatgacatatatgctgctttgaagaagcagtcaagtgctgctgcgaatagttccttcgaacaaaacgaaggcaagaacggatgtggtgatactgtaacattcaccacgcacgatgagcttccggaaggaacacacattgaagatagggataatacagttgaagatggtaaagagcctgaaccgattgggactacaagcagcatggacactattgaggtgaaaacaattgatgacatagacgcagtgttcaagaagctctctgatggcggtaccaagagtgctgcccaggcagtggattgcgagaatacttgtgaagcaagtgatgaaagtgaacagcactga

SEQ ID NO: 3302 - DNA, 1043 bp, Oryza sativa
  Clone ID: PAT_MRT4530_55374C.1
cggacgaggaggcaagagcatccgtattaaccagccttttgagacttgagagtgtgtgtgactcgatccagcgtagtttcagttcgtgtgttggtgagtgattccagccaagtttgcgatggcttctcagcaggaacgggctagctaccacgccggcgagaccaaggcccgcgccgaggagaagacggggcgcatgatgggcacggcgcaggagaaggcgcgggaggccaaggacacggcgtccgacgccgcggggcgcgcgatgggcaggggacacggcgccaaggaggcgaccaaggagaaggcgtacgagaccaaggacgcgaccaaggagaaggcgtacgaggcaaaggacgcggcctccgacgccaccggccgcgccatggacaagggccgcggcgccgcgggcgccacgagggacaaggcgtacgatgccaaggacagggcggctgacacggcgcagtccgccgccgaccgcgcccgcgacggcgccgggcagaccgggagctacattggacagaccgccgaggccgccaagcagaaagcggccggcgccgcgcagtacgccaaggagaccgcgatcgccggcaaggacaagaccggcgccgtgctccagcaggcaggggagcaggtgaagagcgtggcggtgggggcgaaggacgcggtgatgtacacgctcgggatgtcaggcgataacaagaacaacgccgctgccggcaaggacaccagcacctacaagcctggaactgggagtgactaccagtaatacggtataagaagcatgtgtcgtctttggcactgatgccaaagtgtacgtgttgtatcctcttttttaagtttcagctcgacttcgacgtgttcggtgtcacactttggtttttcagttgtgctcaactgttcatgtttctggttccatggagggccagtgtggaggtcaatgtttaagctttcgttttaaaatctgataataaagttggttaagacctgaaaaaaaaaaaaaaaaaaaaaaaaaaaaaaaaaaaaaaaaaaggacggcacagacc

SEQ ID NO: 3303 - DNA, 899 bp, Oryza sativa
  Clone ID: PAT_MRT4530_5542C.1
cggctatatcttctttagggaatcttgtttccatcagtctggagattcaaaaaggaaagtgaatcctacacattaccgggagccaaggttttacactaaggtgtttaaagagtgtcaagctcttgatcaagatgggaattcctttgaactctctgtacttacttgcaagtgtgttggagcttacgtgaaaagcaagaaaaatcaaaaccagatatgttggctatggcaaaaggttgattcaacagaagatcgggggtttcaaagatttttggacaatgtgcagtacaaagccagtggaatattacgctatgaacgcatctttggagaaggctttgtgagcactggtggaattgaaactacaaaagaatttgtggacaggctggatctcaaacctggccagaacgttcttgatgttggatgtggaattgggggcggtgatttttatatggctgacaagtatgatgttcatgttgttggtattgatctttcgataaacatggtttcttttgcacttgagcgtgctattgggcgtaagtgctcagttgagtttgaagtcgctgattgcaccaaaaagacatacccagacaacacgtttgacgtcatctacagtcgtgatactatccttcacatacaagataaaccctcactatttaaaagtttcttcaagtggctcaaacctgggggtaaggtcctaattagtgattactgcaagtgccctgggaaaccttcagaagagttcgcagcttacattaagcaaaggggttatgaccttcacgacgtcagggcttacggacagatgcttgagaatgctggtttccatgatgtcattggtgaagaccgcaccgatcagttcctcgagttctagagagggacctggtaaagttgaaagaccaaaacca

SEQ ID NO: 3304 - DNA, 1640 bp, Oryza sativa
  UNSURE (1)..(1640): unsure at all n locations
  Clone ID: PAT_MRT4530_55761C.1
  unsure (1)..(1640): unsure at all n locations
atggaggtggagtcgccgccgaggcctgcggaggaggagggggaggggtcgccgacgaggagggagatcgtgctggggaggaacgtgcacacggcgtcgttcgcggtgaaggagcccgacgcggacgacgaggagaccggggagcgggaggccgccatggccagcgtcctcgcgctctaccgccgcaacctcgtcgagcgcaccaagcaccaccttggttacccgtataacctggacttcgactatggtgcacttggccagctgcaacacttctccatcaacaaccttggtgatcccttcatcgagagcaactatggtgtacattccaggcagtttgaggtgggagtattggattggtttgctcgcatctgggagttggaaaagaatgagtactgggggtacattacaaactgtggcacagaaggaaacctgcatggtattcttgttgggagagaggtattccctgatggaatcctgtatgcttcccgtgagtctcactattcagtattcaaggcagcaaggatgtataggatggattgtgttaaggtggacacccttatttctggggaaatagattgtgaagattttcagagaaagttattgctaaacagagacaaacctgccattattaatgttaacattggaacaactgttaagggggctgtcgatgatcttgacttggttattaaaacacttgaagaaggtggctttaaagatcggttttatatccattgtgacggtgctctttttggactgatgataccatttgtcaagaaggcacctaaggtatcatttaagaagcctatcgggagtgtgagcgtttccgggcacaagtttgtaggatgtcccatgccatgtggtgtccagataacaagactggagcacataaatcgtctttctagcaatgttgaatatctggcatcaagagatgcgacgatcatgggaagtaggaacggccatgctccgatcttcctctggtacaccctgaacaggaaaggctacaggggcttccagaaggaggtccagaagtgcctgaggaacgctcactacctgaaggaccgcctcaaggaagctggaatcggcgccatgctcaacgagctgagcagcaccgtggtgttcgaaaggcccaaggacgaggagttcgtccggaggtggcagctcgcctgcgagggcaacatcgctcatgtcgtggtgatgcccagtgtgaccatcgacaagctggactacttcctgaacgagctgacggagaagcgggcgacctggtaccaggacggatcatgccagcctccctgcctcgccaaagacgtaggcgaggagaactgcctctgcagcatccacaagaagtgaagaggagcttatatattataacaaggagccatgttgcagtgtagctttgtgttgttgtcgtggcctgaagttagtactcctaatgcgttgtgttgtaccccgatgccttctgtatgtaataatgcgttatgcagtcagtgcagcttataatgttgttatcgtcaggatattacagttaagttaaaattgatgggatgaaaattgcatcatctttacctcttntgttntcaaaaaaaaaaaaaaaaaaaaaaaaaaaaaaaaaaaaaaaaaaaaaaaaaaaaaaaaaaaaaaaa

SEQ ID NO: 3305 - DNA, 281 bp, Oryza sativa
  Clone ID: PAT_MRT4530_56041C.1
ggggggggcgccaccaccaccttttccaccacaagaaggacgactagcctgccaccggagtatactcctacggggggggggtctacacgtctgagactgtgaccaccgaagtggtcgccggcgggcatgacgagtactagaggtacaagaagggggagaagcatcacatgcacaagcagcacctcggggagggcgggtccctcgccggctgggccttctccctgtatgagaagcacgatgcgaataatgacccggagaacgcgcacaggcacaagatcacg

SEQ ID NO: 3306 - DNA, 1610 bp, Oryza sativa
  Clone ID: PAT_MRT4530_56399C.1
gcacgacggaacaaagaaagaaaatggaaaaaagattcatctcttcctcctcgtcttgtccccttccctcgtcgaaaccctagctaggctcgccgccggcgacgcccgcctcgccgatgcgctcccccacctgaccgctccgcctcgctctcccgggtcgtcgttgcctcaccgctgtgcccgcccacccccacctgggcagcgggcgggatccagtcccagatcggcgccatgtccaaggccagggtctacaccgacgtcaacgtgctgcgccccaaggagtactgggactacgaggccctcaccgtccaatggggtgagcaggatgattatgaagttgtcaggaaagttgggagaggaaaatacagcgaggtctttgagggtattaatgtcaacaacaatgaaaaatgcattatcaaaattctcaagcctgtgaagaaaaagaagatcaaaagagagataaaaatacttcagaatctttgtggaggtccaaatatcgtgaaactgcttgatattgttagagatcagcactcaaaaacaccaagcttgatatttgaatatgtcaacaacacagatttcaaagtgctatacccaaccctgacagattatgacatccgttattatatctacgagctactgaaggctttagattactgccattcacaaggcatcatgcaccgcgatgtgaagcctcacaatgttatgatagatcacgagcttcgaaaactccgattaatagactggggccttgctgaattctaccaccctggcaaggaatataatgtccgtgttgcttcaaggtacttcaagggacctgagcttcttgttgacttgcaagattatgactactctttggacatgtggagtcttggttgcatgtttgctggaatgatcttccgcaaggagccatttttctatggtcatgacaaccatgatcaacttgttaagatcgcaaaggtacttgggacagacagcctgaattcatacttgaacaagtaccgtattgagcttgacccacagcttgaagccctcgttggaaggcacagcaggaaaccttggtcaaagtttattaatgctgacaaccaacatctagtatccccagaggccatcgatttccttgacaagcttcttcgctatgatcaccaggatagacttactgcacgtgaagctatggcacacccatactttctccaagtgagggctgcggagaacagtaggcctcgtgcacaatagacaaaagaacgggactattgctgactgtcgattagcagcagtcatggagctgcaccgtattagtgacttagtccagtcacttgtattgggagtttgagattcggtaatggttgaatcacctggcaagaggattctgggagagcatgtaacagctcatgtgtgcttaaccgcaaacgtggattgtgatttactcgtgctgtttgtatctttgtttctgacgattgattgaaacacattgttctcgttgagtataaatgtttttttttaatttgcgagttggtccgttttaagactgattgtaatgatcaattagctgtaccttaatggttttatgcaccttgacttcggacatcatcgctgaaccatttcaattccct

SEQ ID NO: 3307 - DNA, 391 bp, Oryza sativa
  UNSURE (1)..(391): unsure at all n locations
  Clone ID: PAT_MRT4530_5639C.1
  unsure (1)..(391): unsure at all n locations
ccttctaatattgatcagaaacaaatcangacattacagataattttggaggggggctcaagggggtgggggggtcnctnccnganggatttnttcagtatttctcaagccgattcccaaaggtggtaattaaagggtgcgggggcatgtccgagcattggaagggcgaagaagctttcagcaaatatttccttggaagctcggcgtagctgtgacctggaggaggggtgaagggcctgccctggctagtgtgtgcactaacactcttctagcaaaaatgtgtggacatgggatttggaccatatatcataggggaaagaaaggtcagcctgtacattggattccacagaattggggattacttataggaaatcaaatcttttacctgact

SEQ ID NO: 3308 - DNA, 2366 bp, Oryza sativa
  Clone ID: PAT_MRT4530_56655C.1
gatcccccgggctgcaggaatcggcacgagggagagagagaactagtctcgagtttttttttttttgtttgggcaccggaccccccgagagcgctctagtttccatttttttttttttttgggcacgatgaacagcgtccatattatccatagcgcagtgatatttcaccgctaaacattccaagaacaatagtacaatagcagtttgttggttacagcattgtcactcaaatctttcctggggttttgccagttgccaagatatagatgccattgttcatcttgatctgacaaagctactgtctcccccaggagtaggctcattttggcatagcaagaccgagaattttacagcatccaacggaatcagacgctgcctgagctaaatagagagaagacacaggtttgatacctttcttcagttattcgcacgccggtttggtgtcaaagctagtcaggcagatcgcaaatgcctggaacgccgagagcgggtacctataatccattgtgaatatatcctttccgattttcccaaattggaggatgaccttctcctgctctgccgcagggataccaagggaaggatcaactgaggcaacgagctggaagttcttgactgatgctactgtaacgcgccctcggaagttgaggcaccagcactgcagctgctcatgccagcggggagctttgttcttcagaacaagaggcacttcatttgtacagaccggtccagacaaatcagcgctgaggcttgtcgatgaaaattctatggctggttcctttcctttgctagttgataaggcgggaacttgttcgtcaagtgagtggatgatgccggtaggggttggggccttcccaccttcctgaatacacaatgccggtatagagtgcatggtgcattgcattctccttggtcctcgattacgtaggacagtgagctcatatgagaccgtagcaacattgtaattgcctagtggcaatcgcggtgatacttgcttgaaatgtcgtttgcttggtcggttgtttggcaacactacagcatcgcaaggaggctggctgtcaaagattgtaaactttgtgccaaggaagtttggtttcagtttaccaacataggtgctactggatagagagaagtcattggagaccagtgagatcacaaaagaagtcctggtcgcacgcctaatcttgcgtgctgcaagcaaaagcttgtcgttttctccatgtagagatgggctgagccccaggtagaggagataggtggaagtcgccctgtccctcctcacaaagcactgcactggatgctcacgaggccccggctgcttgagggagatggggaaggtgatcctgccgcactcctcgagcgtcttcaccacctccttggtgacctcgcgccacgagcggcagacggcggcgcacgccaccacctgccgccgcgccggccacgtcgcctcgctggcctccaccctctggatcacgtccagcagcagctccggcggcaggttcgcccaccgcccctgctgctgctgatgctcctgacgctgcagctgctgctgctgcggcggctgctgctgctccgaccacaggaccggccaagaatgccgcgagccgccgcgcccgccgccggcgcgcccgtcagcggctcgcctcgacatgctgccgatgccgtccctcatctccctcagctcccgcacaatgctcttcagagacatcgccgccgcttaatggctaagcacccttcgctatcaccgaaggaaccccctgctgctgctgctactactactactactactactactactactactactactactactccatggcaagatccgccattactgacgaatctactctaaaaaaaaaatggcaggagacacctcataaagtagtccgcatcactgccatatctaacccccaactaaacaaatgaactttctgaaaaggatttgaagcacggggggctaccacgaacacagcttgctccagagcccaaattttgggcggatttggggagagcgcaagcaaagatccgagtttccctcgcacggcagctcggatctgggggcaacaaggcaatgcagcaacggagcaccggaagaaaccaggcttcgcgctcgggtagcctcaagatccaaatttccccccaaccccgcagcttaaaaagatcaaatttcccgcctcaagaacggatcaaggagcttctcctcccccatttcatcacagctcccatgagattctcccaactcctttccccccaaccagctccagatcagagcaatcaccctcccttcttcttctctcactctccccttcctctctcagccaccctgcaagctaaagatttcttcacggcatccaactcctcg

SEQ ID NO: 3309 - DNA, 2569 bp, Oryza sativa
  UNSURE (1)..(2569): unsure at all n locations
  Clone ID: PAT_MRT4530_56936C.1
  unsure (1)..(2569): unsure at all n locations
cggcagtgcattagcgcgaagcagttttgctaaggaacgacaccatgcatacagcttttatgccttttgcatgagagatcaaacgtggaaagctttcctgactgcataacaagatggagtacggtgcagcaacgcgtggcgcgctcctcgcggccaccctgctcgccggcgcccggcgtagccggttgcccctctcaccgccgccgtcgccgccctctattcagattcagaatcgactttattcgatgtcgtcgcttccactaaaggctcgaggcgtgagaagatgcgaggcttctctagcaagtgactacacgaaggcatctgaggtagctgattttgattgggagaaccttggttttggaatcgtgcagaccgactacatgtatatcacaaaatgcggacaggacgggaatttttctgagggtgaaatgattccatttggacctatagcgctgaacccatcttctggagaaaatgcactgagaatgagaacaggtgcagaaagaatgtgcatgcctgcgcctagtgttgagcagtttgtggatgcagtaaagcagactgttttagcaaacaagagatgggtgcctcctaccggtaaaggttctttgtatattagaccgctactcatgggtagtggtgctgttcttggtcttgcacctgctcctgagtatacgttcattatatttgtctcgcctgtggggaactactttaaggaaggtttagctccaataaatttgatagttgaagataagtttcatcgtgcaacccctggtggaacccacgagcagcggccggggcttatcatcaatcggcgcctccctctctctcgctcaccgcctccttctcctcgcgatctatccaaacaaggggctcgctaagatcggcatgtcggactctgaggagcaccatttcgagtcgaaggccgacgctggggcgtccaagacctatccccagcaggccggaaccatccgcaagaatgggtatattgttatcaagaaccgcccctgcaaggtggtggaggtttctacctcgaagactggtaagcacggtcatgccaagtgtcactttgttgccatagatatattcaatggtaaaaagcttgaggatattgttccttcgtcccacaactgtgatgttccacatgtgaaccgcacagagtaccagctgattgacatatcagaggatggattcgtgagccttcttactgagagtggtaacactaaggatgatcttagactcccaactgatgacagtctcctgggtcagatcaagactggatttggtgaaggcaaggatcttgttgtgactgtcatgtccgccatgggggaggagcagatctgtgcgctgaaggacattggccccaagtaactccctcaagtggaaggcagaacagaggggcaactccctcaagtggaaggcagaacagaggggtaactccctcaagtggaaggcagaacagagggatccttatgtatcaaacctaaactaaaaaacaaagacatgtattgagaaggaatgctacaaaagacatccacccagcttgaagccgcagtaacaagtgcagtgattgctgggtgtggcattatctgattaccgctaccccatcatgacatttgggatcctgtattttccatggttttatttgtgccctctgtttggtatcaataattgatttggaacggtggaaaccatatactgaagctgaagattatcattgggtcatttcgtgcctatggatttttctctgaaaaaatcaaaaaaaaaccgatggcacagaagattgcaaaagaaaagggctattctgatgttctctacttggatgctgttcacaaaaagtatcttgaagaagtttcttcatgtaatatttttgttgtcaagggcaatgtcatttcaactccagcagtaaaaggaacaatattgccaggcatcacaaggaaaagtatcattgatgttgctctgagcaagggtttccaggtcgaggagcgacttgtgtcagtagatgagctgcttgaagctgatgaggttttctgcacaggaactgctgtcgtagtgtctcctgtgggtagtattacctatcaagggaaaagggtcgaatatgctggcaacaaaggagttggtgtcgtgtctcagcagctatatacttcattaacaagcctgcagatgggccaggcagaagattggctaggctggactgtgcaactgagttaggaagtaataaaatgttcatcaacatcaaaagatggacatgattatgatcatgtgtatccttcagttttgtagttttgttggtgtgacatcctgctgtatatgtatagacggcagtgcattagcgcgaagcagttttgctaaggaacgacaccatgcatccagcttttatgccttttgcatgagaaatcaaacgtggaaggctttcctgactgaaatatcgacaattataaaactattttgctatgttgattacaatatatatcctagataatctaaattaactgctttttttgggctccaaaaaaaagaaaaaaaaaaaaaaaaaaaaaannanaaaaaannnnaannnnaaaaanaaaaa

SEQ ID NO: 3310 - DNA, 2551 bp, Oryza sativa
  Clone ID: PAT_MRT4530_5736C.1
ctctttctgctgataagtagatggatggatcatgtgattgcattgagccgctctggcaggcggatgatctccttgtaaagtatcagtacatatctgacttctttattgcgctcgcttacttctcgatccctttggagctcatatatttcgttaagaagtcagcattcttcccttaccgatgggtgcttatacaattcggcgcattcattgttctttgtggggcaacccacctgataaatttgtggacttttgccatatataccaagactatagctgtggtactgacagtggcgaaagcagcgacagcggttgtttcgtgcatcacagctttgatgcttgtgcatataattcctgatttgttgaatgtgaagttgagagagagatttctgaaggataaggctgatgagcttgatagagagatggggattataagaacacaagaggagacaggaagacatgtccacatgctgacccatgagataagaagcacacttgacaggcacaccattctgcgaactacgctcgtcgagctgggaaggactcttgctttagcggagtgtgccctgtggatgccaacacgctctggatcggcccttcagctctctcatacgatatataacagcgcagcaattggatcagttgttcctatcaaccttcccattgtcagtaaggtttttaatagtaaccgtgtagtaaaaattccgcatacctccccgttagcttcgataacggctgacaaaagcaggtatgtgccaccagaggttgtggctatccgtgttccactgctgcaccttacgaatttccaaataaatgattggcctgagctatctgcaaaaagctttgcagtaatggttttgatgctccctccagacagtgcaagagaatggcggccgcatgaacgggagcttgttgaagtcgttgctgatcaggtagcggtcgcattgtctcatgctgccattttggaagagtccatgcgggcccgtgatctactaatggagcaaaacattgctcttgatgcagcacgtcgggaggcagaaatggctatttgtgcccgtaatgattttcttgctgtaatgaaccatgaaatgcggactcctatgcgagcaatcgtttctttgtcctctctccttttagaaacaaatcttagtgctgaacaacgcctaatggttgagactatactaaagagtagcgatcttctggcaactcttacgaatgatgttttggacgtttcaaagcttgagaatgggagtcttgagctggaaattgcaccttttaatttgcattccacctttacagatgtggttaatttgattaagccagtagcagcgtgcaagaggctctcggttatggtcactttggcaccagagttacctctacatgctattggtgatcaaaagcgattgatgcaaataatcctaaatgttgccgggaactccattaagttcacaaaggagggtcatgtttcgattacagcttctatggccagaccagatgctttgagaggtccacatgaacctgactaccatccagttgtctctgatggattcttttacctggctgttcaggtaaaagacacaggctgcggaatcagccctcaggatatgccccacacattcagaaagtttgcacaccctgaaaacgcaggcaaatggaacagtggcagtggattggggctggccctttccagaagatttgtcagtctaatggaaggtaacatctggctcgagagcgaaggcgtcgggaagggctgtaccgcgatgttctttgtgaaacttggcatgcctgagaaaccaaatgcaaacctccgaagaatggcgccgcaccctctacagccaaaccaaggagctggaggccctgatgccctcagtatatccataatggacagcaacccgagggttcctcgggttcgctaccaatcaagcgtatgagaagcaccgatgatgccatcgccatgccaaggcagagcatccgacccagttttgccatcacagtttacagctccatttgcagctctctttttgatgtatggatggtagatgttgttcttgtccatcagtggaggtaccttgggcatgctgggataagtttcattggcattcctgaatcttgatttcagttgtgagggtgattgggtggtcttaagtggtgacaattgggaaagctgatgtagtagtctgttgtctgcacgagtctgaagttactgggaagtgccaatttactgcaagtgacagtgaacatgaaggtctatggccatcttacatctctgataccctgagctatagaagagcttggacgaacgtgtttatttttcttacttttttttccctagattagggctacaacctggaagggatcgatctactagctgattgcagtatcatttgtactttttgttttttttttctgaaataagagtatcagtggtaattgtaagcgttactgcagtgctttataagcacaagcaaattatcatcaaatcaaattatagaaaaatctagtgaattaaaaagagctcaaaaaaaaaaaccaaaaaaaaaaaaaaatactgctc

SEQ ID NO: 3311 - DNA, 1518 bp, Oryza sativa
  Clone ID: PAT_MRT4530_57465C.1
tttttttttttttttagatgccaacatccaaggaaaccaaatgcttttatgttaagatgatataataagatgtcataggcttgggaagccctacaaaataccaccctgggagctgcacagctctccttatgcacgtagtacatatataaccgatgttatatacatggcagcttttagaacatatatgtacttcaaccaagtgatagtgggcctatgctacgagttacatgaccgtcagtgtgcattgcttgccgccatagaactctaatagaacaacatcgtccaaagctgaacttacagtcgggcatgccaggaatcaggagactggagggaccacctcgacaccgagaatcaccgatgccgttccaaagttcagatgtgcttcatcagagtggacgaaatgttggtttctggaactctcataaactgggttctccatcagaagatcccaggtcacctggttgaccgaatagttatgcgaggttagcgacgagcatacaccatatcagcttgtccccctacttgctgcttgctgaggctggggcagctcaagtacgatatggaagaaactccgctccgactcccttatatattggacctcgccacccatcaattttaggatcttcctgcatatgcttaggccaataccctcttgggttgtccagcgggagttactaaacatgtcttgaacaatctctgggggaaggccttcgccaggacaggcaaacctgaagaggaaaagcattgtgtctgttccatcagaattttgttttatatttggtctgacctgtatctccacccagccattttcagctggagcaaacctcaccatgcttagcaaaaagtcacataaaacttgttgaattctatattggtcaccatatgctgaggcttctttaatttcatcagggatatctcgaataagttgtaaatctctttctctcaactgtatcatcacttggctgacaacagcattcataacactacctagtgaaaattcacctttctcaagcaccaaagagccatcctcaatactttggaggctagcatccttaacaattttggacatctgtttctcacaagcagtgctggtttcaagaaactgcctctggtcatcctttagatcagtcatctccaataacgagtttgtaaatcggataccgttgagaggattctttatttcctggtaaatgtaagccaattccttcatccttgcataacacttcttttcatggtgtctctgaatctcaaaggcttgctgtaattcaggacttgcaatctgcaagaaacagaaggctcctatggcctcaccatccattctgctcctcgtgtttgcagtcaataaggcctgcacgtatttcccattcttgtcaaaaaatgaaaacggacgcgtgggacaatcctgtcctcctatagcgctgtgtaggacaatcattaatttcgcttatgcataccgtgcctatcagtcgccatcaattaccaaagaccttgtttaccataagttaaacaacaacttcc

SEQ ID NO: 3312 - DNA, 786 bp, Oryza sativa
  Clone ID: PAT_MRT4530_57804C.1
atgtgccaaaatggacacactctgtgttccacctgcaaagctagggtgcacaaccgttgccctacatgcagacaagagcttggtgatatcaggtgtttggccctggagaaagtagctgaatcgcttgagcttccctgtaagtactgctctttggggtgcccagagatcttcccatactacagcaagataaaacatgaagcgcagtgcatgtttagaccatacaattgcccttatgctggttctgagtgtgctgtggtgggtgatatcccttatcttgttgcccatttgagggatgatcacaaagttgatatgcatagtggttgcacattcaaccatagatatgtcaagtccaacccacgagaagtcgaaaatgccacctggatgctgacgaaatattggcacattgaatcgctgtctggtgaggaggtcttccactgtttcgggcaatacttgtgcgtgcactttgaggccttccagcttgggatggcgccagtctatatggcctttctccgtttcatgggtgatgaaaatgaggcaaggaactatagctacagccttgaggtcggcgcaaacggcaggaaaatggtatgggagggcaccccccgaagtgtccgggacagccaccggaaggtgcgggacagccatgatggcctcatcatccagaggaacatggcgctgttcttctcggggggcgaccgaaaggagctgaagctgaggatcaccggccggatctggaaggagcagcagaccccagacggtgcctgcataccaaatctctgtagctaa

SEQ ID NO: 3313 - DNA, 2114 bp, Oryza sativa
  Clone ID: PAT_MRT4530_57841C.1
cccacgcgtccgcccacgcgtgcgcccccgcgttcggtgcaaaggatttgccctgctcactgctcggtcactcactcactcaccatgaagtccatgaggctttcctacatccctcctgctgcttctgctgctccacagagccccagctatggcaggaagaagaacgcctccgccgctccgccatcggctgccgcctccaccaccgttctcacctccccgccggtgaccaccacccgcactccgaagcagaccgggcaagaggacgagcagttggtagccaagaccaagactacgagaactgttattgctacgacgaatggcagggcggcgccgagccagtctcggcctcgccgccggcctgcccccgccgccgcggcgtcggccgcttcgctgccgatgacgttctgcaacgcgctggaggaggtgatcaacacgttcatcgacccgccggcgcttcggccggcggtggacccgcggaacgtgctgaccagcaacttcgtgcccgtggacgagctgccgccgacgccctgccccgtcgtgcgcggcgccatcccgcgctgcctcgccggcggcgcctacatccgcaacgggcccaacccgcagcacctcccgcgcgggccgcaccacctgttcgacggcgacggcatgctgcactccctcctcctcccgtcgcccgcgtcgtccggcgacgaccccgtcctgtgctcgcgctacgtgcagacgtacaagtacctcgtggagcgcgacgccggcgcgcccgtcctgcccaacgtcttctccggcttccacggcgtggccgggatggcgcgcggcgccgtcgtggcggccagggtcctgaccgggcagatgaatccgttggagggcgtcgggctcgccaacaccagcctcgcctacttcgccggccgcctctacgcgctcggcgagtccgacctcccctacgccgtgcgcgtccacccggacaccggcgaggtgaccacgcacggcaggtgcgacttcggcggccgcctcgtcatgggcatgaccgcgcaccccaagaaggaccccgtcaccggcgagctcttcgcgttccgctacggccccgtgccgccgttcgtgacgtacttccggttcgacccggccggcaacaagggcgccgacgtgcccatcttctccgtgcagcagccgtcgttcctgcacgacttcgccatcaccgagcggtacgccatcttcccggagatccagatcgtgatgaagcccatggacatggtggtgggcggcggctcgcccgtggggtcggaccccggcaaggtgccccgcctcggcgtgatcccgcgctacgccaccgacgagtcggagatgcggtggttcgaggtgccgggcttcaacatcatgcactcggtgaacgcgtgggaggaggccggcggcgaggagctggtgctggtggcgcccaacgtcctctccatcgagcacgccctggagcacatggagctagtgcactcctgcgtcgagaaggtgcgcatcaacctccgcaccggcgtcgtcacgcgcaccccgctcgccgccgggaacttcgacttccccgtgatcaacccggctttcctcggccgccgcaacaggtacggctacttcggcgtcggcgaccccgcgcccaagatcggcggcgtggccaagctcgacttcgaccgcgccggcgagggcgactgcaccgtggcgcagcgcgacttcgggcccgggtgcttcgccggcgaaccgttcttcgtggccgacgacgtcgagggcaacggcaacgaggatgacgggtacttggtgtgctacgtccacgacgaggccaccggcgagaaccggttcgtggtgatggacgcgcggtcgccggacctggagatcgtcgcggaggtgcagctgcccggacgcgtcccctacggcttccatggcctgttcgtcacgcaggccgagctccagtcacagcaccaatgatacaaaccaacgtagcaatgtatagaattcacgtatacattttccatacgaaattacgagttactgtggaacacgtagtataagtgcacacatacttcgagaaaattatgtagagtacatatgaaatgaaagaatgattttaactaaaaaaaaaaaaaaaa

SEQ ID NO: 3314 - DNA, 1883 bp, Oryza sativa
  Clone ID: PAT_MRT4530_5803C.1
caagaagcatactagcacgctacgaaaccccccttctcttcgtccccaaattgcactacaaaaaaggccgcccctttcttctctcctcgtccttatcaccaccaatccgatcctcttctcttctcttctcttcttccccacatccagttcgattctcatctctcccacaacaaatcacgccatggatccctacaagcatcggccgtccagcgggagcaattccaccttctggaccaccaactccggcgcccccgtctggaacaacaactccgccctcaccgtcggagagcgaggccctatcctccttgaggactatcatctgattgaaaagcttgcacagtttgacagggagcgtatccctgaacgtgtcgttcatgcaaggggagccagtgccaagggattttttgaggttactcatgatatttctcacctcacatgtgctgattttctccgtgctcctggtgttcagaccccagttattgttcggttctccacagtcgtgcatgagcgtggaagccctgagacattgagggatccacgtggttttgctgtcaagttttacactagagagggtaattttgatcttgttgggaacaatatgcctgtcttttttatccgagatgggatgaaattccctgacatggtccatgctttcaagccaagtccaaagaccaatatgcaggagaactggagaatagttgatttcttttcacaccacccagagagcctgcacatgttctccttcctctttgacgatgtaggcatcccactcaactacaggcacatggagggttttggtgtcaacacctacaccctaatcaataaggatggaaagcctcaccttgtcaaattccactggaagcctacctgtggtgtcaaatgcctgttggatgatgaagctgtgactgttggcggcacctgccacagccatgccacgaaggacttgactgattctattgcagcagggaattacccagagtggaagctttacatccagactattgatcctgatcatgaggacagatttgacttcgatcctcttgatgtcaccaagacatggccagaggatatcatccccctgcagccagttggacggatggtcctgaacaaaaacattgataacttctttgcagaaaatgaacagcttgctttctgcccagcgataattgtccctggaatccattactctgatgataagctgctccagacaagaattttctcctatgctgatacccaaaggcaccgtcttggcccaaactatttgatgcttcctgtgaatgcaccaaaatgtgcataccacaacaaccaccacgatggctccatgaatttcatgcacagggatgaagaggttaactacttcccttcaaggtttgatgctgcacgtcatgctgagaaggtccctattcctcctcgtgttctaacaggctgtcgggaaaagtgtgtcattgacaaggagaacaatttccaacaggctggtgagagataccggtcatttgaccctgccaggcaagatcgttttctccagcggtgggttgatgctctctcagatcctcgtattacacatgaactccgtggcatctggatctcctactggtcgcagtgtgatgcgtcccttgggcagaagctggcttcacgtctcaacctgaaaccaaacatgtagatcggccaggaggaatccagtggtggtgctatgttggacagtcaaacatgaactgtaatgtgtcgaccagccgtagtcgtgaataaaatgtgatacggtgatatgtatactggtgacgcaagttgtgaaactgtatctggaatcctgaaaatatgccttgctgtgtcttgggaaagagataataaagactgatacagtgggtgctaaaaaaaaaaaaaaaaac

SEQ ID NO: 3315 - DNA, 1754 bp, Oryza sativa
  Clone ID: PAT_MRT4530_58916C.1
gcggtgccggcggggtgcgcctcgtcgcttttattagacgccgccgctgtggtggtgtttacttcgttcgtttggatcccacgcaggccatcgccatgggcgtctcggctctcctccgcctgtagatcgtgtggatcgtgcttacctgcgatggatagggcgagcgagaaccggaggctggcggcggtggggaagcccgtgccggggatcggagagatggggaaccggaggccgctcagggacatcaacaacctcgtcggggcgccgccgcacccgtccgcgatcgccaagaagccgatgctagagaagagtgggaaggaagagcagaagcctgcattggtggtgagccaccggcctatgacgaggaatttcgcggcctccttgacgcgaaaagaacagcttgaccatcaggtttccgtggctgatgcagcggtcgtctgcactgatccacagaagaaccccatccccgatggcacagttgacgacgatgtggaatcgtgcgaatcgaacgactatattgccgtggatgaatgcaatgatactgatgaggatgagtccatgatggacattgacagtgccgactcagggaatccgcttgcagcaaccgagtacgtcgaagagttgtacaagttctatagagaaaatgaggaaatgagttgtgtgcagcctgattacatgtccagtcaaggagacataaatgaaaagatgagagcaattctgattgattggctcattgaggtccatcacaagtttgagctgatggatgagactctctttcttactgttaacatagtagacagattcttggaaaaacaagttgtgccaaggaagaagttgcagctagttggagtgacagctatgctccttgcttgcaaatatgaggaagtcgcagtccctgtcgtcgaggatctagtgctaatttctgaccgggcttatacaaaaggacaaattctggaaatggaaaagttgatcctaaacacactccagttcaacatgtctgtaccaacaccttacgtttttatgagacggtttctgaaggcagctcagtctgacaagcagctacagctactttcctttttcattctggagctctccctggtggaataccaaatgctcaagtaccgaccttcgcttctttctgctgctgcagtttacacagcacaatgtgctctcactcgttgccagcagtggacaaagacctgcgaactacatagtagatataccggagagcagcttcttgagtgttctaggatgatggtagatttccaccagaaggccggagcaggcaagctcaccggcgtgcaccggaaatacagtacgttcaagtttgggtgtgcagccaaaacggagcctgctctcttcttgcttgagtcaggagcaggaggttacaaccttcagaagcagccttgttgaatgaatctattcccctggatagatttttttaacttagcttcagaacaactacagcaagcatgttgatgcttcacaaaagtgcagcagatttaccttactacagctcttttgtggtaatgtaaacttggtgtgaatgatggataatctgggtggtggtcagtccttcagttatactggggggctaataaatgattcaggcattcagcctatgtaagctgaatctcttgtaaatctacatgtgttcaagtagcatgaagaaaataacttgcatgttgagactttcagattcctcttaaaaaaaatgaaaattcccattggggcgtgcaaaaaaaaaaaaaaat

SEQ ID NO: 3316 - DNA, 3725 bp, Oryza sativa
  Clone ID: PAT_MRT4530_59607C.1
ctagtggatccccgggacacagaacaatttatatttcctttgcagtaaatgttagataaacccatgcctaccatacatacatactggaggctaaacctatcaccttagtgctaaatgaatttactcgttatacacaccaaagaggcgaaaaacaacccaaaaaaaaagaaatttctataaaggagaattttctatagctatctccttgggtcatgcagacgtgtcattggaacttctgaacggttcacctgatttacattctcgaatttttctatctctcgggcaacttgaatatcactgggggtaaaatactctgtaaaggccttgattacaaaatgtggtaccattgctgcaacaacaatgataagcagcagtaaccaaaacaaacctgtccccatttacttcctaggataaccatatccaggaagaaaccaaatggagtcgatcacaaagaggcaaatggttgttgctgctattgttccccacacaaaagcatgtacgatccaattccaccgaaagatgtccatggctagtagcatatttacaacaatgacaggggcaagtgcccatagatctcccagactagacatatctatcgtactttgtctatatgcaaaatatggcatgtagaaaacaaccagactttgccatagcgcttcgagcatattgaggacaaacaaatttacattatacttctcatccctttggccagatccatatagctttggataagctagtagtgtttccttactaagatccttgtcaagaataccaacaacaattgttggaagggatgtatatagcacagtatacaaaaggctactccattctgtgatagcagttgtcagagtgaatgctgtataaagtacataccagaaaagaaccaagacaaatgtcgcattcttgtaaaagttgtagaggatcatatatgacattctttgataattccaatggccatgaactaatagaagagggaccaagaatctgaattggcccatcgcaaaatctgatgccattacagcctgccgtccttcttgaccactgatgccaacaccaacatcagccatttgaatcattgaaacatcatttgcaccatcaccaattgctaaggtcatgtcatctgttcggtttttgataagtgcaactatccctgccttttgtaacggggccacccgacaacacaatacaacactacattctcttgccactttgaaaagctcttcttgcaactctgtctcaagtatgtaaaccaggctgttaccatctacaattaacgcaagagttacaccagcagattctgatgctaattctggactctgtgtgccagttgaagcaattctgagcttcttaatcgttgcatgtgcttcctcgagactcctcttacaagactcctttgagttgttgtttatcacaatttgtgtcatgtcattggtcagcagtttacaagagtagccaatagaaattgctgtctcctgcttatctcctgttaaaatccaaacctttatgtctgcttgtcgaagagattctattgtttctggaaccccatcttgaagcttatcttctatcccagtagcccccaatatgcggatattgttctctatattggccgcaactgatcggagtaaatttccccttccaagtactgacgtgctagcattttcatatgccaattgccactcctcaaactcaggttgactcaattcacgcatgccaataacgagagttcttagaccaaacgatgaatatttgtggaggtgtgcctctgtagcacgaacaatgtccagatctaatgaatttttggtaattccaaacaatgaactgtccgcacctttcacatatagcttaacagtcttatcggggcagccaactatgacagacatcctcttacgatcactatcaaactcatgaagtcctaatatatcaaatctctgtctgtcaccaaggacatcaatcaccacataaccagatgttcgctcaacaagcacaatgccataagatgccgcagcatacactagtgcctgctcatcaggggactcaccctgataatcaatcaacttttgcttagaatcacgagtatctaggacaagtggcacaatggtattacatgcagcaagagcaaggaagaattcgaggacaagctttgtttcctcatctgtgccaccacccctcagtaacttcaaaagccgatgatcaatcttgactgccatcttgggtgtccataggagatcatcgactacaactgagtatccgcatgaatctttgccagaacagtaatcaaccccccgaattgatgcacactggaactccatcttgttctctgtcagcgtccctgtcttatcagaaaatacatatttaatctgtcctagatcctcgtttatattcagggccctgcattggaactttgaccttgatgactcatcatacaaatctctgtcagcacccatgaaatatgcctgcccaagccgtaccaactccattgatatatacaaagagatcggaatgatgacctgatatacaatcaccgccatgaggaatgtaatgaatatctgcatccccatgccatagtaattgtagttcttccctgtcgtgtaatccttctccctaaagaactgggtgaattccaaatccccacggtgattcagtatccaaatccccgcgagcacacttgcggtcgtgcacatcccaatgagcataatggacagtatgacagtctcccggttcaactgtgtctccaaccggctccgtttcgacggcgccccggagctattaagcatgaccttggtctcctttccagcatacacaacaacccctatcgcccaggtggtattcttgagctcacatccacggagcacaatgttcgatggccctagcgagacacgcttgccatcaatctccaaattcgcctgaaatccatagatgttcctgtttggccgctcacaatgaaggacaccgccgattccaccgtcctgcgagaacctcagttgcgtctcctgcttagcatacctcgtcttgaggttggtctccccgtcaagattgacggtctggacgtgcgcgacgccggaggggtcgctggtggcgaggagcaccatgtcggcagggagcgtctcgctggaggcgacgcggacgacgtccccgacgcggatgtgcttccatttcttgggcgcgaactcccccgcggcgggcggcgccaggaggaccctggcgaggcggttgttctcctggcggtcggagcggtggcggcggaggtcctcgtaggcgtccttgacggcggtgacgaagaggacgaaggcgagcgggagcacggaggcgccgcggccgaagacggcgacctgggggagctggttgagcacggtgatggcgaggaagtagacgtacgacagccgccggaactgctcgaacaggttccgcggcaggaacgtcagcaccgagtacttcgccgtccgtacgccgttcccggcgaaccccgccgccgcctccgaagacgagggctccccgacaacaaccgcgcgggactcctcctcgccgcccccctcctcctccccccgctgcgacgcggccgacgacgggtcgggctcccggcggaaggggtcgggcacctcgagggagaacgcgaggcggtcggctcggaggggcggctccggctgcggcggcgggagcagcgatgacgccggcggctgctgcgtcggccgcggcgaggcgtcgagcagcgggcgcccggaagccat

SEQ ID NO: 3317 - DNA, 866 bp, Oryza sativa
  UNSURE (1)..(866): unsure at all n locations
  Clone ID: PAT_MRT4530_59646C.1
  unsure (1)..(866): unsure at all n locations
ccggccggggaatcccaagccgaaaccctcctctcctctcctcttcccccgcttctcccctcttcccccaaccaaattccaatggcggccacggcgatggaccacgacggcggcgaggtggtcacccctggggagctcctcggcaactcgtccctcctagcggggctcggcgcctacgccgacggccgctgcgtgcgcgcgtccatcactggccatcgccgcctcgtgccgcctcctcccggctccaccgatcagaggtccacggtggaggtggtcgggcacaaggcccatggagctgtgccgcagccgggaagcgtcgtcattgcgcgtgtgacgaaggttatggctaggatggcttctgcagatataatgtgtgttgactcaaaggctgtcaaggaaaagttcactggcatgataaggcagcaagatgttcgtgcaactgaaatcgacaaggtggatatgtttcagtcataccgacctggtgatattgtcagagccctggttctctctcttggtgatgcaagggcatattacctttccactgcccagaatgaactcggagttgtttctgcacaaagtataactggtggtacactagtcccgatcagttggactgagatgcaatgcgaattgacgggccaaatagagcaaaggaaagttgcaaaagtggaatagatttggtgactttgctaacagaaaaggttcatgatggcctacaatgtgttgaccaacaaagatggtcctcatgcgtgtatcaaaagcttgcgacgctcaagctcacgtcgccactggatttnagagttttgggttagcgatggtccatttagattctaatgatgtaggtcagggttttgctctggggtgct

SEQ ID NO: 3318 - DNA, 2084 bp, Oryza sativa
  Clone ID: PAT_MRT4530_59818C.1
atggcggggagtgggaggccgccggcggcgcagaagaagatcctgcagtcgctgcgcccgccgctgccgttcgccgcctcgtcgaggtcgcccttcgcggcgcccaacgactaccaccgcttccccgctggtggcgcggcggcggcggcggcgtctggttcgggtggcatcggcgcgggcggtgctggcggcggcggcgatatcgaggaggggctggtcatccggacgccgacacgcgacgcagatcgatatggaaagaatttgatccatgcagttgtcggagccaagcaaaaaagaaaagcaccagaagaaagtgatgttgctgagtctagcgactgtatgattactagccctggatttgctgtcagtccaatgctcactccagtctctgggaaagctgttaagacttccaagtcaaagactaagaacaacaaagctgggcctcagacacctacatcaaatgttggttcaccacttaatcccccaactcctgttggtacatgccgttatgacagttcgttagggcttctcacaaagaagttcataaatttgctgaagcaggctccggatggcattctagatttgaataatgctgcagaaacactagaggttcaaaaacggcgtatatatgatattaccaatgtacttgaaggaatagggttgattgaaaagacactcaagaacagaatccgttggaagggcttggatgattcaggagtggaattagataatggtctttcagctttgcaggcagaagttgaaaatcttagtctgaaggagcaagcattagatgagcgcataagtgatatgcgtgaaaaactaagaggtttaactgaagatgaaaacaatcaaagatggctctatgtgacagaagatgatatcaagggattaccctgctttcagaatgaaacactaattgcaataaaagctcctcatggcactacacttgaagtcccagatcctgacgaggctggtgattatctccagagaagatatagaatcgtattaagaagtacaatgggcccaatagatgtctacttagttagtcaatttgatgagaaatttgaggacttgggtgggggtgcaacaccatcagggcatgcaaatgtaccaaaacatcaacctactgaagtcttcaatacaacaaatgctggggttgggcaatgtagcaactcagttgctgtggacaataatattcagcacagccagacgattcctcaggatcctagtgcttcacatgattttggaggaatgacaaggattatcccttcagatattgatactgatgctgattactggctcatatcagaaggggatgtcagcattactgatatgtggaaaacagcactacttaacatggaaacagcagatgtgcagtgggatgagagcctggatacggatgtcttcctatctgaagacgttagaacgccaagttcacacaatcagcagccatctgcagtgggcgggccacagatgcaggtctcagacatgcataaaccctaggatcacaggggttacagaagtgaaaagatgacatctggaattcctggagcggtgtttgtagtgaaaagtgaaagcatgacagcaaatgctcattgccaaattgtaaagagccgggtggtcttcatcagaatatctgcatcttctcgagacaccaagtccgtgcgagagatcaggatgacaccattccggattcacatctgctgtggaggctggtggcgtcaactaacttaccagcctgctgtttcagcaccctgcttcagtcgaacgggagtaaatcttgctgctgctttcgctgtgaagcctgctgcggtgctcattaaggcactgatatattttttgcattcaaaactaactagtcatcagcaaggaaacggtgggctttgctgtgctctgtcgagtattctttgaaaattctttgtacattgggaggtataagggcatgcagggctcgagttattggtttgacgggagcaatgagctgagttaatgatgtaaccgagccgtctttgtaaattgttccatgctcttcctcaaatacaatggatagactttcattttgaaaaaaaaaaaaaaaaaaaaaa

SEQ ID NO: 3319 - DNA, 1882 bp, Oryza sativa
  Clone ID: PAT_MRT4530_59856C.1
cgaaaaggccacagctttcaatataaacaaacaccaaacgaatcccttcttagcggtagtgcatccccatccatccattctcgcacaagattccatcttttcatccaccaatctcgcgaaatctccgtctaattcaagaaaagatgagctgaggaatgagaggaaatattggtgttgcgaattgtggattgggaatttggagtttggattaggaggaggaggaggaggagaagattaggcgatgtctttcaggagcgtgatccaggaggtgaagggcgagatcggcgccatctcgcggcgggggttcaggtcgcggccggggcgagtccggcgagtggcggcggcggcggaggagccgccggacgagtcgtcggcggcggcgctggtgatgcgggagagctgctggacgcagctgccgccggagctcctgcgggaggtgctggcgagggtggaggagtcggaggggtggtggccgcgccgccgcgacgtggtggcgtgcgccggcgtctgccggagctggagggggatcgtcagggagatcgtgcgcaccccggaggcgtccgggaacctcaccttcccaatctctctcaagcagcctggcccgagggatgctcctatgaaatgtttcattgtaaggaaccggaccactcagacatattacctgtacattggactgactgatgcattaactgatgatgggaagttcctacttgctgcacgcaaatgtcgtaggaccacatgcactgagtacctgatttcgcttgatatgaacgatatatcaaagaggactgatagttatgttggcaaactaagatctaacttcttgggaaccaaatttactatctatgatgcccatccaccttatgctggagatgtgatttcaaagggtcagtctgcacgtgtgattggttcaaaccatttatcccccaggatacctgctgggaattatccagtctcacatatttcatatgaattgaacgttttgggttctaggggcccgagaaggatgcactgcgctatggattctatccctgtatcagcaattgaacaaggaggaacagctccgacgcagactgaatttcctttgagttaccatgaatctttcacatcaattccctttttcaaatcaaaatcagttcgagcgaataattcaactgcttcattactcactcaaaatggaagcaaactggtgttgaagaacaagtccccgaggtggcacgaacatctgcagtgctggtgccttaacttccatggacgggtaacggttgcatcggtaaagaacttccagctggtggcttcagatgagagtaacccaaccaaccaggaacacgatgatgtgatcctccagtttggtaaagttgggaaggacatgttcaccatggattaccgctatcctatctcggcatttcaggcgtttgcgatatgtctgagcagctttgacaccaaaatagcgtgcgaatgagtgaaggtgtgattctttcttccatgatcgaatgaaccgtttcctgatgacccacattgcaagctggccatgcactctgcttagttgcttccaccttttggaagcatgcagaatagagacataaataaaagttgctttaaatctaacattttagttgggtagggatatgtaacctgcaatttagctttcttgaagtatgttcaacctgcaacatttgagtgacttgtaagtcttgagtttaactacaggtgttggataaccacaattgacagctcacggacttatgtgtatacttgtccctttcggaaatccatagatgtatctgtttgcatagatatgtttatgttacattcttctattaccagaatgaacagagctattggatcttgtttcaaaaatcatgaaaaaaaaaaaaaaaaa

SEQ ID NO: 3320 - DNA, 1278 bp, Oryza sativa
  Clone ID: PAT_MRT4530_59858C.1
atgtctttcaggagcgtgatccaggaggtgaagggcgagatcggcgccatctcgcggcgggggttcaggtcgcggccggggcgagtccggcgagtggcggcggcggcggaggagccgccggacgagtcgtcggcggcggcgctggtgatgcgggagagctgctggacgcagctgccgccggagctcctgcgggaggtgctggcgagggtggaggagtcggaggggtggtggccgcgccgccgcgacgtggtggcgtgcgccggcgtctgccggagctggagggggatcgtcagggagatcgtgcgcaccccggaggcgtccgggaacctcaccttcccaatctctctcaagcagaccggaggccagatggcccagcttgtgttgaaagctgataaaatgcaattatattcgcctggcccgagggatgctcctatgaaatgtttcattgtaaggaaccggaccactcagacatattacctgtacattggactgactgatgcattaactgatgatgggaagttcctacttgctgcacgcaaatgtcgtaggaccacatgcactgagtacctgatttcgcttgatatgaacgatatatcaaagaggactgatagttatgttggcaaactaagatctaacttcttgggaaccaaatttactatctatgatgcccatccaccttatgctggagatgtgatttcaaagggtcagtctgcacgtgtgattggttcaaaccatttatcccccaggatacctgctgggaattatccagtctcacatatttcatatgaattgaacgttttgggttctaggggcccgagaaggatgcactgcgctatggattctatccctgtatcagcaattgaacaaggaggaacagctccgacgcagactgaatttcctttgagttaccatgaatctttcacatcaattccctttttcaaatcaaaatcagttcgagcgaataattcaactgcttcattactcactcaaaatggaagcaaactggtgttgaagaacaagtccccgaggtggcacgaacatctgcagtgctggtgccttaacttccatggacgggtaacggttgcatcggtaaagaacttccagctggtggcttcagatgagagtaacccaaccaaccaggaacacgatgatgtgatcctccagtttggtaaagttgggaaggacatgttcaccatggattaccgctatcctatctcggcatttcaggcgtttgcgatatgtctgagcagctttgacaccaaaatagcgtgcgaatga

SEQ ID NO: 3321 - DNA, 4737 bp, Oryza sativa
  Clone ID: PAT_MRT4530_60150C.1
atgatcaccctcaagagctccgacggcgagccggtcgaggtgacagaggcgtcggcgaggatctccaaggtcatcggggacaagatcgacgccggccgcggcggcgaggccatcccgctcccacacgtcgacaaaaagaccctcaagaaggtgatcgagtactgcgacgagcacgccaacgagaactccgacaccgacgagcagaaagaggaactcaagaactgggacaaggccttcatcgacgagctggacgaggacgacggctccttcctcttcttggtcctcctggcctccagctacctcaaaatcgatgggctcctcgacctcacctaccagagggtcgccgacaatagcaaggccaagaccaccgaggagatccgcaagaccttcagtaccatcgagatcgaactcagcgacaaggaggaggaggagcagcagcaggaggaggagatccgcccggagaacatgaagaagaagacggccacggcgatgatgatcgtgacgccccggccgaccgtgacgactgtgcccgtggcaggagaagaggtcgccgggggcacaacaacgaccaccccagggctaatcaaaactggcgatgcagggattgagacgacgacgattggaatgaacggggacgagactttgggcgtggccgcggcgaacaacgtgcgattgatcaagactaccgccgtgaacgcacacgctccccgcgccagcgcgacaggggagggcacagtcaccatggcggccggcgtcatcacgctggtgccaccgacgtggacaacgtcaccgatcctgtctaccccgagccacacctggcagagatctctctgccttcccgccagcaggagcttcacaccgaggaaatcccggcgtgatcagctgcttcgcctcgcgcttgtcgctgataaggccatggctgcgccacctccgacggcgatggaggacctggccatccggtcttccactgggactgaagcctggttcagcggcacggcatggaagccagtgcctgttgcgcgtgtctttggccgtatcagggaggccttgccggccacgccagcggtcgaaacgccgacaacctaccagcaaattgaggaggcgctgatgcgccttgagctcgctgccgctgcagctcgcaccccaggcgatgacactctcctaccacagcccatgtcaccggcacctctcgcagcgtccccgcctcgccgcttggaagatctggccagcgacgctgtggccgacaagattctgccggcgccgctccccggggcgctgcttccccaagagatgacccatatgccagccaccccgcccctgtcggcgctggagccgggctcgctgccggaacgcgcatcctcgccatgcgccatcgcgggactgttcacctcgcctccgccggctatcattgcgtcgccgctgcgctcgacgcttccatgtctgcggccggtcgtcctcacaaggaaggtgaagctccggccgaggcagcatagccaggcaatccggcggagtgagcacctcgccaagcaacctgcaagaccgatgatggagaggtgccagcgcatcctattcaggaggttgggcatcctccatgacgaagaagatgcctccgtggagcgcgttctcagccagtacatggccatgtttgatgggcccctgccgccgcacgccatcgccgccttgacggcgatcttcggcctcgacgacgatgatgagtgcgccatggatgcctctctgctcccccttgtgggcgaagggatcactgatgtggccgatgaactggcgtgccgccggtggcctgcgtgccgcctccctagcatttctatggaacctcagctcttggagcacatgtcgatgtcgcacagtctagatttcattagttggaatgtgagggggctcaattcgccagcacactgcaacacggtccacgagatgatgttggatacgaagtgcaacctagcatgcctccaagagacgaaacttcagaacatctacgacggcctcgcccgcttcctgggtggctacaaattggatagctttgccttcaaaccggccacgggcacgagagggggaattctcatcctttggaacagtgctgtcctcgtcctacaagatattcgaatcggccgcttttcgatctcagcacaagtgacggtcccactcacaggggctaccttccttatgaccggggtgtacgggcccacgagacaccggcttaaggatggcttccttaggcacataaggcggctaaagcccaatgctggcgaagggtggctcctattcggggatttcaacatgatctaccgagcaagggacaaaaacaatggcaaccttaatctagctcgcatgaggcgctttcgagcgacaatcgatcgatgtgaactccgcgagatccccttgcaaaacaggagattcacctggagtaatgagcgtcaaaggcccactctagtgaagcttgatcgttgtttctgcaatgagaactgggatctcgccttccatcaccatgtcctgcatgccctcccaacagggccgtcagaccactgccctctcgttctttcaaatcccgctgccccgcgcaagccgcgcccctttagatttgagaacttttggacacgcattccgggtttcaaggacatggtcaaggctagttggacccaaccatccccgcacacagagccgatgcaccgcctaaattacaagctacagcgcacagcttcttgcattaaaacctgggctaaaagtctattcacggaggtgaaaattcagtttcacatggcactcgatgtcattcagcggcttgatgtggcccaggaacacagagatctctctggcccggaattgcggctgagagctgccctaaagcgcaaaactctgactctcgccacgatagagagggcaaggaaaagacatgcttccaggttgactcatatccgtgaaggggaggcaaacataaagttttttcacctcagggtgaatgcgcgtaggaggaagaatagcattcaaagacccagcaaagaaaatggctgggcagtcactcacgatgagaaagaaatgaccattcttgaccacttcgcccatttaatgggtcggccggggccgaggccgaatgagctcaactgggaagctctagacatccagcctttcgacctctctaccttggaagagcctttcttggagcaggagatccaccaggctatcaaagagatgccagttgacaaagcgccagggccgaatggttacactggtatcttctttaaaatttgttgggatatcgtcaaggaggatgtttcccttgtcttcaattccatcttcaacctccgctacgccagcttgggcctccttaactcagcgaatattgtgttgatcccgaagaaggaaggggcggagagtgtttcggactacaggccgattaatctaatccatagcatagccaaaatcttctccaagctgctggcgttgtggctgaggccccacatgcactccttggtctccatcaaccaaagcgccttcatcaagggaagaagcattcatgacaacttcctctttgtgaggaacatggccagaagatttcaccgtacgaatcggccgatgctcctcttcaagctcgacatcacgaaagcatttgattctattcgttgggactacttgatggcccttttgcaacgcctaggcttccctgtaaaatggagagactggctagatgacgctgccattttcgtcaatcccacaagaggggatgtccaagcgctcacggaaatcctgcaacgtttcggtacggccactggactcgttaccaacttccaaaaatctcaagtcgcggccatcaaatgcaataacattgatttggacgacgtcctagagggagtcccagcagctggcacgggggacatcacgggtggaaaatgcaaagtcaattggacaaagacgtgtctgccaattaggcaaggaggcctcgaggtcctgaacctagaaagattcatgagagccctgcgtctacgctggctgtggcatgaatggaaggacccaaacaagccatgggttggtctcgagatcccctgcgacgaagtagacaagagcttgtttgccgcatccactaagataaccattggtgatgggaatatagcgcgattctgggacactgcgtggattgatgggagaagaccaaaggacctcatgcccctagtatatgcaatttctaagaagaggaaaaagaacctgcgccaaggaaaggagaatgatgcctgggtaggtgatttggcactggagacaaacccagtaattacagtggcccttgtggagcagctggttgccctatggactgcagtctgcaacgtgcagttagaagaagaagagtcagaccaaatcgcctggaagttcactcctcatgggcactactcggcttcatcggcctacaaagcgcagtatacgagacggatttggaacctcgttgcgacatgggtagggttccaccagctagaaccccgacgctggggggtggcgcaatcggtcaaagattggtgggaaatgctggcctctgtgtctggcgtccccaagaagggactccgcactctgattctactcatcgtatgggaagtctggaaggagcgaaataggaggatatttgatcataaggaagccacaacctcgtatctcctttcaaagataaaagaagaggctggcatgtgggccttggcaggtgccaagcgtcttggagagatcatctcgcagtttgtatag

SEQ ID NO: 3322 - DNA, 1769 bp, Oryza sativa
  Clone ID: PAT_MRT4530_60372C.1
tttggcgccacgtttaaagggcggagtcgctggcgttagagaagaggatttaaagagagagaaggccattctctcttgattgcttggagaggaagaagaacaagagccgccaccgccgccgttaggtttttatttattttttttctcgatctgatccgaggaggagcgaagcgaagaagggcaagatgcattcgacgaatctgctgctggaggagcccatcaggatggcatccatcctggagccatccaagcccagcttcttcccggcgatgaccaagatcgtggggacgctggggccaaagtcgcgctccgtcgacaccatctcctcctgcctcaaggccggcatgtcggtggcccgatttgatttctcgtggggagacgccgagtaccaccaggaaacccttgagaacctcaaggtcgccatcaagtccaccaagaagctctgcgcggtcatgcttgacacggtcggcccagagttgcaggtggtgaacaagagcgaagcctccatctccctcgaggagaacggcactgttattctcacccctgaccaggggcaggaggcctcctcacaagtgctgccaattaacttcgctgggcttgctaaggctgtgaagccaggtgacacaatatttgttgggcaatacttgttcacaggcagtgagactacttcagtttggttagaggtttctcaaattaaaggagatgatgtggtctgtgtgataaaaaacacagcaactctggctgggtcgctcttcacattgcattgctcgcagattcacatcgacttacctaccctatctgatgaggacaaggaggttatcagaaaatggggtgccccaaacaagattgacttcctctctctttcttatacaagacatgtagaagatgtgcgacaggcacgtgaattcctctcaaagttaggtgaccttagccagacccagatttttgcaaaaatcgagaatgtggaggggttgaataattttgatgaaatcctccaagaagctgatggtatcatcctgtcaagaggaaaccttggaattgatcttccacctgaaaaggtgtttttatttcaaaagtctgctctgcacaagtgcaacatggctggaaagcctgctgttgttactcgtgttgtagacagtatgactgacaacctcaggcctactcgtgcagaggctacggatgtggcaaatgcagtgcttgacgggagtgatgccattctccttggtgctgagactctgcgtggtttatacccagttgagactatttcaatagtgggtaaaatttgtgctgaggctgagaaggtcttcaaccaagatttatacttcaagagaactgtgaaacatgtgggggagcccatgacccacttggagtctattgcttcctctgcggtgcgagctgctattaaagtgaaggcgtctgtcataatttgcttcacatcatctggacgtgctgcaaggctaattgccaagtataggccaaccatgcctgttctatctgttgtcattcctcgtctaaaaacaaatcaactgaggtggagtttcactggcgcatttgaagcaagacaatcgctcatagttagaggcctctttccgatgcttgctgatccgaggcatccagctgaatcaaccaacgctacaaatgaatccgttttgaaggttgctcttgaccacggtaaagtttctggtgtgataaagtcgcatgatcgcgttgttgtctgccagaaggtgggagattcctcggttgtgaagatcattgagctggacgattag

SEQ ID NO: 3323 - DNA, 3042 bp, Oryza sativa
  Clone ID: PAT_MRT4530_60464C.1
atgggtgtgggaggaggcggaggaggaggaggaggggaggcggcggcggcggtggcggtggagggggatgaggcggggaaggggaggaggtggtggagggtgaaggtgaagctgagcacggtggcggtggtggcgtgggtgctggcgtcggcggcgctctgggcggggctgcactggcgcttccgccgcgcggcgctgcacaaggccgaggaggccctcgtctgcatgtgcgaggagcgcgcccgcatgctgcaggaccagttcgccgtctccgtcaaccacgtccacgccctcgccatcctcgtcgccaccttccactacgacaagcaccctcccgccctcgaccaggacacgttcgccgtgtacgccgcgaggacgtccttcgagcggccgctgctgagcggcgtggcgtacgcgcagcgggtggtgcacgccgacagggagagcttcgagcggcagcaggggtggatcatcaagaccatgaagcacgagccgtccccggcgcaggacgagtacgccccggtgatctactcccaggagaccatctcctacatcgagggcctcgacgtcatgtccggcgaggaggacagggagaacatcttgagggcgagggcgacagggaaggccgtcctcacgaggccgttccggctgatgtcgaatcacttgggtgttgtcttgacgtttcctgtctacctcgtcgatctcccaaatgataccgcggtggaggatcgtgttgctgctactgcaggataccttggaggagcatttgatgtggagtcactagtagaaaatttgttgagacagttagctggtaaccaggaattggtggtcaatgtttatgatgtcacaaaccactcaaaccctcttgtgatgtatggatctgaggttcctcttggtattccctcaccatcacacacctatacgttggattttggtgatccattgagaaagcatcagatggtttgcagatacagaaacaagcttcatgtttcatggtctgcaattactacaccatcaggggtctttgttatatgtatgctggtgggctacataatatatgctgcttggagtcgctacgataatgttaaggaagattgccggaaaatggaagcgctgaaaaaacgggcagaagcggctgatattgctaaatctcagttccttgcaactgtttctcatgagatcagaacacccatgaatggcgtgctgggaatgcttgatatgttattagacacagagctgaagtcaacccagagggattatgcacaaacagcccaagtctgtggaaaggcattaatatccctgattaacgaagtgcttgacagggccaaaatcgaggctggcaagatagatctcgagtcagtaccatttgacctgaggtccatccttgatgatgtcatctcgttattttcttcaaaatcaagagagaaaggaattgagcttgctgtatatgtttctgaaagagttcctgaaatcctgttgggcgaccctggaaggtttcgtcagataattacaaacttggtgggaaactcgatcaagataacaatatttaccttgtcgcagttcacagaacgggggcacatttttgtacaagttcacctggcagatcactcaaatcttgcaacagaagcaaaaattgaaccagtagtcaatgggatgaatggacataaagacgaggctattgctatacccaccagtgggtctcataacactttaagtggttttgaagcagctgatagccgaaataactgggaaaacttcaagcttttgctctcttacgagaaaaatgaaatgccatatgaaagtgattctgataaagtaactcttgttgttagtgtggaagatactgggataggcataccactgcatgcccaaggccgggtcttcacgcctttcatgcaagctgacagctcaacttctaggaactatggtggaactggcattggattgagcatcagcaaatgtcttgttgaaataatgggtggtcagataaactttgtcagccgacctcttgttgggagcacattcacattcactgctgttctgagaaggtgtgacaaaaatgctattagtgacagtaagactgttgctttgcacccattaccgtccagttttaaaggcttatctgcgctattggttgataaaagacctgtaagagcaactgtgactaagtatcatttgcaaaggcttggaatcacttctgaagttgttggtaccattgatccgacatttggtgtgttgtctgggagaaatggcagttctctaaccagcattggtaagaagcagccatgcatgttgctaatcgagagtgattcctggggaccacagatggatgtctccttacatgctagacttcaggagatgaaacagagtgatcgcatacatgtattgcccaaggttttccttctttctgctgcagaatcagacaaagtaaagaagatacatgcagttgattctgtgataccaaagcctctgaaagcaagtgcacttgcggcctgtctgttccaagcacttggtatcacacagccgagccatgagaaacgtgacgattcaggttctcttcatgggcgtgatggttcaggttctcttcatgggttgcttcttggcaagaacatattggtagttgatgacaacaaggtaaacctcagagtggccgctggtacattgaagaaatatggggcaaaggtggagtgtgtggagagtggaaaagatgctctttcccttctacaagtgccgcacaagtttgatctgtgtctcatggacattcagatgccggagatggatggatttgaggcaactcggcaaatacgagcaatggaagggaaggcaaatgagcaggcagacgacagcgaatcgggttcagaaatcgcagcaaagacggccaaatggcacttgccaatcctggcaatgaccgctgatgtcatccaggccacccacgaggaatgcacaaagtgcgggatggatggctacgtctcgaagccctttgaggagaagcagctcttccaggcagtacagaagttcttgggcccatgcgtttccagctga

SEQ ID NO: 3324 - DNA, 2249 bp, Oryza sativa
  Clone ID: PAT_MRT4530_60549C.1
gactgaaaagtagcttatcgaatttcatatatgcaggtgtgtgagctcggtgttacttcacaaatacttgtctcttacacatgttcaggagctgatccactatgttagatgtaggaggtaaggaccactcatttcttttgttacttactgaattacccgtgggcaattagatagagtataggtgataattagcggaagcaaaggaaaccgttgaaacaccagatcaatggaaaaggcatctgttttcactgagcagattgtgctagggtcaggtcatatggggagagagtgccagagtggtcgacatcgagcttttcaaactcctccagaaaagaagaaatctcctcttggttgatcttacccagttctttgagcttgtacacaacaaattctgcagcaccaacttgtcgatcatcatccagatcggctgcctcaagatccatctttgtcattttccgtgtgagaacccaattggccagcattttctgccgtcgctcggtgtagatctcagcaaggtacatgaagaattgtgccatgatgatagtgctcgtgataatccaaaagaccgcgaaaacacgtcccagtttggatgagaagcttttatccccataacccagggtagtgattgtggcacatacacagtagaaggaatcaacaagactcagtttctccactttccacagaaatacggtcccagaaataatggatagcaccagaagcagtgcatttgtgtaaaatttgtactttatcctgtttgtctcgattgctctaagcatcttggtctcaccacccttcagattcgtgtgcaatgctttgaagaacagcacctcctgcttctcaacaagataatctgctactttgctgacaaagagagcaacaactgccatacccatgaagacgaaagcacaagcaagcagttttgttgtgtcattgtttgggacgaggtctccatagccgacggtggtcattgtgacaacacagaagtacaaggcgtcaagcactctatttgttcgcttgcctgatatctcatccatgacagcataaaaggccaggacgcccactagaagatagataaaaaggagaagtcctactagtctgaaacttggcctcatctccttgaataactccttggctttaactgatgagcccttttcaggggggccttgaagaggatccgtggaaggagtcgacctgcatcgtcgaaaccgatttactccttctgacggcttccgctgcagcacattagggttatcagctagcagtgattgctgaatgctgttgtcatccattggattagcctggatctttcctccggctgaggggacgccgcgcgtcgatctcctctccctctcgcccgacctgccctgagccgcctgagacggatgccccgcgcgcgcgcgccactgctgctgcgcgcctgcggggttgagggctctggctcctggttgtgaacttgtgacggcaactgcaaccagcggccacaagtcgcagtcacaggcggtggcgattcggttggcgagctccggcggcgcggagaggcggcgacccagcgggcaagctccggcggtgattcggtcggcgagctccggccgcgcagagaggcggcgaaccggcggtcgggaggtcgcgactcgatgggctggctcccgcggcagggagaggcagtgacccagcggtagggaggccgcgactcggcgagctagctccggccggcggtagggaggccgcgactcggcgagctggctccggcggtgtggagaggcggcggcctcggcgggctggctccagcgacgcggagaagtggcagcccgatgggcggagatcgcgtggaggcggtggaggtcgcgcgactggccaagtccggcaggggcggcgaggctagcagtggcgcggagtacaccagtcgccgcgggcttcctccgcgcgtcgtcgtcgtcgccgtcgccggagcggatggtggtggcggcagcggccggagcaggtcgccatggcgtcacaccagacgtcgtcgtccctcgccacggcggcactcgaagccgatggtggttggctccagcatctctggattcaccaatgaagccattcaatttcaggctccagcagtggtatacttggaggaggttgtactcttcagcagagccattctctttatcatgttgtagtctcttatctctgaacttctctgaaacttcaattccatccttgaactttctctgaaatagcaggagcaattcagcactcatgatcat

SEQ ID NO: 3325 - DNA, 1725 bp, Oryza sativa
  Clone ID: PAT_MRT4530_6072C.1
atggccgaggtgacggtggtccgtgcggagcgcgaggaggagtccaccctggagcagggtctcctcgccatcccggaggaatccaaccaacttacatacactggagatggatctgtcgacttttctgggaatcctgttgtgaaggagagaactggtagatggagggcatgcccatttatcttaggtaatgagtgctgtgagcggttggcctattatggaatctccacaaaccttgttacatacttgacaaagaaactgcatgatggtaatgcttctgctgctagcaatgtgactgcatggcagggaacttgctacttaactccccttattggagctatactggctgatgcatactggggaaggtattggactattgcaacattctccacgatatacttcattgggatggctgtactgactctttcagcatcagttcctacattcatgcctccaccttgcgaagggtccttttgcccaccagcaaatccattgcagtatactgtcttttttcttggactttacctaattgctcttggtactggtggtattaagccctgtgtctcatcctttggagcagatcaatttgatgatacagacccagttgagcgaatccagaagggatctttctttaactggttctatttctcaataaacattggtgctctcatatcaagcagttttctggtttgggtgcaagacaatataggatggggaataggctttggcattccaacaattttcatggggctggccatcataagtttcttctctggaacatcactttatagattccaaaagccaggcggcagtcctattacacgagtatgccaggtggttgttgcctcctttcgcaagtggaacgtacatgttccagaggatagctctcgcttgtatgagttgcctgatggggcttcagcaattgaagggagtcggcaattggagcacaccgatgaactcagatgtctggacaaagctgctacaattactgatcttgatgtgaaagcagatagctttacaaacccatggcgaatatgcactgtgactcaggtggaagaactgaagatattgatgtccaccatgtttgttgagcaagggatgatgcttgatacatcagtaggtccattcaagattcctccagcatctctatctacctttgatgtggtaagtgtcattatatgggtccccctctatgatagtatcttggttccaatagctaggaggttcactggcaacccgaggggctttacagagttacagaggatggggattggtttggtaatctcaatcttttcgatggcggcagctgcagttcttgagattaaaaggttggacattgcaagggctgaacatttggtggatcaaaatgttccagtaccactgaacatctgctggcaaattcctcaatatttcttggttggtgcctcagaggtcttcacatttgtcgggtcacttgagttcttctatgatcaatcaccggatgccatgaggagcctctgcagcgcactgcagcttgtcacaacagctcttgggaattatctcagtgcattcattttgacattggttgcgtacttcacaacaagaggaggaaatcctggatggattcctgataacttgaatcaaggtcacctagattatttcttctggcttcttgctgggctcagttttctgaactttgtgatatatgtcatctgcgcaaacaaatacaaaagcaagaaagcagcttga

SEQ ID NO: 3326 - DNA, 2232 bp, Oryza sativa
  Clone ID: PAT_MRT4530_6073C.1
cctcgaggccgggagcccaacaataataatccccccttttcatcgcggcgacgccggagaccccacatatccagatctgcaagcttcctcctcctccttcctcctgatcctttagcttcctatatacgattccaccatcgaaggccagggcccagacttgcttgccgcaggttactgatccaccgaaggagggaggcgcccgcccgccgccatggccgaggtgacggtggtccgtgcggagcgcgaggaggagtccaccctggagcagggtctcctcgccatcccggaggaatccaaccaacttacatacactggagatggatctgtcgacttttctgggaatcctgttgtgaaggagagaactggtagatggagggcatgcccatttatcttaggtaatgagtgctgtgagcggttggcctattatggaatctccacaaaccttgttacatacttgacaaagaaactgcatgatggtaatgcttctgctgctagcaatgtgactgcatggcagggaacttgctacttaactccccttattggagctatactggctgatgcatactggggaaggtattggactattgcaacattctccacgatatacttcattgggatggctgtactgactctttcagcatcagttcctacattcatgcctccaccttgcgaagggtccttttgcccaccagcaaatccattgcagtatactgtcttttttcttggactttacctaattgctcttggtactggtggtattaagccctgtgtctcatcctttggagcagatcaattcgatgatacagacccagttgagggaatccggaagggatctttctttaactggttctatttctcaataaacatgggtgctctcatatcaagcagttgtctggtttgggtgcaagacaatataggatggggaataggctttggcattccaacaattttcatggggctggccatcataagtttcttctctggaacatcactttatagattccaaaagccaggcggcagtcctattacacgagtatgccaggtggttgttgcctcctttcgcaagtggaacgtacatgttccagaggatagctctcgcttgtatgagttgcctgatggggcttcagcaattgaagggagtcggcaattggagcacaccgatgaactcagatgtctggacaaagctgctacaattactgatcttgatgtgaaagcagatagctttacaaacccatggcgaatatgcactgtgactcaggtggaagaactgaagatattggtaaggatgttccctgtctgggcaacgactattgtgttttctgctgtctatgctcagatgtccaccatgtttgttgagcaagggatgatgcttgatacatcagtaggtccattcaagattcctccagcatctctatctacctttgatgtggtaagtgtcattatatgggtccccctctatgatagtatcttggttccaatagctaggaggttcactggcaacccgaggggctttacagagttacagaggatggggattggtttggtaatctcaatcttttcgatggcggcagctgcagttcttgagattaaaaggttggacattgcaagggctgaacatttggtggatcaaaatgttccagtaccactgaacatctgctggcaaattcctcaatatttcttggttggtgcctcagaggtcttcacatttgtcgggtcacttgagttcttctatgatcaatcaccggatgccatgaggagcctctgcagcgcactgcagcttgtcacaacagctcttgggaattatctcagtgcattcattttgacattggttgcgtacttcacaacaagaggaggaaatcctggatggattcctgataacttgaatcaaggtcacctagattatttcttctggcttcttgctgggctcagttttctgaactttgtgatatatgtcatctgcgcaaacaaatacaaaagcaagaaagcagcttgagctaatcaggagttaaaagactgtcgtcatgggaatttcacttcaaaattctgtatatatgtgcacaaagtacatgttgaagcagcgaccgtaacaagagaactttaaccatcctgtactctgtatttgatgctactatacattttatactttttgttctgtagatattaatttattgaagctacttgtggaatgtagctttgcttccaatgcgtctcattaaaaaaaaaaacctgatt

SEQ ID NO: 3327 - DNA, 2313 bp, Oryza sativa
  Clone ID: PAT_MRT4530_60906C.1
atggcggcggcggcgatactgccggagctggcggcgcaggtggtgatcccggtggcagcggcggtggggatcgcgttcgcggtgctgcagtgggcgctcgtctccaaggtgaagctcacggcggagccgcggcgcggggaggcggggggcgccgccggggggaagagcgggccgagcgactacctcatcgaggaggaggaggggctcaacgaccacaacgtcgtctccaagtgcgccgagatccagaccgccatctccgaaggagcgacatctttccttttcactgagtacaagtatgtcggattattcatgagcatcttcgcagttcttattttcctcttccttgggtctgttgagggcttcagcacgaagagccagccttgccactacagcaaggacaagacttgcaagcctgcccttgcaaatgctatctttagcactatagcttttgtgcttggtgcagttacctctctggtatctggttttcttggaatgaagattgcaacttatgcaaatgctcggacgactctggaggccaggaagggtgttggaaaggcttttatcactgctttccggtctggtgccgttatgggtttcctgcttgctgcaagcggtctcttggtcctttacattgcaattaatttgtttggaatttattatggtgatgactgggaaggcctttttgaagctattactggttatggacttggtggttcttctatggctcttttcggccgtgtaggtggtggtatttatacaaaagctgctgatgttggtgctgaccttgttgggaaggtggaaagaaatattcctgaggacgatcccagaaacccagctgtcattgcagacaatgttggtgacaatgttggagatattgctggaatgggatcagatctttttggttcttatgctgaatcatcgtgtgctgcacttgttgtggcatcaatctcttcttttggaatcaaccatgaatttactcccatggtgtaccctcttcttgtcagctctgtgggaattatagcgtgtctcataaccaccttgtttgcaactgatttctttgagataaaggctgtgagtgaaatagagccagctctcaagaaacagcttataatttccactgcttttatgactgttggcattgcccttgtcagttggttgggccttccttacaccttcaccatctttaactttggtgcccagaagacagtgcaaagctggcaattattcttgtgtgtggcggttggtctttgggctggtctaatcattggatttgttaccgagtattacaccagcaacgcatatagccctgtacaagatgttgctgattcttgcagaactggagctgccactaatgtcatttttgggcttgctttgggttacaaatcagtcatcatccctatttttgctattgctttcagcattttcctcagcttcagccttgctgccatgtatggtgttgctgtggctgctcttggaatgctgagcacaattgccacaggtcttgctatcgacgcctatggtcccatcagtgacaatgctggaggaattgctgaaatggccggcatgagccacagaattcgggagagaactgatgctctggatgctgccggaaacacaactgccgcaattggaaagggttttgccatcggctctgcagccttggtgtcacttgcactttttggtgcctttgtgagccgtgcggctatctctacggttgatgttctgacaccaaaagtgttcattgggcttattgttggtgctatgctcccatactggttctcagcaatgactatgaagagtgtaggcagcgcggcgctaaagatggtggaggaagtccgcaggcagttcaacaccatccctggactcatggagggcacaactaagcctgactatgcaacttgtgtcaagatctccactgatgcatccatcaaggagatgatccctcctggtgctcttgttatgctcaccccacttatcgtcggaattctgttcggcgtcgagaccctctctggagtccttgctggtgctctcgtctctggtgttcagattgccatctccgcatcaaacactggcggtgcttgggacaatgcaaagaaatacattgaggctggagcttcagagcatgccaggacccttggtcccaaaggttccgatccccacaaggcggccgtcatcggtgacaccatcggagaccctctcaaggacacttcaggaccctctctcaacatcctcatcaagctcatggcggtcgaatccctcgttttcgcccccttcttcgccacccacggtggtatcctcttcaagttgttctaa

SEQ ID NO: 3328 - DNA, 710 bp, Oryza sativa
  Clone ID: PAT_MRT4530_60938C.1
ttttgtgctattcaacgcaacgcagaactttgatggtgcaaatttcagcagtggggagattcttgcaattcattggcaatttcctttatctgttcgccacgagcacctttcttggagttgctgctggacttctcagtgcttatatcataaaaaagctgtacttcagcaggcattccactgatcgtgaagtttctattatgatgctcatggcttacttgtcttacatgcttgctgaattgcttgatttcaagggtattcttacagtgttcttctgtggtattgtaatgtcgcactatacctggcataatgtaacagagagttccagggtcacaaccaagcacgccttcgccacattgtcatttatcgccgagacatttctatttctttatgttggtatggatgcattggatatggagaagtggaagattgtcggtgaaacattcagcccaatgaaatctattgctttgagctccactattttgttcttggtgctggtcgcaagagctgcttttgttttcccactatcttttttggcaaatttgaccaaaaaaactgaagagggaaagatctctattaagcagcaagttattatttggtgggcgggtctgatgagaggtgctgtgtccattgcattggcctacaacaagttcacaaggtcaggccacactcaactccctagtaatgctatcatgatcactagtacaatcact

SEQ ID NO: 3329 - DNA, 3243 bp, Oryza sativa
  Clone ID: PAT_MRT4530_60954C.1
tcacctcaacctcgtcaatttccagttcctcctgtccagcggctcgctgctgccggcggtgacgtcgtcctggtcggtcgtcatcgtgatctcgtcgctgctgccggccaccgtcgccgccacggggacgatctccttggtgcgcctctcgccgccgctgaacctgagcatgtcgaccacctcggccatcgccgggcggctctcggcgctgctctgcgtgcacagcatggccgtctccaccacggcgcggagctgcgcggcgtcgaagcgcccggcgagccttgggtcggcgaggcgctcccacctgcggcgctccaccagcggcgccgcccactgcacgatctcgcgcttgacgccgccggggagcttctccagcgggcggcgcgcgctgacgagctccagcaggaggacgccgaagctgtagacgtcgcagctctcggagaccttcccccacatggcgtactccggcgccaggtacccgagcgtccccttcacccgcgtcgtcaggtgcgacacgccgtccgggatcagcttcgcgaacccgaagtcggccaccttgggcacgaactccgcgtcgagcagcacgttgctcgccttgatgtcgcggtggatgatgtgcgggctcgcctcatggtgcaagtacgagaggccttcggcggcgccgacggcgatggcgacgcggcggggccactcgagggggacgtggtggtgggaggagggggtgccgcggtgagggtgcaggtgggtgaggaggctgtggttgggcatgtagtcatagacgatgaggcgctcgtcgccgccggcgtagaagccgcggaggctcagcaggttcctgtggcggacgcggccgaggatctccacctccacggcgaactccatctccgccttggccgtcatcgccttcagccgcttcaccgcaatctcgacgcctttggaggtgcgtccccagtagacggtgccgaagccgccctcgccgagcttgttgctctcgctgaagttgccggtcgcttgcaggagctccttgagcgtgtacgtttcccatgggtaatccacgctcgtccggttcttggacgccctcgccggattcgtcctccgacgactactggtggcagccggctccggatcagagtcgccgccggtgacgcagcagaagcaccggttgatcatttcttcacagcaatcgatggatcctgcgggccaagctgacagtatgcggatgaagaataatctgcatttatatgcatatgcacttgtgaagtcagtcagcttgcccgtcataatcttttctgttaattgtccaaaaataagaatgatgcaaaccgtcaggccaacgaacttgtccaatatggtctgtacttggtcatacttggtcattgccaactccagccatggcttcatgttaccgttgtaatcaacaacggctgcattatctatctctgagcggtcaatgcttgggttgtatcctaatccgaggacatgccacgacttgtcaaggggatgcgtcaacttgaagaaggtcaagaggccgtgtggaagtgtcccaagcttccaaagaacccggtcttcgttcatgttttgccacctgtggtagatcccagtgatatctttcttcttccactcgttcagatcaaagatgttcattccatatgcccagccacatgcatttggatcgaagttccgagcgatatgtggatttgaaaagttaagatacttgtcaaaacgatgaaaactctccccacaggtctccactgcaccggtgaccttcccattaagatcaacatcccataatcccgtcaaatctttctgcacgactatgtcatcatcaaggaaaaatatcttatccaactttggatagacctgtgggagataaaatctcaagtggttcagcatggagaggtacttggggttacgatactttaggtttgaagaacccgcagagagagtggtggggcggtcagctttgaaataatactctttcatggctgcagactcaagttgccgtaaaacaggacagtatgatgagttcaaccacttaaattcatctacgttctcaacatggatggtggccttcccaggagggttcagcaaaaaccacatgttcatggctccaaagttcaacttatcagtcacaagatggaaaacatgcttctcaggctccttagcattcatgatggttgagttcacaacagatgctgccaagacattgtctgagaaaagtgcataatggtagagctctggattttccaagttctcgctcctcgggaacttccttttctccaacgggaggagatagtaatctattgttaagcgcatcgacaaacaatgaatgctgtttggaattgtcttcgcagccaactggctaagaaatgtactctgcttcttcaagctcctgacttgttcatctgctgactgaagcatagctctaagtctctgagtaaccgccttgcaatcatacacatcttctctagccttggatagaagttgacccattactctgactttctcaggtgcactatgatgaaggtcagaatcagcagtagcctctccaacagcccgctggctttccttgatcctggtttgcagctcttgataaagatcattcttgttctttgatttagcaagcacagaataaacacgtgccataataatctggtctctcatcaatctaactgtcaaatctgagttctcattctcattctcctttctccaaatgccttcgaacattttttgcagccgtgtcgacttgatgttcatctgcacagacaagaagtttattttcttgcataccttgtcatcaatatccaaactcgcattgctcaggtcattgactagatcatcagttttccaagagggagatgcacgttttatgaaaaaatcaacactcaaagcacctgcttcttgttgactagaagctaaagcatcaaacatctccttggacaaaatagatttcaggttgttcgttggcagctgtttttgccattctgtttcctgagtaccttccatatccatgggatctgcaggtaaacaaactacaacatcacttatcaaacctgaacacatcactccccagtccccacccccaccggaacctgagccgacgtggcccccattgcacgcgacgaagaagatcgacggcgcgagaacgaagaggaacacgacgaccaccagcggcgccaccacgccgcgcctccctcctccgccgccgccggccgtggagtacgggagccgcttcgagttcgccat

SEQ ID NO: 3330 - DNA, 1139 bp, Oryza sativa
  Clone ID: PAT_MRT4530_61243C.1
gagagaaaccccccgcacgaagcaaagaagccgcaaccgcaagccccaagagcgaaaccgtaacgaagggaaagtttgggatgcgcgttgctgcgacgacgcggcccgcctcctcctccgccgccgctccgctccccctcttcctcctcctcgccgtcgccgccgccgccgccgccctgttcctcgtcggctccgcgtccctcgccatggccggccacgtcctcggcggcgcgcacgacgccccctccgccgccaacagcgtcgagaccgacgcgctcgcccgcttcgccgtcgacgagcacaacaagcgcgagaacgcgctgctggagttcgtgcgggtggtggaggcgaaggagcaggtggtggccggcacgctgcaccacctcacgctcgaggccctcgaggcggggaggaagaaggtgtacgaggccaaggtctgggtcaagccgtggctcgatttcaaggagctccaggagttccgcaacactggggatgcaaccaccttcaccaacgccgacctcggcgccaagaaaggtggacatgagcctgggtggcgtgatgttccagtacatgatcctgtagtcaaagatgctgcagaccatgctgtgaaatcaatccagcagaggtcaaactccctgtttccatatgaacttctcgagatcgttcgtgcaaaggcagaggttgttgaagacttcgcaaagtttgacattctgatgaaacttaagaggggaaacaaggaggagaagttcaaagccgaggtccacaagaaccttgaaggggcatttgtactgaaccagatgcaacaagagcatgatgaatcgagcagccagtgaaccttgccacattaagctgtagttatgtagtttgtgttcaataagaaaacagtgaacatgcacccttccgtttctatcgggacataggctggaacttgttcctaacatcgatgaaaagaagacactacactatccttttgttcctgttgctcttagtgtgataatacgatactggtcgtgtaacttctcaagggaaccgtgggtctatgccatacagcttgtgaatgtgaaatcctatgttgatacttctcaagtcaaaaaaaaaaaaaaaaataaaaaaaaaaaaaaaaaaaaaaaaaaaaaaaa

SEQ ID NO: 3331 - DNA, 1110 bp, Oryza sativa
  Clone ID: PAT_MRT4530_61245C.1
atggccggccacgtcctcggcggcgcgcacgacgccccctccgccgccaacagcgtcgagaccgacgcgctcgcccgcttcgccgtcgacgagcacaacaagcgcgagaacgcgctgctggagttcgtgcgggtggtggaggcgaaggagcaggtggtggccggcacgctgcaccacctcacgctcgaggccctcgaggcggggaggaagaaggtgtacgaggccaaggtctgggtcaagccgtggctcgatttcaaggagctccaggagttccgcaacactggggatgcaaccaccttcaccaacgccgacctcggcgccaagaaagttacacattcatgtctagttgagtttgttatatgtgccctgttgaacttaaaaggtggacatgagcctgggtggcgtgatgttccagtacatgatcctgtagtcaaagatgctgcagaccatgctgtgaaatcaatccagcagaggtcaaactccctgtttccatatgaacttctcgagatcgttcgtgcaaaggcagaggttgttgaagacttcgcaaagtttgacattctgatgaaacttaagaggggaaacaaggaggagaagttcaaagccgaggtccacaagaaccttgaaggggcatttgtactgaaccagatgcaacaagagcatgatgaatcgagcagccagtgaaccttgccacattaagctgtagttatgtagtttgtgttcaataagaaaacagtgaacatgcacccttccgtttctatcgggacataggctggaacttgttcctaacatcgatgaaaagaagacactacactatccttttgttcctgttgctcttagtgtgataatacgatactggtcgtgtaacttctcaagggaaccgtgggtctatgccatacagcttgtgaatgtgaaatcctatgttgatacttctcaagtcaccactctttggttgcttaacatgccaaatgtacttgcatgaatattcaacatgttataccgtcggatctctgcagatattcgggttagggatccgatttttttctgcattttaactactatgtagagaaacatgccaaagcaagggagtttggggctgctgatttctgcttc

SEQ ID NO: 3332 - DNA, 1805 bp, Oryza sativa
  Clone ID: PAT_MRT4530_61496C.1
ccaccgccttcgtcggaggcagctttgcttcgctaccctgcgccgagctagctagggagaggggatcaatataccaccccgcgcatcaaccggagagacgtacgatcgatcgaatagctagctagctctctagctcggggagagagagagacaaagaagcctctctcttcgcatgggaggagggcccaacggcaacggcggcggagggcgtcactatggacgtctaccttccccggacccaaggcgacgtcgacgacgacggcaaggagaggaggacagggacggtgtggacggcgacggcgcacataatcacggcggtgatcgggtccggcgtgctgtcgctggcgtgggcgatggcgcagctggggtgggtggctggccccatcaccctcctcctcttcgccgccatcaccttctacacctgcggcctcctctccgactgctaccgcgtcggcgacccggccaccggcaagcgcaactacacctacaccgacgccgtcaagtcctacctcggtggctggcacgtctggttctgcggcttctgccagtacgtcaacatgttcggcaccggcatcggctacaccatcaccgcctccatctccgccgcggctatcaacaagtccaactgctaccactggcgcggccatggcacggactgcagccagaacacgagcgcctacatcatcggcttcggcgtcctgcaggccctcttctgccagctcccaaacttccaccagctctggtggctgtccatcatcgccgccgtcatgtccttctcgtacgccgccatcgccgtcggcttgtcgctggcgcagaccatcatggacccgctggggaggacgacgctgacgggcacggtggtcggcgtcgacgtcgacgccacgcagaaggtgtggctcacgttccaggcgctggggaacgtcgccttcgcctactcctacgccatcatcctcatcgagatccaggacacgctgcggtcgccgccgccggagaacgcgacgatgcggcgcgccacggcggcggggatctcgacgaccacggggttctacctgctgtgcggctgcctgggctactcggcgttcgggaacgcggcgccgggcaacatcctcaccggcttcggcttctacgagccatactggctggtggacgtggccaacgcctgcatcgtggtgcacctcgtcggcgggttccaggtgttctgccagccgctgttcgccgccgtggagggcggcgtggcgcggcggtgcccggggctgctcggcggcggcgcggggcgggccagcggcgtgaacgtgttccggcttgtgtggaggacggcgttcgtggcggtgatcacgctgctggccatcctgatgcccttcttcaacagcatcctgggaatcctggggagcatcgcgttctggccgctcaccgtcttcttccccgtcgagatgtacatccggcagcggcagctgccgcggttcagcgccaagtgggtggcgctgcagagcctgagcctcgtctgcttcctcgtcaccgtcgccgcctgcgccgcctccatccagggcgtcctcgactcgctcaagacctacgtgcccttcaagaccaggtcctgattcgacctcgccgtagtgcgttagtgtatactctcggtttgattccatatggatatgggggaataatgatttactacagtcgttttggactctctgaggtgcagctttatctgaagattttatgagaaggatttagcttaaaaaaaaaaaaaaaaaaaaatattatggtgttaaaaaaaaaaaaaaaaaaaaaaaaaaaaaaaaaaaaaa

SEQ ID NO: 3333 - DNA, 714 bp, Oryza sativa
  Clone ID: PAT_MRT4530_61692C.1
gttgattgggcgatgtggtagttgcatactagtcgtcctttcttcccttgtcacctttggcggcctcggcttgcttaaaaggatacatatgcttttgtaactagaacatttgttgttgaatttggattatttgatcccatggcgaattctcgggctagccgtttcaagatgtctaatctatcagagccctcaaaagaagctgcatcagctgatgattcaagtgctgtccagaaaactggagcatggagtaacacgttgaacattcttctgcaacaagcttcagtctatggtgtggctgctggttattgcctgtcagcatccctgctctccattatcaacaaatgggcagtcatgaaatttccataccctggagcattgacagctttacagtacttcactagtgttgttggagttctcttatgtggacaactaaagcttattgagcatgatggccttaatttgaggaccatgtggaagttcttgcctgctgcggtgatgttctacatctccatcttcacaaacaatgaacttctactccatgccaatgtggacactttcatcgtgtttcgctcagctgtgccaatttttgtggccattggagagaccctttatcttcaccaaccatggccatcactcaagacatggctttcactttcaactatacttgggggaagtgtgatctatgttttcacagacaaccaagtcactgtgact

SEQ ID NO: 3334 - DNA, 1063 bp, Oryza sativa
  Clone ID: PAT_MRT4530_62143C.1
ggtttacaggggtcctcgttaccatgcagcggcggcattcatcctcggattctggctgctcgacttctccaacaacaccgtgcagggtccagctcgcgctctgatggccgatttgtcaggtcggcatggcccaagcgcggccaacgcgatcttctgttcttggatggcattaggcaacatccttggctactcctccggatccaccaatgactggcacaagtcggtgtttttggggttgtcgacggcggtgacgatggtgtttgcgagggaggtggcgctggacccagtggcggcggcgaagcggaacgagggtgaggcgtcggggctcctcgccgtgttcaaggggatgaagaacctccccgtcgggatgccgtcggtgcttatcgtcaccggcctcacctggctctcgtggttccccttcatcctcttcgacaccgactggatgggccgcgagatctaccatggccgcccggacggctcccccgccgaggtcaccgccttccaagagggtgtccgccaaggcgccttcggcctcctccttaactcgatcgtgctgggcatcagctcgttcctgatcgagccgatgtgccgtcggctgggcgcccgcgcggtgtgggtgatgagcagcgccgtcgtgtgcgtcgccatggcggccgtctccgtgctcagcgcgtggtcgctcggcgacttcggcggctcggtgcaggacgcagcgcgggcgccggcggaggagggcggcgtcagggcgtcggcgctggcgctcttcgtcttcctcggcctccccttcgccgtcctctgcagcgtcccgttcgccgtcacggcgcagctcgcggcgagccgcggcggcgggcagggcctctgcaccggcgtcctcaacatctccatcgtcgtgccgcagatggccatcgccctcggcgccgggccctgggacgagctgttcggggaggggaacatcccggcgttcgccatggcgtccgtgttcgccgccgcggccgccgccgccggcgtcgtcttgctgcccaaggtctccgtccgctccgtcagcatggccggcggccactga

SEQ ID NO: 3335 - DNA, 1713 bp, Oryza sativa
  Clone ID: PAT_MRT4530_62144C.1
cttcgatctcttgggatataactagcttagctatagctctagctaaataggttcgtacgtataggatatttgatccattgatcgatggccgtcgacatggagctcgacggcggtggcgacggcaagggcaaagccccgccgcagataagcctgtcggggctattccttgcgtgcatggtcgccggtggcgtgcagtacggctgggcgctgcagctctctctcctcaccccgtacgttcagacattgggaattcctcatgcactcacttcagttatgtggctctgtggccctattgctggcttaattgttcagccatgcgtcggcctgtacagtgacaagtgcacatccagccttggaagacgtagaccgttcatcctcactggatgcataatcatctgcatatctgtgatcgtcatcgggttctcctcggacatcggctacgctctcggcgacacgactgaggactgcaaggtttacaggggtcctcgttaccatgcagcggcggcattcatcctcggattctggctgctcgacttctccaacaacaccgtgcagggtccagctcgcgctctgatggccgatttgtcaggtcggcatggcccaagcgcggccaacgcgatcttctgttcttggatggcattaggcaacatccttggctactcctccggatccaccaatgactggcacaagtggtttccctttctcatgaccagggcttgctgcgaggcctgcgcgaatctcaaagcggccttcttggttgcagtggtgtttttggggttgtcgacggcggtgacgatggtgtttgcgagggaggtggcgctggacccagtggcggcggcgaagcggaacgagggtgaggcgtcggggctcctcgccgtgttcaaggggatgaagaacctccccgtcgggatgccgtcggtgcttatcgtcaccggcctcacctggctctcgtggttccccttcatcctcttcgacaccgactggatgggccgcgagatctaccatggccgcccggacggctcccccgccgaggtcaccgccttccaagagggtgtccgccaaggcgccttcggcctcctccttaactcgatcgtgctgggcatcagctcgttcctgatcgagccgatgtgccgtcggctgggcgcccgcgcggtgtgggtgatgagcagcgccgtcgtgtgcgtcgccatggcggccgtctccgtgctcagcgcgtggtcgctcggcgacttcggcggctcggtgcaggacgcagcgcgggcgccggcggaggagggcggcgtcagggcgtcggcgctggcgctcttcgtcttcctcggcctccccttcgccgtcctctgcagcgtcccgttcgccgtcacggcgcagctcgcggcgagccgcggcggcgggcagggcctctgcaccggcgtcctcaacatctccatcgtcgtgccgcagatggccatcgccctcggcgccgggccctgggacgagctgttcggggaggggaacatcccggcgttcgccatggcgtccgtgttcgccgccgcggccgccgccgccggcgtcgtcttgctgcccaaggtctccgtccgctccgtcagcatggccggcggccactgatcactactagtctatcaccctttttttttccgtggttttaaatctcccgctatagctgctgctatctccagttagagcgggtactatagcaggctataagccagctgt

SEQ ID NO: 3336 - DNA, 3062 bp, Oryza sativa
  Clone ID: PAT_MRT4530_62177C.1
atgcggggtggggaggaggaggaaaggcggctgggcgaggaggaggaggtcgtcgagaaaagctggaaagctctgtggaagatcaatgcacctgggaagatgaagataaacctctggcgtgcagtccaagattgtttgcccactggcttccagctgagaaggcgtcacattgattctaatgacggctacgttttctggaagcaaggaacaatgcaagaaatgggattagcgccctgcatcctcggcgcgtggctcagaagcgaacgagtgaacaacatcgtcctccctgaaatggctgaggcactggctattcgtcgggcactagtactggcaacagaagagggtttccagcaggtgttggtagcctctgattgcatcttccccggcgccgccgtatcgagcctgttctcccaccacggcgccatcgcatcgaccccggtgcggctgccgccgcaacgaggctgccgcatccagcccgccgtcccgcggccgccgtctcatcgagacagccgcggcgccatcgggttggccgcggctgctgccggacacccaggctgccagacgaggtgcggggacgtcgacatcccgttccccttcggcatcggcgatcactgcgcgattcacgagggttttcggctcgagtgcgacaacgccacgaaaggcaccagcaatcagaagcctttctggggggacttcgaggtgatcaagatctccatggaagacggcaaggtctgggtgaaggcgtacatgtccaggcagtgctacgaccaatccacgggcggtatgtcatacagcgacgcatcggcgaatttgagtggttcatctttctggttatcggacacggataacaaaattaccgtgatcggatgcaagactctcgcctacatgacgaccgattctgcaaatgttcctaagagcatacagtactaccagggttatttcaacgaaggctacaacaccactaaaatatggatgagcagcccttgcagctacatggcagtgatggaaaccgcagcattcaactttagcacaagttacctcacatccagcgtattttatgacacgtacaaggggggagttccggttgtctacgactgggccataacatcaaaaacatgtacagaatctagaagaaacaagacttcctacgcatgtattagtaacaacagtcagtgcattgacaacctgacgaatgcacaaggttaccgctgcaagtgctccaatggatatgaaggcaacccgtacataaaggatggttgcaaagatattgatgagtgcctcaacaatgctacttacccttgcaaggggatatgcaccaacacgttggggaatttcacctgctcatgctccccaggaagttatatgatgaatggagattgcgcaagtatcatatctgttgtcctggaagcaacaaataggttcaatgaacaacagattcttgggcaaggaggccatggaactgtttacaaggggcttctgaagggcaacatggaagtagctgtcaaaagatgcatgacaatcaatgagcatcagaagaaagaatttggtaaagaaatgctaattttatctcaaatcaaccacaaaaatattgtcaaactattaggttgttgtcttgaagtagaggtccctatgctagtatacgagttcatcccgaacggcacgcttttcgatctcatccatggtaaccatggtcagcagatctccctggccactcgtcttcagattgcccatgagtcagctgaggcacttacttatctccattcatgtgcttcaccaccaatccttcatggtgacatcaaatcatccaacatcctccttgatagaaacctgatagcaaaggtttcagattttggtgcttccattctagcaccaacagatgagtcacagtttgtcacactggttcaaggaacttgtggatatcttgacccagagtacatgcagttgtgtcaattaacagataagagtgacgtatatagcttcggagttgttctcgtagagcttctcacatgccagaaagcgttcaacctcaatgcacctgaacatgagaaaagcctatcgatgaggtttctcaatgcaatgaagaataacaagcttgcagatatattagatgaccagatcaagaatagtgagaatatgccatttctcgaagagattgcagagttggcagcacaatgcttggagatgtctggtgtgaataggccatcaatgaagcacattgcagataatcttgacaggctgagaaaggttatgcaacatccatgggcagaacagaattcagaagagttggagagtttgcttggagaatcgtccatggtcagctcaagactttcagtagctaccttccaattccagcttttccagggattttccccagtcctccaagccgggttctcggtggtgaagggctaccacgaggggttcccctgcacccatcaccgcttccttcggctccttcgccacaggagggcgctggggtttgtgcttcaagatgttctcgcgcccctgcttgaagtggcggcgctgcgttcaggacctttcatctggccggctcctgacactgtcgcctttctcactcccggtgatggcgcggataggggtggcggcggcgcgaagggagggggggaaaggttcatggggtttcggagcgacggcgaccggaaagcgatgagggcggctgggcgagaggcggaggtcgtcgatggtggcaccggcgacgacgtcgacttcaagctccacacctgctgccaccatcgctcgctcgttcacacaggaatgacactggtggtgtgtgaaaaatcgtggcatgggcgaggacgcgtgagaggatggggaaggaagcaatccttgccattccacctcttcctcactggacagaggtcgacagggccgtcaggtccaccgggctgggacggtgccgacagcagggacgtggggaagaggaaagggccggccgccacccttcaccggaaccgctgctcaagctctgtgccccactaccacctcgtcaagctccggagctcgtccatcgctggcctgtcgacctccggagctccgagaggctg

SEQ ID NO: 3337 - DNA, 1090 bp, Oryza sativa
  Clone ID: PAT_MRT4530_62336C.1
gcccgcacgagacatcgtcaccgatcgatcccggccattccacggtcgatcgatcgtctccggccggccggtcgccggtgggaattgaagcagctagctgacatacatacatggcgggcgtgtgggtgttcaaggacggcatcgtgcggcgcgtggagaaccccggcagcgaggaatcgtcgtcggcgggggacggcggcggaggcgggcggcggaaggtgctggtgcacgtgccgagcggggaggtggtggcgtcatacgaggtgctggagcggcggctgcgggagctcgggtgggagaggtacctcaccgacccgtgcctcctgcagttccaccagcgctccaccgtgcacctcatctctgtcccccgcgacttctccaagttcaagctcgtccacatgtacgacatcgtcgtcaagacccgcaacgtcttcgaggtccgcgacgccgctgcccccgccgtctcaccggcgacctagctgctgatccgagatccatccatccatcgatcagacgacagcttatagctacagcagtccacatgagcttgcctgcctgctattataagagtgtaagtatgtatatatatactggtatgcgtgtgatcgatcaaggatcgatgtacacacaaatgatcagcatgcacagatcactagatcgagatctatagctcgatcgatttggggtttctcctgccggcgttgcagcttttggattagatgttgcgccggtgaggacattgctataggttaattggcttttgggtatatttctgcataaataatgcatcaatagagagcacaacatgtgtatgcatacttatatttatatgtacacatgcatacatatataagtacatacataggggccgggggcaacatgcaggttgcagagattctgccagagatcaagcagaaaggggatcgccgatgccctactctcaaccgtacctttttactgtttaatttggaataatttggattgtctcaatacaaattatgtaccagttttttcacatatgatttgcacgacattttaaatattgtaatctgtacacataatattgatcggtctctctttccctgtggcc

SEQ ID NO: 3338 - DNA, 1181 bp, Oryza sativa
  Clone ID: PAT_MRT4530_62420C.1
cccacccactccaggctcaactcaactccacccgaatccgcaagagagagagagagagacgatggcggcggcggcgggaggagggacgagggaggagatggtgtacatggcgaagctggcggagcaggcggagaggtacgaggagatggtggagttcatggagaaggtggtgacggcggcggcggcgggcgggggtggggagctcacggtggaggagaggaacctgctgtccgtggcgtacaagaacgtcatcggcgcgcgcagggcgtcgtggcgcatcgtgtcctccatcgagcagaaggaggaaggccgcggcgccgcgggccacgccgccgccgcgcgctcctaccgcgcccgcgtcgaggccgagctctccaacatctgcgcggggatactccgcctcctcgacgagcgcctcgtccccgccgccgccgccgtcgacgccaaggtcttctacctcaagatgaagggcgactaccaccgctacctcgccgagttcaagaccggagccgagcgcaaggacgccgccgacgccaccctcgccgcctaccaggccgcgcaggacatagccatgaaggagctgtcgccgacgcaccccatcagactgggccttgcgctcaacttctccgtgttctactacgagatcctcaactcgcccgaccgcgcgtgcacgctcgccaagcaggccttcgatgaagctatttcggaactggatacccttggggaagaatcctacaaggacagcaccctgatcatgcagcttcttcgcgacaatctcactttgtggacttctgatatgcaggacgatggaggtgatgaaatgagggatgcaaccaagcctgaggatgagcactagctaaagatcctagtgacagtcgtctgtctcttaaccgctgggggtagttatgatgcttgtacaaggaccattttcttgtgtcctttcgtcgggtctttgcttaccctttgtttacttatattgctatcgccatcctcatgtattatttgttactttcctgctggaatcctgctcgtgtgtgggagagtgcctcaagcctttaactaggacaaggattgtcaactcttgtttactatgattgaatggctatgcttgttcgatatttaaaaaaaaaaaaaaaaaaacgagaaaaaaaaaagaccaggccgcctgccgtgtcctgcag

SEQ ID NO: 3339 - DNA, 1138 bp, Oryza sativa
  Clone ID: PAT_MRT4530_62783C.1
tttttttttttttttagatggaagatttatgatgtatatatgaattgatttgatgttataacagcaggggcaccaagggcaggagtactgctgatgaaccactgcattgcctcttcatcaagaactgcctcttgccccatttccacctgcctctcccgcttcctggcaatctgccgccgccgccggtgatgtccatgcctgaacagcctcactgacgctgtgttgcttcgcctgcttgtaatttggcttctcgtcgccggtggcctgccgccgtgtttgttcttcttgcagtcgatgaagagcagcttgtcggggccatactgcctgagccggagaaggccacggtgtcgcctggtcggaggcccttctccctcacgaatcggctccaccccttggtgagcacgtaactctggctgctgttccagtacgagtaccggaatcgccacaccttgccgtcgccgtcctcgaagttgaggagcacgcccttgccggcggcgtcggagctgtggcggcggagcgggaacgggaaatgcctctcggcctgctgcttgggcaccacgaggcggttgagcttgccgacgtcgctcggcgtcacggccttctcgaacagcggctcgcgcgcccaccgcggcgtcggctgcgcgcgcgagccgcggcggaggccctgctggagctcgtcgtcgtaggtgtgcttccgcagcatgtccacgacctccgccttggagtgcgcggccaggaacgcgagctcgccggcggacgcgccctccgccgccggggcgcggttggtgacggcgtcgcgcccccggaagcggagcgccgccacgtcgtaggcgcgcgccgccgcctcctcgtcggggaacgtcccgagccacacccgcgcgtgccgctcgtagatctgcgccccccaccgcccgttcggctgcggcaccacccccttgtaccgcgacgacggccgcgtcgccgtcgtcgacgacggcagccgcagctccgccgcctggacgacgtggatcaactcgtcttcctccattgcggccaactcctcctcctcctcctcctcttgctttgaatcggtcgtcgacgacgacccaccggagccggagttgcaggagaagacgaccatggcagcttcttgctccat

SEQ ID NO: 3340 - DNA, 266 bp, Oryza sativa
  UNSURE (1)..(266): unsure at all n locations
  Clone ID: PAT_MRT4530_62821C.1
  unsure (1)..(266): unsure at all n locations
gaccataacaataaacacctanaaaaagggggacagaaaaacaggaagcgccaccaagcagttcaagaggctcccccacccccaaccagtcctggctccacaaacccccacctgttttgctactagtagcttaaatgcgaaactgcataaccatctctagcaacctcacatacagtggagccccatatttcccaacaacaattacaaccacataggtttcattacacagtagctaatcactatctacaaacttctaagtcacataa

SEQ ID NO: 3341 - DNA, 2624 bp, Oryza sativa
  Clone ID: PAT_MRT4530_63568C.1
atgggcgtatgcggtatgaacactcagaacattaaagattttactttctttcaaaggcatctactggagaccccaagcttcaagagctatatcatcaaaggttttggtttttctactcctcggtttttggagatacgcttcttaaggggtttgttcggatcagctagacagtggctgtacagccgcagtgctgcagttgttttagtacaaatttacttggtagatcctgttggtgtggctgcagcgcagccactgctagctcttccgaacacagccataataaaagattttgttggtttttgccacatcgccaccacatcatcaagtccaaagactggacagggccacgagcccacgacgtgtttcaggccggtccttctggcaccttctcccctctgcctgacacgtgggccccacaccatcacccaccaaattgaggccccacaggctgatcatgttgaggattcagtttcatcacccaaatacgtgaaacctgccgttgcgaagcaaaatggagaggttgtgagcagagctaccaaatctgatgcaccagtgtctaaacccaaagttgacccgtcagttcctgcttccaaggctgaagctgatggtaatgcacaagctgtggaatcgaaggctgcactggacaagaaggaagacgtcggtgttgctgaaccgttggaagctaaggctgatgctggtggagatgcaggtgcagtaagctctgcagatgatagtgagaacaaggaatctggtccattggcagggccaaatgtgatgaatgtcattgtggtggcttctgaatgttctcctttctgtaaaacaggtggtcttggagatgttgtgggtgctttgcctaaggctctggcaagaagaggacatcgtgttatggttgtgataccaagatacggagaatatgcagaagccaaggatctaggtgtccgcaaacgttacagggtagctggacaggattcagaagtgagttattttcatgcttttatcgatggtgttgattttgtgtttctagaggcccctccctttcgacaccggcacaatgatatttatggaggagaaagatttgatgttttgaagcgtatgattttgttctgcaaagctgctgttgaggttccttggtttgctccatgtggtggttccatctacggtgatggcaatttagtcttcattgcaaatgattggcatactgcacttttacccgtatatttgaaggcatattacagagacaatggcatgatgcagtacactcgctctgtccttgtgatacataatatcgcttaccagggccgtggcccagtagatgaattcccctacatggaattgccggagcactacctggatcacttcaagctgtacgaccccgtcggcggcgagcacgccaacatcttcggcgcgggcctgaagatggcggaccgggtggtgaccgtgagccccggctacctctgggagctgaagacaacggagggcggctggggcctccacgacatcatacgggagaacgactggaagatgaacggcatcgtgaacggcatcgacttgggggagtggaacccggaggtggacgtgcacctgcagtccgacggctacgccaactacaccgtggcgtcgctggactccagcaagacgcggtgcaaggaggcgctgcagcggcagctgggcctggaggtccgcgacgacgtgccgctgatcgggttcatcgggcggctcgaccaccagaagggcgtggacatcatcggcgacgcgatgccgtggatcgccgggcaggacgtgcaggtggtgatgctgggcacggggcggccggacctggaggagatgctgcggcggttcgagtcggagcacaacgacaaggtgcgcgggtgggtggggttctcggtgcagctggcgcaccggatcacggcgggcgccgacgtcctcctgatgccgtcgcggttcgagccgtgcggcctgaaccagctgtacgccatggcgtacggcaccgtccccgtggtgcacgccgtcggcgggctcagggacaccgtgtcggcgttcgacccgttcgaggacacgggcctcgggtggacgttcgaccgcgccgagccgcacaagctcatcgaggcgctcggccactgcctcgagacgtaccgcaagtacaaggagagctggagggggctccaggtgcgcggcatgtcgcaggacctcagctgggaccacgccgccgagctctacgaggaggtccttgtcaaggccaagtaccaatggtgaagagaccatgtccgcccgcggtctccgcctgcgcgttcggcagctatagctatagcctccctgaagaagcttggcgctgctgtggaggtgcgactcggtggcggtgtggcgccggcgccggcgcttgcaggggaggtgtttgtgctgaccgagctgtgcgttgaggtgcgcaaattagcttccggtttgtgtgttcatggcgaggcatggtggagttgagggagtattaagctttgtttcagatgcatcatgcatgcgtaataggatgttgtatttaataatgtgtttgttatgtccattgatgcgatgttacttcttcattaaaaaaaaaaaatgaatggatgtgacttgtgagcaaaaaaaaaaaaaaa

SEQ ID NO: 3342 - DNA, 2528 bp, Oryza sativa
  Clone ID: PAT_MRT4530_63570C.1
ggaggaggaggagcggcggcggcggcggatcctatgtcgggggcaatcgcttcctcgccggcggctactctcttcctcgctggctcctcctcctcttcgccgcggcgcaggcggagcagggtgagcggggtttggtggcacttgtatggtggcacggggctgcggttgcattgggagcggcggggtttggttcgggacggagccgtcgtgtgctcggcgtcggccgccggtggtgaggatggcgtcgcgaaggcgaagacgaagtcagcggggagctcgaaggcggtcgctgtgcagggcagcacggccaaggctgatcatgttgaggattcagtttcatcacccaaatacgtgaaacctgccgttgcgaagcaaaatggagaggttgtgagcagagctaccaaatctgatgcaccagtgtctaaacccaaagttgacccgtcagttcctgcttccaaggctgaagctgatggtaatgcacaagctgtggaatcgaaggctgcactggacaagaaggaagacgtcggtgttgctgaaccgttggaagctaaggctgatgctggtggagatgcaggtgcagtaagctctgcagatgatagtgagaacaaggaatctggtccattggcagggccaaatgtgatgaatgtcattgtggtggcttctgaatgttctcctttctgtaaaacaggtggtcttggagatgttgtgggtgctttgcctaaggctctggcaagaagaggacatcgtgttatggttgtgataccaagatacggagaatatgcagaagccaaggatctaggtgtccgcaaacgttacagggtagctggacaggattcagaagtgagttattttcatgcttttatcgatggtgttgattttgtgtttctagaggcccctccctttcgacaccggcacaatgatatttatggaggagaaagatttgatgttttgaagcgtatgattttgttctgcaaagctgctgttgaggttccttggtttgctccatgtggtggttccatctacggtgatggcaatttagtcttcattgcaaatgattggcatactgcacttttacccgtatgtttgaaggcatattaccgagataatggcttgatgcagtatactcgctctgttcttgtgatacacaacattgctcatcagggtcgcggccctgtagatgacttcgccacgatggacttgcccgagcactacatcgatcatttcagactgtacgaccccgtcggcggtgagcacagcaacgtgttcgccgctggcctgaagatggctgaccgcgcggtcaccgtcagccatggctatctgtgggagatcaagacaatggacggtggctggggcctccacgagataataaaccacaacgactggaagctgcagggcatcgtgaatggcatcgacatggccgaatggaaccccgaggtggacgagcacctgcagtccgacggctacgccaactacacgttcgagacgctggacaccggcaagaaacagtgcaaggaggcgctgcagcggcagctgggcctgcaggtccgcgacgacgtgccgctgatcgggttcatcgggcggctcgaccaccagaagggcgtggacatcatcggcgacgcgatgccgtggatcgccgggcaggacgtgcaggtggtgatgctgggcacggggcggccggacctggaggagatgctgcggcggttcgagtcggagcacaacgacaaggtgcgcgggtgggtggggttctcggtgcagctggcgcaccggatcacggcgggcgccgacgtcctcctgatgccgtcgcggttcgagccgtgcgggctgaaccagctgtacgccatggcgtacggcaccgtgcccgtggtgcacgccgtgggcgggctccgcgacacggtggcgccgttcgacccgttcgccgacacggggctcgggtggacgttcgaccgcgccgaggcgaaccggatgatcgacgcgctcgggcactgcctcaacacgtaccggaactacaaggagagctggagggggctccaggcgcgcggcatggcgcaggacctcagctgggaccacgccgccgagctctacgaggacgtcctcgtcaaggccaagtaccagtggtgagctggtggtatttttcgcgacgcctctggatcccgccgtggatgggcgcgctttttctctagggcggctctgcgtcggagacgctcagacgcatcgcgcgcgttcgcgcccacacgatgactggcacgctgctgctgagacggcggcacgcgatgccatcatgccaccggacggtaggagcaacggtggaagtgaactgtactactggtgctacactgctactacatgagatctgctcttattggtcacgtactcacgttcacgctgaattaccgaatgtgttgtgtcttgtgtgtgtgtgttaaaaggcattgtcctggtaaatggtggagacgagatggccgggtcgcgggagttatatttgtatatgttgccagctttctgagtttttaaaaaaaaaaaaactcttc

SEQ ID NO: 3343 - DNA, 1832 bp, Oryza sativa
  Clone ID: PAT_MRT4530_63782C.1
atggacgtggagaaggtggagaggaaggaggtggccgtcgacgacgatggccgcgtcagaacagccgcgctgatatggcaatctcttcaatgcactgcatctttattgatgttcatgcttaatcagccaggtgttccaagagaccaagaaggcaagaatgtcacacgaacggtatggacggcgacgacgcacgccatcaccgccgtgatcgggtcaggcgtgctggcgctgccgtggagcgtggcccagatggggtgggtgctcggccccatcgccctcgtcgtctgcgcctacatcacctactacaccgccgtcctcctctgcgactgctaccgcacgccggaccccgtccacggcaagcggaactacacctacatggacgtcgtccgctcatgcctcgtacgcgattctctggggcgcaatggtgggttacaccatcacgaccgctacgagcatcatgatttgggccgtgagaatgcaggtcagtggtgcgcacgaactgccaccactacaagggggccggacgcgacctgcggctcgtccgggacgatgtacatggtgctgttcggcctcgcggaggtcgtcctgtcccagtgcccgagcctggagggggtgacgctcatctccgtcgtcgccgccgtcatgtcgttcacctactccttcgtcgggctcttcctcagcgccgctaaggtcgcgtcgcacggcgcggcgcacggcaccctcctcggcgtcagggtcggcgccggaggcgtcaccgcgtcgaccaaggcgtggcacttcctgcaggcgctcgggaacatcgccttcgcgtacacctactccatgctgctcatcgagatccaggacacggtgaagtcgccgccgtcggagaacgtgacgatgaagagggcgagcctgtacggcatcggcgtcacgaccgtcttctacgtgtcgatcgggtgcgtcgggtacgcggcgttcggcaacgccgcgcccgggaacgtcctcaccggcttcctcgagccgttctggctcgtcgacatcgccaacgttgccgtcgtcatccacctggtcggagcgtaccaggtgtacgcgcagccggtgttcgcgtgctacgagaagtggctggcgagccgttggccggagtcggcgttcttccaccgggagtacgcggtgccgctgggcggcgggcgcgcggtgcggttcacgctgtgcaagctggtgctgcgcacggcgttcgtggccgtgacgacggtggtgtcgctggtgctgccgttcttcaacgccgtgctcgggctgctcggcgccgtcgcgttctggccgctcacggtgtacttcccggtgaccatgtacatggcgcaggcgaaggtgcagagaggcagccggaagtgggtggcgctgcaggcgctcaacgtcggcgcgctcgtcgtgtcgctgctcgcggcggtgggctcggtggccgacatggcgcagcgcctgcgccacgtcaccatcttccaaacgcagctctgaacccggatggacgcatgcagccgatgagattatgcatgtagtactactcctactacttttgttgctgtactcgtactagttgctggtgtaatttggctgtcgtgttacaagctactactactagtacaagcccctctgtttttatacctctgaatttagcaaatgggacttgaggagtatggttatcctatggacaaaactgtgtacgttattccggttgggatcgtcaagcatagcatataggaatttcgggtgaaagaattcaattatgagtattagcaccttttgtatttagaacttatttctgaaagcaactaaagttaaaaaaaaaaaaaaaaaaa

SEQ ID NO: 3344 - DNA, 1478 bp, Oryza sativa
  UNSURE (1)..(1478): unsure at all n locations
  Clone ID: PAT_MRT4530_63823C.1
  unsure (1)..(1478): unsure at all n locations
gcacatactacaggattgaaggacacagccagcccacgcaggcccgccgccgcgctcgcccagcccgccgccacaccctcctcgcccccccccacacggagcccccgcccccgtcgcctgccccatcgccgccgccatggacccttcggcgccgtccggtagctccgccgacgcctcggcgtcctcctcttcttccgccgtagaggacctcgccccgggcatggcggccatgagcctccaagaccggttcgagttgctgcggggcatcggcgaggagtgtatccaggaggacgagctcatgaatctgctgcagaaaaagcccgtccccatctgctacgacggatttgagccctccggccgcatgcacattgcccagggcattgtgaagacaatcaatgttaacaagatggtcagggctggatgcaaagtaaaaatttggatagcagactggtttgctcagctcaacaataagatggggggtgatctaaaaaaaatccagactgttggacggtacatgattgagatttggagagcagctggtatgaatcttgatggtgtggaattcttgtggtcctcagaagaaatcaataatcgtgcaaatgaatattggccacttgtaatggacattgcctgtaaaaataatgtcaaaagaataatgagatgttgtcagattatgggtcgaaatgattcggatgagttgacagctgcccaaatattctatccttgtatgcagtgtgctgatatatttttcttgaaggcagacatttgccagttgggcatggaccaaaggaaggctcaggtaaatttgaagataaaacaagcattttgccctcccaacgtggttgatgggaacccatgcttggagtacatcaagtatattgttttcccttggtttgaaatgtttgaggtggttcggaaggaagcaaatggcggtaacaagacatttacaaacatggatgaactcatcgatgattataagactggtgctttgcatcctgctgatgttaagccagctctagcaaaagcaataaaccaaatattgcagcctattcgtgaccacttcaataacaacagtgaagcaaagattctgcttaacactgttaagaagtacagagtaaccaactaaggaggaaactagttcaagcatctttgtcctattgatctacctggatattttctatggctactttggaaccatatgaacctaatatttaatggaggaattttgtttgccatttttttgtttttgtttttttatgtactgagttgcagagcaaccattgcatggtactgcacaaactttgtttagattattagttgtcagatacccaatctcgttttatcagtatggtgcaatgaatgttcatgatcaccttaatgttatagatttgacaagacaaagtcgagtgcaaatgcaaacatatggtggaaatgcatttgattttattccgggaaaaaaaaaaaaaaaaaaannaaaa

SEQ ID NO: 3345 - DNA, 889 bp, Oryza sativa
  Clone ID: PAT_MRT4530_63826C.1
cggacgcgtgggtgtggctaccgagttcatttaagggcattgtgaagacaatcaatgttaacaagatggtcagggctggatgcaaagtaaaaatttggatagcagactggtttgctcagctcaacaataagatggggggtgatctaaaaaaaatccagactgttggacggtacatgattgagcccacgcgtccggctggtatgaatcttgatggtgtggaattcttgtggtcctcagaagaaatcaataatcgtgcaaatgaatattggccacttgtaatggacattgcctgtaaaaataatgtcaaaagaataatgagatgttgtcagattatgggtcgaaatgattcggacgagttgacagctgcccaaatattctatccttgtatgcagtgtgctgatatatttttcttgaaggcagacatttgccagttgggcatggaccaaaggaaggtcaatgtgctagccagggagtactgtaccgacatcaaaaggaaaaacaaaccgattattttgtcacatcacatgctccctggttttaaggagggccaggaaaagatgtcaaagagtgatccatcctcagccatttttatggaagatgacgaggctcaggtaaatttgaagataaaacaagcattttgccctcccaacgtggttgatgggaacccatgcttggagtacatcaagtatattgttttcccttggtttgaaatgtttgaggtggttcggaaggaagcaaatggcggtaacaagacatttacaaacatggatgaactcattgatgattataagactggtgctttgcatcctgctgatgttaaaccagctctagcaaaagcaataaaccaaatattgcagcctattcgtgaccactttaacaacaacagtga

SEQ ID NO: 3346 - DNA, 453 bp, Oryza sativa
  Clone ID: PAT_MRT4530_6392C.1
ctgtctctggtgtgctctctttccttgagaaccacagtttgcattcagtgtaatagtgaagcaggtgctggggctatcaccagaggagccggtcactgccatgatacttgaagatttcctcgccttcatgaagggtctcatctctttccctctctacatcccagggacgccctatgccaaagcataataacttcatccttttgtccgcgaatcctcacaggccagagcgaggatatcaagcactgtgaagggtattattgaggagaggaggaatgctggctccagcaacaagggtgatttccttgatgtgctgctttcaagcaatgagctctctgatgaggagaaagtgagctttgtgctggattccttactgggaggatatgagaccacctcactcttgatctccatggttgtgtatttccttgggcagtcagctcaagatctggaactagt

SEQ ID NO: 3347 - DNA, 1282 bp, Oryza sativa
  Clone ID: PAT_MRT4530_64041C.1
agcaagctgcacagagctagcgttagcttggttagttgttcttagcattctagctagctcaatggcgaaagacattgaggcgtcggcgccggagggcggcgagttctcggcgaaggactacaccgacccgccgccggcgccgctgatcgacgtggaggagctgaccaagtggtcgctgtaccgcgcggtgatcgcggagttcatcgcgacgctcctcttcctgtacatcacggtggccaccgtgatcgggtacaagcaccagtcggacgccaccgtcaacaccaccgacgccgcctgcagcggcgtcggcatcctcggcatcgcctgggccttcggcggcatgatcttcatcctcgtctactgcaccgccggcatctcaggtgggcacatcaacccggcggtgacgttcgggctgttcctggcgaggaaggtgtcgctgatcagggcggtgctgtacatcatcgcgcagtgcctgggcgccatctgcggcgtggggctcgtcaaggggttccagagctcgtactacgcgcggtacggcggcggagccaacgagctcagcgacggctactccaagggcaccggcctcggcgcggagatcatcggcaccttcgtgctcgtctacaccgtcttctccgccaccgaccccaagcgcaacgcccgcgactcccacatcccggtgttggctcctctcccaattggattcgcggtgttcatggtccatctggccaccatccccatcaccggcaccggcattaacccggcgaggagcttgggagccgcggttatctacaacaaggacaaggcctgggatgaccaatggatcttctgggtgggccccctgatcggcgccgccatcgccgccgcctaccaccagtacgtgctgagggccagcgccgccaagctcgggtcctaccggagcaacgcctgagatcggcggcggcggcgcgcgcgaggtggcgctgaagtgtagatacgcgtacaagatggccgcctctgtccagcactagatcaacgaattcagccttcgcatcctgcatttcgcctcgtggatagattctactgcactattatgtactatgtatccatgcatatggtctccattcctttgaactatgtccgccatatgttgcttcccgctggtgcttccaagtttggttaattttccttcacattctgcatgtatgtaatattcatatggagaatttgtgaatttgaagatcatagttactattatgtgcgatttattaagtactttctgcatgcttgtctgtggagatgtaac

SEQ ID NO: 3348 - DNA, 3600 bp, Oryza sativa
  Clone ID: PAT_MRT4530_64237C.1
tcatcgtcgcttggcgagctggaacgtgcgcttcagaaactggctggcggcctcgtcgtcgcggtggcagagcacgcggaggatcgtgttcgcgtcggcggcgtcccaccgcctcgacgtcggcggcaccggcgtcacgccgccgtagccgccgtcgccgtcgtcgccgccgcgccccacggcggcgacgatggactcggacgtggcgacgccgaacgcgtcgatgagggcgtccataacaaaatgctagtaggaactttatacaaagcgaagaaagtacatttccacagaaagacaaaaatatatgccaaacagaaaaggtgtagatattacacatttgaaatttagtgattacagtgaaaagcataggtttgaacaaaaaaataaaaaagcatttgctagagaaagtaacaatgctagtgagagaagctcttctgccagcatatctaatttttacttgaaagttgaaaagcggggaagcttgtgcttcaaataatataactttgctcttctcactttcttgtgcctgattactttaatttccttgatcctgggtgaatatatagggaaggtaatctcaactccgacaccagcaataatccttctgacacggattgtggtgtgaacaccagatttgtgttttgctataattatgcccttaaagagcgacaatctcctcttgttgggccgttgcattctaagctcaatgatgtcaccaggcctaagatctggtaaagtcttcaccttttcagcctcctcaatgaactgtttgttcagaatcccaatgatctccccgaacttaaccgggggcttgctcggcggcggaggctcatcttcttcctcctgctcttcctccgccaccgcgacagccgcctccgcctcaccctcctccacctcagcgtcagtcgaggcagcaacagcctcagcctcagcctcagcggcgggctccggttctcccgcttctgcgctggcgtccgcgcgagggaccaggcggctggcccggcgaggggaggcggtcagggagaggcggcggaatgaggaggacaccgcgaggagctgcggccgcggcggcaagcggtggcatgcgacggcgtgggggagtaacgcaccggagatggcggcggtggcggaggcggcggcggcggcggcggccatcggaaggttacttacggcgggtcgacggaggagccgcgcgccggcgacgccgcggaggtagaggccgtggtagaaggagtggcgcgagtcgaggaacacgaggcggaacgccgccacctcggcgacgcgggcgatcgccgacttcgccgcggcgcgcgcgccgtcgaagcgtggcgacggcgcggcgacgagcgacttgtcgatggcgtggaggtgcgtgaggacgtactcgagcgtgttgaggcggacgtagaggcgctgcgtgccgcggctgatcgacggccgcgggacgtggtgcgagccgccgccaacgccgacgccgcgtgggccgccctccggcgcttggcacgacggcagcaccgtcttcctccacagcttgaagaagcccgagtcctggttgcacctcgtcaatggtggcaacggtgggaggtaattctgcttggccccgcacgaggcgacgaaggagatgtactcttggaagatcgcctcgaggccgtcgacgaggtcttgcaccacctcgtctttcgcgctcgccgggatctcggagaactcttcgacggtatacttagccagcttcatcatctccatcgctgacccggcaaaaggttcatctttggattttggtatccagctctcggtttctttggctctggcgaggcagtccatggtgatcttgaacctgtcgtccatccacaccttgagcaagcccataacgacggaatccacctcgtagggctccatgtcgccgacgatggccttggcccggtcgtcgcggcagtcggcggcgtcctccgccgtcatctgcgccatggccttctccatcctgctcgccgactggagcacgcggacgagctcctccgtgaggatggtcaccttgccgaggtactgcctcagcacgacgccgtagcagccgtgcagggtgaccgccgcgacggccaccggcgccgggtgccaccgcctcagcaccgggctgaagctccgccgctccacgacggcgagctcctccgtgtccctcgccagctgcgtcagcaccacccccggctcgccgtcgccgtcgcccattccgctctcgagaatcttggtgaaggcgttcttcatcgaacacctgatgtagtagtcgacgcggtcaccggcgaaattggcggcgtcgtcggcgtcggcggcggcatcacggtcggcgatgatcttgccggcggcgagcgagatggagaggaggatctccatgacctcggtgggggcgccgccgatgcccttctcgtagctgtcgtggtagtccagcagccgcttctcggaccactcctgcatggcgccgagcgcgccgaggagcgccttgccgtacaccgcgtcgcgggtccccctggcgtcggctgcgacgtcggcgagcacggcgagcgcggcggcggcgagctccggctcgacctggccggtgacgacgtactgctggaagaacgcccacgcgaggcacacgttgtgcacgggcctggtgacgcccagcgtcggccacgtcttcctgatgaggtcgaggagctcgtcgacctcgtcgagcacgacggtgcagtcgcggtggtcgaagatggcgtggaggagcgaggcgtagaggaggacgttgagcgggtagccgtcggcccaatggcaggcgtcgccgccgccgctgccgacgccggagcgccaggcgagggcgtggacggcgctggtgagggtgcgcatggcgtcggagctcttggcggtgtcgatggcgcggatctcggtggcacgcatcacctcgcggaagcggagcacggcggagttgaggcggtcgagggggagggaagggtggaggatgaggccggcctcgaggagcttcacctggcggaactgccactggtggtactcctcgccgtcggcgaactccgccggcttcagttgccggaggagctcgagggggaggacgatggtgtcgggcctcctgccgacctgcccgacgacggcgcgcatcagcgtccgccgcagccgcgcgtcgctctgctcggtcacgcgcatctgctgccgcatgatctccgccgacgtcatcggccgccgcccacgccccggggacgccggccccgacgtctggctcagcgtgcgcaccatcatcggctgcgccaccatcgccgccgacgacgacgacagccgcctcgccttgagccccagcgccttcttgacgcggctgccgccgccgcccctcggcccggccaccggcgacgacacctctgctgcgccggcggtgttcccgccggaggaggagcggcaggacatgaagaagatctcgtaggcggtctcgcggagctcgacggggccgagcgcgtcgacgcgtccgaacgggcagccgacgtcggcggcggcggcgaagtcgagctcggtggcgtcggacgagggcgtcgcggaggaggtcaccgagagggagcccgaacgctggtggcgccccat

SEQ ID NO: 3349 - DNA, 1291 bp, Oryza sativa
  Clone ID: PAT_MRT4530_64414C.1
ggcacgaggcccacatcttattgtcacttccatctcattctcctaattgtcatcactagcttctagctagcttaattaattaattagccatggcggaggagaagcaccaccaccacctgttccaccacaagaaggacgacgagccggccaccggagtagactcctacggcgagggcgtctacacgtcggagacggtgaccaccgaggtggtcgccggcggccaggacgagtacgagaggtacaagaaggaggagaagcagcacaaccacacggagcacaagcaagcaaagccacatcttattgtcacttccatctcattctcctaattgtcatcactagcttctagctagcttaattaattaattagccatggcggaggagaagcaccaccaccacctgttccaccacaagaaggacgacgagccggccaccggagtagactcctacggcgagggcgtctacacgtcggagacggtgaccaccgaggtggtcgccggcggccaggacgagtacgagaggtacaagaaggaggagaagcagcacaagcacaagcagcacctcggcgaggccggcgccctcgccgccggcgccttcgccctgtatgagaagcacgaggcgaagaaggacccggagaacgcgcacaggcacaagatcacggaggagatcgcggccacggcggcggtcggcgccggcggctacgccttccacgagcaccacgagaagaagaaggaccacaagagcgccgaggagtccaccggcgagaagaagcaccacctcttcggctgatcgacctcatcacaacgtcgccggcggcggcgacgacctcgccgtacgtcgccggccgccgtgtcgtcgatttgtgtgtgtaataatttgtcttcttctgcatgcgtggtgttgctgtttttcacaagagtctccggcctcgaccagtgagaggctgacaggtggggccgtgagttcagcttgtgttgcttgattttctctgcagccttgccctctgtgtgtccaaataagtggtgtgcatggctctctccgtgtcatgtatcaatgtatttttatctgtactttgtacaagtgaagcaatatttatcgaaccttgactttctccaaaaaaaaaaaaaaaaaaaaaaaaaaaaagattgcgccgcgcgggctttttcctctccacgttcctgcctccccctcgccccgccttcttcgacggatcgtcccgtcgttctcgctttgctcctcgttcctttcgtttcgcttccctcctctcgttcttttctctctaccgtttttcttt

SEQ ID NO: 3350 - DNA, 196 bp, Oryza sativa
  UNSURE (1)..(196): unsure at all n locations
  Clone ID: PAT_MRT4530_64758C.1
  unsure (1)..(196): unsure at all n locations
gggtacgccttccacgagcatcacgagaagaagaaggaccacaagagcgccgaggagtccaccggcgagaagtaagcaccacctgcttgcggctgatgcgacctgcatcacaacgtcgccgtcggcggcgacgacntcgccgtacggtcgccaggccgccgtggtcgtcgatttgtgtggtggtaagaatttgtct

SEQ ID NO: 3351 - DNA, 709 bp, Oryza sativa
  Clone ID: PAT_MRT4530_65023C.1
cccgggtcccggccgggcctgctcctcaaacgagaccaagaaatcaatcgttccagcgaagaagaagaagaagaaggaggaatccatggcggcgaggacggtggcggtggcggcggcgctcgccgtgctgctgattttcgccgcctcgtcggcgaccgtggccatggccggccggccaacgcctacgacgtctctcgacgaggaagcggctcaggcggcggcgcagtcggagatcggcggcgggtgcaaggaaggggaaggggaggaggagtgcctcgcgaggaggacgctgacggcgcacaccgattacatctacacccagcagcatcacaactaattaatcttatcgatcaatcaataatcaatcaatcaatcagtcgcttcctcttcgatctaccaatactagtattggtatataattaaaactgcaaatccgtcatgcatgcatggtatgcccatcgatccatccatgattatctctagttagatgtagtaacaaactgcatgcgcgtgttgtgctcatcagtgttaattttggccgcccccctgttgataaacagttcttgatcgatgagagctagctttcgttttgttttgatttgttggttggttggttgatttgagagttgagacagatcgatctctgcttgaatggtacctgtcccaatttcagaaaaaaagattctaattacaacgcttctgattgatg

SEQ ID NO: 3352 - DNA, 2430 bp, Oryza sativa
  Clone ID: PAT_MRT4530_6575C.1
ttttttttttttttttttttagtttccagaaccaggaccaccaatggttgatacaaaattctcagtacataaactcacctgataagtttcccctacggtttgggagcatttatgtacaaggaacatgattttaatgactgccaaaaccaggtattcttatacctccaatggtaacaaaccaggacgggagcatgaacaagcaaggagtagtggcacagagtgttccttagtatacatcttcctaggattagatagtagtagagtgggaaatagaagtgcttattccagtacatctcagctaccagtagcttattacggtacatagcagctagccatctagagttctagacccatacaataaccacatatcaacatatcacccaaaaaaggcaagaggcaagaacgaagcagagagataccatatcggtatttacagtcacgcaggatacaaaggaaccacagatcgtgggcagtccgacctcttcccggcaagggagtagtatgcaagtatctgagcttgactatctacacaaggttcaccatcttctctcattcgatttgcattctcagaactgggaggtgtaaactctatgttccagaagggcctggccatgagcatgagatcgtgaccagtcttagaagccttgtagccctgtacccacacgtatctcagggaaggcatactccgtatagcgcaggctaaagcttgctcactgaagcaacaactccttagctcaagcttccgcaggttctcacaccccaatgcaaaccggatcagaccatcatctgtttccccaacattacccagaagcatgtattggataattccactgtactgtccaatatagccaaggcctgtatctgaaagtccccctggtctcaagtatagagcaaacctccgaagtttcgtgcagcccctcagcagtgcacggacaccattgtctaagggcaaatctgttatcctctcttctctatcgagtaggacaagacggaagtcgcaaagatttttgcagaaagtcccaatagactccagggccccatttgtgatatcagacacataggcagctatgtattccagttcacggcatcctacggctacagttgtcaacccgacttgagagactcctccttgttcttcttgcaaacctggatcatcatctcctcgctcaactctgagtctttgtagcttcttgcatgtgtctgcaacaacccctaatcctctatctccaatcacattcctcaccgcaagaactagtaagttgggacattttgcaatgagttggcagtgatcttcagtggtgagaaaagtgtactgcaagtccagcttcttgagtaatgcagagaaagggaagataatgggcatctcgtttgtccccatgtacgtaagtcctaaggagcacagtcttgaagggaatttaacatttccatacttagtgagctccccttgctcaatgaatgcccctcccgcaaactcttgcaatgatgcagccatccggaaaaatccaattaaatctgaaaagtcacagtcactgatcttcaatgaaattagtgacttgcacttctttgcgagaagctccaggtcagctggcaccactgtgagttcggtcatgtggaagttcaatgtctccagaacaggattgttgacagcaaggtcgtggagccattcagtaccattatcagcaattgagcattcctccagaaataatgttctcagtgatctgcaggagagggcgacgaggcggagagcgtcggtggagaagccggagcacttgtcgagcttgagctcctgcagcatgtggccgcgggcgcggacgagcgcggcgaggtcgtcgtcggtgacgaccatgcggcgcaggtggagcgccttgaggcactcgagcggcgcggcgagctcggcgacccaggggcgcgcgtaggcgccccagtcctccgggatgagcccgtacatggcggcgcgcggcttccccttgaccgcgagcgactccagccgcgggaaccgcgcgagcaggtgcgcgggcgacgcggcgtagcagaagggcacggtgacgtgcttccgcgtgagcgcgtcgatgcggtgccagcggcggcacacgagcgacaccgcctccctgtcccgcgggtcgtccacgtaccccagcaccaggtgcagcgcctcctccgggatgctgcccgcgccgccgaagctcatcgcgcggtccaaccgccgcgcctccgccccctcccctcccatccctcccccctcaccccaccaccaccaaccaggcgggagcgcggatcaagcacaccctcctcctcctcctcctcgtcctcgcgcgggatgtggccgggagtggtgcgcaagcatggggattattggatggagaccgcctctctgctgctggtggtggtggtggtggtgaagaggaggagaggggagagaattacctcgtc

SEQ ID NO: 3353 - DNA, 2350 bp, Oryza sativa
  Clone ID: PAT_MRT4530_65929C.1
cggaaatcaacacaagtccaacctcgtacattttcagctagccacaagcaacacaagtccaagacaagtcaagcgttcgcaccaagtcaaaccgcgcctcactgccaccttcgtttgcgcaccatggagcttgccctggttggcaacccttcgaatggcgtggcgaagccgtcgtgcaactccgtcggctcgctgcccgtcgtcagctccaacgccgtcatcaacccgccggtgaccagcgcggcgggcgccacgctcggcaggcacctcgcgaggcgcctcgtgcagatcggcgccaccgacgtgttcgccgtccccggggacttcaacctcaccctgctcgactacctcatcgccgagcccgggctcaagctcatcggctgctgcaatgagctcaacgccgggtacgcggccgacggctacgcccgcgcccgcggcgtcggcgcctgcgccgtcacgttcaccgtcggtggcctcagcgtgctcaacgctatcgccggcgcctacagcgagaacctccccgtgatctgcatcgtcggcgggcccaactccaacgactacggcaccaaccgcatcctgcaccacaccatcggcctcccggacttctcacaggagctccgctgcttccagaccatcacctgctaccaggccgtcattaacaacctcgacgacgcgcacgagcagatcgacaccgccatcgcgacggcgctaagggagagcaagcccgtctacatcagcgtgggctgcaacctggcaggcctctcccacccaacgttcagccgcgagccagtgccactattcatctcgccaaggctgagcaacaaggcgaacttggagtacgccgtcgaagccgcggcggacttcctgaacaaggcggtgaagccggtgatggtcggtgggccaaagatccgggtggccaaggcgaagaaggcgttcgccggcatcgcggagtcgagcgggtacccgttcgcggtgatgccgtccgcaaagggcctcgtgccggagcaccacccgcggttcatcggcacgtactggggcgccgtgagcaccaccttctgcgccgagatcgtcgagtccgccgacgcctacctcttcgccggcccaatcttcaacgactacagctccgtcggctactccctgctgctgaagcgggagaaggccgtcatcgtgcagcctgaccgcgtggtggtcggcaacggcccggcgttcggctgcatcctcatgacggagttcctcgacgcgctcgccaagcgcctcgaccgcaacacgacggcatacgacaactaccgccgcatcttcatccccgaccgcgagccgcccaatggccagcccgacgagccactcagggtcaacatcctcttcaagcacatcaaggagatgctgtctggcgacaccgccgtcatcgccgagaccggcgactcgtggttcaactgccagaagctcaggctccccgagggctgcgggtacgagttccagatgcagtacggctcaatcggttggtccgtcggcgccacgctcggatacgcccaggcggccaaggacaagcgcgtcatctcctgcatcggcgacggaagcttccagatgacggcgcaggacgtgtcgacgatgctgcggtgcgggcagaagagcatcatcttcctcatcaacaacggcgggtacaccatcgaggtggagatccacgacgggccgtacaacgtcatcaagaactgggactacaccggcctcatcgacgccatccacaactctgacggcaactgctggacaaagaaggtccggactgaggaggagctgatagaggcgatcgcgacggcgacgggcgccaagaaagactgcctctgcttcatcgagatcatcgtgcacaaagatgacacgagcaaagagcttctcgagtggggatccagggtctcggctgccaacagcaggccgcctaatccccagtgatcttgctgctcgtcttctcaggacgcacactcgaaattgctgggctgccaatgtctaagatgtgctgcttatcatcgtctgtgaattaattgtttaacgcttctgtttctgtatccattcaaaattttcttagagaagaggttgaattagtacatgtcgatgggtgttacctatcctatgataatgtatgtaattcaaatgcttggaattaatgttttgtaaacctacactatattgcgatgcaataacatggacgatttgaaggagaaaaaaaaaaaaaaaaaaaaaaaaaaaaaaaaaaaaaaaaaaaaaaaaaaaaaaaaaaaaaaattgcacgatcgtaatatcgtactacctctgtgctataatataagaaactagtccagattcatataaaaaaaaaaaaaaa

SEQ ID NO: 3354 - DNA, 1451 bp, Oryza sativa
  Clone ID: PAT_MRT4530_66026C.1
tgccgccgccgccgccgccagtgcatgcagggaagtatggccgccggtcgctgggtctcgccggtacacctacacatccatgatcttgggtctcgcaatgcacggccacggtgaggacgccctgtctctatttgccggcatgcaacgagccggcgtgacgccgaacgaggtgaccctcctcggcgtcctcacggcgtgctgtcatgccggacttgtcgaggaggggctccagcaactcgacgccatgccggaacctcgcatcgagcactacggctgcgtcgtcgacatgctcgaccgcgccgggagactagacgaggcagaggagctcgtcgcggcaatgccagcacaccccgacgcgctcatctggggctcgctgctcgccgcatgccgcgcacatgacgacgtcgagcgcgccgagcgggtgatgtggcggcgcaccaccgacgccgacgcggacgccggcgactacgtgctgatgtcgaacacatacgcgtcgaatggccgccacggcgaggtggtgaaggtgaggaggcagatgaggaggaacgagatcgacaaggtccccgactgcagcctcatcgagatcgacggcgtcgtgcacgaattcaaagcaatcccagcaaattccatccgataaaaccacaacaagattcatcaaagaacagattatccgattgatcactgtagataacaagattcatacaaccaacgacgcaagattttcactgggaaattttctagtactagttgtacatgagatttcagaaggcattatttggctttattggttattgctgctactgctgagttgatgctcatttgggcttgtgattggcagcggccatgtcgacggccggcctctcgacgtcctccatgtcctcctcgcggacgaacaccgcctggtcaagcaccgacggcgagccgccggccgccgccgccgccgctccgcagtggtcgtggttttcggtgccggagacggcggcctcgtcggcggggacaaagacgccggtctcgtggtcgggcacccacgcgtcctccaccgtctcctcctccgggtgcacctccacgttcttgcggttcagcgccgcctccacctgcgctccggcggcgccgccgccgtcgtggatggccttctgctcctcctccggctgggcctgtgcgctaatcgagtaattctgatgagcttgatctcctctcctgcaggaggcaagaagagggaagccagtctgtccggccatccggcgaccggcggcggcggcagcagcagacagtgctcgagcggccattgagcagaacaaccgaacaacagagctactgctactcctaccgagcttgcaatggtgtcgtcagccaatctctcagaacgaacgcacccttagtttactgctgccaatgcagatgatgcaggtgcaagaagtactagactgtgatgaaggggaagaaggatcaag

SEQ ID NO: 3355 - DNA, 361 bp, Oryza sativa
  Clone ID: PAT_MRT4530_66161C.1
gggacgacaactttaaatattggtcaataaaaccctttctggggccaacccacacgagaggcatatccagaggaaaacaattagcccaaacggaccacttggcccaaatgcaaagcattgggaagaactaatttgaccggtaccacccttgtaaaaacccaaaaagagagaggaaggggggcccggaagaaaaacatttttgttgaaccggagaagaatccattcattatggggaccgcagcatggggcatctaaatcgatgggctccaataacatgcggagccattgatcgatcgatcttcccattttactgggccttgaaggggttgtccttggagggtttttttaccttattaccacc

SEQ ID NO: 3356 - DNA, 694 bp, Oryza sativa
  Clone ID: PAT_MRT4530_66445C.1
gcttgatggtagccctagaattaaaatagagcaacattcactaacacagaacatgcatgctgatactcaactaggccattctagaattaaggaagctcttatgcgcaaaaggatcacaggcggaattcttgatagtaatagcttaaggacgcttaaagacaggagagatttgttttacccgttttctctcatcttgcacaacactaaaccagttggccatcaggatcttgttggcttagtaatctcaatattgcttctcgcagattttagcttagtgttactgacttttctccagctatattcatactctatggccgatgttctcttagttttatttgttcttccacttgggatactatcaccttttcctgctggaataaatgctctttttagtcatggaccacggcgatcagcaggccttgctcgtgtgtatgcattatggaacattacttcactggtcaatgttgttgtggcttttgcttgcggccttgtacactacaagtcatcaaccaaaagacatcctagtacgcagccatggaaccttggaacggatgaaagtggctggtggctcttccctactggactcatgttgctgaaatgcatccaagctaggcttgtcgattggcatgtggctaatttagagattcaagaccgcgcagtatatagcaatgacccaagcatattttggcagtca

SEQ ID NO: 3357 - DNA, 2348 bp, Oryza sativa
  Clone ID: PAT_MRT4530_67017C.1
gcccccgggccgctgcccccccgccccctcctccccctccgcatcccctcctcggccggtgccaggcaatggccagtggcaacagcagcagcagcagcggcagcatggctgccaccgccggaggtgtcggcggctggctgggattctcgctgtcgccgcacatggcgacgtactgcgccggcggcgtcgacgatgtcggccaccaccaccaccaccacgtgcaccagcatcagcagcagcatggaggtgggctgttctacaaccctgccgccgtcgcctcctccttctactacggcggcgggcatgacgccgtcgtcacctccgcggccggcggcggatcgtactatggcgccgggttctcctccatgccgctcaagtccgacggctcgctctgcatcatggaggcactccggggaggcgaccaagaacagcaaggggtggtggtgtcggcgtcgcccaagctggaggatttcctaggcgcgggccccgccatggcgctgagcctggacaactccgccttctactacggcggccacggtcaccaccagggacacgcccaggacggcggcgccgtcggtggcgacccgcaccacggcggcggcggcttcctgcagtgcgctgtcatccccggcgccggcgccggccacgacgcggcgctggtgcacgaccagtccgccgcggcagtggcggccggctgggcggcgatgcacggcggcggctacgacatcgccaacgccgccgccgacgacgtctgcgccgccggccccatcatccccaccggcggccacctgcaccctctcaccctgtccatgagctcggccgggtcccagtccagctgcgtcaccgtgcaggccgccgccgccggcgagccgtacatggccatggacgccgtgagcaagaagcgcggcggcgcggaccgcgccgggcagaagcagccggtgcaccgcaagtccattgacacgttcggccagaggacgtcgcagtacagaggcgtcaccaggcataggtggactgggagatatgaggcacacctctgggacaacagctgcaagaaggaaggccagaccagaaaaggacgccaaggtgggtatgacatggaggagaaggctgccagggcgtatgatcttgctgcgctcaagtactggggcccttccacgcacatcaacttcccgttggaggactaccaggaggagctggaggagatgaagaacatgagcaggcaggagtatgtggctcacctcagaaggaaaagcagtggcttctcgcgtggcgcttcgatctaccgtggagtcaccaggcatcatcagcacgggagatggcaggcgcgaatcggccgcgtctcgggcaacaaggacctttacttggggacattcagcacgcaggaggaggcggcggaggcgtacgacgtggcggcgatcaagttccgggggctcaacgccgtcaccaacttcgacatcacgaggtacgacgtggacaagatcctggagagcagcacgctcctcccgggggagctggcgcggcgcaagggtaaggtcggcgacggcggcggcgcggcggcggtcgccgacgccgcggccgccttggtgcaggccgggaacgtggcggagtggaagatggccaccgccgccgcgctgccagcggcggcgagaacggagcagcagcagcagcatgggcacggcggccaccaacaccatgacctcctgccgagcgacgccttctcggtgctgcaggacatcgtgtcgaccgtggacgcggcgggcgcgccgccgcgcgcgccgcacatgtcgatggcggcgacgagcctgggcaactcccgggagcagagccctgacaggggcgtcggcggcggcggcggcggcggcgtcctcgccacgctgttcgccaagcccgcggcggcgtcgaagctgtacagcccggtgccgctgaacacctgggcctcgccctcgccggcggaacaacgtgttggttttgcaaagccgaactcactgtggtggtgtttatcatctcaaagtaaattgaaagcacattctcgatcgaacggcggccgtaaaccctccagaggttcggagaaaaatcctccgaacccctgcatgaccttctcagcttctctcgatcggacgaatgaatttgaagatgcgactttgcatgtagatgtaatactattgaaagtgcatttggtgtacacgttaggtgtgtcatcggtcgccgcctcgccgcgcgtcacagaggacgtcgccctctcatgtgttttcctacactactctctgacttgggaactcattccctccgcacagccatcctttgtgagatacgtccagccatcttctgagtgcaaattgacggattag

SEQ ID NO: 3358 - DNA, 1387 bp, Oryza sativa
  UNSURE (1)..(1387): unsure at all n locations
  Clone ID: PAT_MRT4530_67035C.1
  unsure (1)..(1387): unsure at all n locations
tgcgtggtcgcggccgtggttcttttctgcaactatatttgttttttaattgaaatatagtagatagtcaattgaaatatagtgttcttgtgtgctaaacaaaaatataattgaacatatctgtatcttccagataaccattcaggccatcgactaggggattttacaggcttactttgcgtcttagcctaaacaaaacacctgctattgctacaacacagcaccaaaatctaacctggggggcacaagttcaccattcctgaagagagaggggtgcatgacatgcccaaggattgaagatctgctacatgcagcgcatgtacatatattatacttgacgtatattcacagtggtggcattattctctgacatattcgtcgtcgtcctcatcctcgtcaacatcctcgccatcatactgtagaaggctgaaatccctggattgcgccttgagcctctcttggatccgctctttgatggcagttcccattgagtggcagccttcttcaaacttctccagaaaaccagcaacccatcgatctgcattttccacccactcttcctggagtttcgccattgtattccacttctcccctactttttcttggtgctgcttcactttgtcacgcaggttttttaatcccatgttaactctcagtcttttttccttaacgtaactgacaccaagatcctttctggtgtaccccctggccaggttccgcataacatactcattataatccttaacaatccgcattataatatctgacgtcgatatcccatctgtgcgctgggtttccttaaatttaccaagttttttgacaaattcatagacatcgttaccagctccactagcatcagcatacggcagagaatcatgtgcaacaaaatcaatgttatgtttattcaagaattcttccgttaccacccatggagcatcaggaatgacttcatccacccacttgcagtgacgaagtgattcatatcgctcatcctctgtcataacagttctccctttgtacttatgtgtcaactcatcattgcagcatccgacaaggagatatgtgttaggaaacagcctcttggcctgctcgagcgacttggcgtggccgaagtggaagagatcgtagattccgtccgcgtagacccggatcggcctcccctccgggattcccccattggcggcgccgcctccgccgcccctgtccgccacctcgacgtccccgtctcccccctcggcctccttccagtcctcctcctcctcctgcgacgactgcggcgccgcctccgccgcagcgtggtcggccatggcgagaaggttcgggagagagagagagagacagagaaagtccgaggcggggaggggagaaggcgaggnggaaaggctcc

SEQ ID NO: 3359 - DNA, 4102 bp, Oryza sativa
  Clone ID: PAT_MRT4530_67341C.1
ctggacagcgaagatattagtattacaccaattaacctttgtaacttgaacatcagaattttccagcaccaagggcttaatatgtacagtattgactacaagtgccgttttgcacaagtacatgtattcgaaccaaaaattgatacaataatcaaacacaatgaagtagctactgctatctagcaagagaactagattaacaacaggtgagactgacctcgcagaacatgtatgcacccatggaacgaaaatgctgacctgaattatcaacctgagcttccacaggaactaccaaggtgtgccgcaacatcgctaaccaacagcctgatgacatggctaccagagatctccatgcattcttccaagtccgcgttgcatgctaacttcacccactcatgatcatcgtcgagatacttgatatcaaacatgccaacatccatccttagccttttggctacttcatctttcaatgcagtaacgctaccggaacatgggaagcggaacctgacaatgtcttccttaaagctagcctttatggtcaccgtccctgaattttgcatcagcgccaaattgcttgaacgtgctaaaaatggttgatcaactgctgaagtgaagagattcttcaaatctttggaacttccagaatcctcaatgagcatcctggaaagcggtagtgctggttcttgaaagggctctttagtaaacgcctctggaattaattgtggttcagcgaacgtcgatgcaattggcttgcaaacaaatgtctggtttgcaggacttccatggcatgaggcctctgaggtacgtgagtttatactgccttctccagatgagcttctcgagtgagaagctttgtctgcttcaagttgcaagttattgtttgcatctataaacccttgctgtgacatcaatatagctaagttgtcattttctattggcttttgcaaggatgaatctctgtccccctcaacagccagatttgaaagttctgcaactttatttggacttgctttctctagattctgagaatctgatgaaggtccaacaggaatagggagaggacctgtgatagacgtgagattaaatgccgcatctgagccttgaacagactcaattacctgctttagttttgagagagaccggttgaccttgttaatttttcgagatggccaacgagaaatcccatgttgcctgcagatgcgtttcatggttgtgggacatacaccaaggctttttgctgcattttttaggcttcctgagaaatattgctgaagaacatctaagctgattgttttttcagcttttcctcgtctcctttcagggggtttattacttttgtgaagcgaatcagaagcaccactaccatttggcctgccaacagatgccccattgttttgagagttgtcatcagctagcaaatgtctctctgacatgattgaaactttgttgccatcattatcaacctcgtggactctttggcttccattactttcaggcgattcacgaaagcaaccttcagaattctcaaagtgcacatttgtcttcaaatcttcagtctcaattattagcacattacttatttgcagacaaacttcattggtgtctccgttgccaactacctttagggtacgaaggcacttcttcattcgagctaatatggactccaacaaggcattttgatcatcttcgttcctgcaatttggtggcaggaagaactctaatatataatcatcatctccagtatacatactttgcaaacatattgcaaagcagccagctagaccaaacattcgagcatagtgtacaaggggatactccaacttgcagaattgactgatatctttagaaaagcaaggtcgacgatagataaaagccttcccagaaactccttgtcccttctgtaggtgatgttctacacatgcatctctaaatccccacatatgagcatcgataacatgaaatgccacatcactggttgacatgcaaacctcccccatgcaacttccatcaaagctcaaacaactcttcttaacaccaccgccatgtgccagtacacttcgatacttgcaaggaacccaggtttgagccaaaggaagcttgtgctcttcacatacgaccgtcaagatctccagtatctccaccaaagcagattggcggccttcattgcatatctggacattcggatggtccaatatctcagtgcttttgagatttactgcctcaagagctttgcagactttatcaacctcaccagcatagttgatcttctttgatgtcattataagttcaacaaccgcaatacaattttgaacagaaggatcaaaaacaggcaaggctacagtaccatgaacattgtaactgattgcatggttaaggcgtgggtactcagtactgctataatactgcacattcggtgtccactcaggaaccttttgtttgtacacacgcccaggtagccccagctctccagcattttctccatccaccgagaacatgtacatcatggatacagccctgtactgaagaagcccaatactctgctggtcaagtacaaagggctgtcctgaagtagtaagcacataccggtctccactcttaaccggtgcccaaacttgaaccagcagatgctgatctgtggactccttgaagtatctaagagcctgtgtaagcctctccttaaacaagcatgagctgtccgtgttatcatcaatagataggtgaaactgccatttgctattaatctgatcaaccctcttactagtcgtgtcagaattcccggagcgggtccgatggacttcctcgaccacggcggcggcctcggcgggcggagcggtggcgggggcagcgggggcgcccatgtcgagcgggagcagctggcgctcgtcgaacagccacagcggcgagggcggcgtgagccacgacgacgacgaggccggcagcggctgcggtgaggccgacaccgacgagaacagcagcgacgtgaacctcacttcactcagaccgcgctgcggcggcggcggcggcggtggaggaggaggcgacgcggcggctgaggaggaggaggaggaggagaggcgggagcaggagtggggagcgggaggggagcttggccattatggtgggagaggaggaggagagaatggagtggagggggatcaaatgtggctggtggtggtgtggcgggtagtggaccggaataacaataagataatggcgacgattgcgtggacatgtgggggcagatccgatccgctcatgtcgctgccatgtggggcccaccaccctcacctggcacataataaatttataaataaacaagggtggcagccaactccccgggtggtgcactccagcgtggcaataatcgatcgcgctgcgctgcgcacccccgagaccgagaccaccaccaccaccaacaacgacgacaaccgccatcagtgggtgggcgtgcccgcgcgcggggagttgcaaactgcaagcaaacgcgggcgttttctcgcggcaaccgcgtccggaggccggcggccgcgtcgcccaccaggcgcgctcgggtggcacggggaccacctgggctggatggatggccgattggttggcggccaggacggccgggatccgagactgccaggtcggctggagatcgcatctgccgcaggagcggccggggggtcggggcctcggggtaccacgtcatacccctcgggcccttgcactgctttgccccgaggccctcgcccagccgctgtttggcgggaggagcaagcgaggagggggcccaggctgaacttcctttaatgcgcgcagcgccccaactgccccctgtcgcatttaatgcagtggggcggacgtgcggcgtgctgaactgacgcgcaatggtcaagaatgaccggtctgtgaccggcctgacgccggtcacgtctgacatacatccaatacccttactgtggccgcgctgcgtccatccaccgatgactgatccacggcgtctctggtttggccacatggcgacgatcccgcaaacagcgaggctgcgacgtggtgactcgaacagttctggggccttgttgtcgcctgcccgcgacttgacactttgcctcaccat

SEQ ID NO: 3360 - DNA, 1120 bp, Oryza sativa
  Clone ID: PAT_MRT4530_67576C.1
atttaggaaacatgtcttattcacaaatatcaccttcatcatattcctcatcttcttttgatgaaaatccagcaagtagtctgaaagaaaaagcaaagccacaaaagtacacaattacaatgtttttatttacttttattagaagttgacaccacttatatatatgtagtctgatctctgatgacgttgatacatagcagagctttcaccagtatgactataatgacggggacgtcttgtacatacaatcagatgacgaggctaccttcaccaccgtgcagcagcccatgtgacggcgagcccgggccgctcctgcccagcagctcctcgatcatctgcagcgcgatcctctcctcgtcgtccattgccggaggtggtggcgacggcgagcccgtggtggacgtggacgtcgttgtgactgtgctgtcactcggagtcggctggtcgctggacgacactgctgttgctgctgccaccgtcgcagccgacgacacggccgtgtccttgttgagctcgacggtcatgacccagctggagtcagcgcgtgcgccggcgcgcttctgccagacgccaatgtgggacttctccgggtcaaggcggaggcaggtgagcgacggcgacggcgtcttgcagcacttgcggagcttggcgctgaggatctgagacaggctgttcccgccgccgttggccgtcattgaggacgagctgccgctgccgccgccgacacggccatcccgccctgccaccgcagccgccggtgtgagctcccccgtggcgttcctcgcgactgggaagttggtcttggcgttgcggccgctcatcaggatggcggcctcgtcgtacgcccgcgccgcctcctccgccgtctcaaaggtacccagccacaccctcctcttaaggagagggtgcctgatctcggagacccaggagccccagtggcgctgcctgactccgcggaacttcttcttcgactgtcccatgatctcacctctgcagggatactgtccctgaagaattctccctgcggcccggcggtccacgcgggcagagtaggagaaggaatgagcagcagcagcagccagtcagtcagtcagacagtgagcatcctcccctcgtgccg

SEQ ID NO: 3361 - DNA, 690 bp, Oryza sativa
  Clone ID: PAT_MRT4530_67628C.1
atggggagagggagggtggagctgaagaggatcgagaacaagatcaacaggcaggtgacgttcgcgaagcggaggaatgggctgctcaagaaggcgtacgagctctccgtgctctgcgacgccgaggtcgccctcatcatcttctccaaccgcggcaagctctacgagttctgcagcggccaaagcatgaccagaactttggaaagataccaaaaattcagttatggtgggccagatactgcaatacagaacaaggaaaatgagttagtgcaaagcagccgcaatgagtacctcaaactgaaggcacgggtggaaaatttacagaggacccaaaggaatcttcttggtgaagatcttgggacacttggcataaaagagctagagcagcttgagaaacaacttgattcatccttgaggcacattagatccacaaggacacagcatatgcttgatcagctcactgatctccagaggagggaacaaatgttgtgtgaagcaaataagtgcctcagaagaaaagaaaagctggaggagagcaaccagttgcatggacaagtgtgggagcacggcgccaccctactcggctacgagcggcagtcgcctcatgccgtccagcaggtttactccagagcagatgaacaactcatgcgtgactgccttcatgccgacatggctaccctgaactcctga

SEQ ID NO: 3362 - DNA, 1497 bp, Oryza sativa
  Clone ID: PAT_MRT4530_67786C.1
cgtcccacgccgcctctatctatctccacgtgaaataaaaaaaaaacaaagctcccgaaaatattctctctcccccacccccgaaaccctagcgcgacctcgccgccggcaatggccgcatgaccgatgcgcctccgccgaggagccgcccgcacccacccagcagcagcgtcgccgtgcccgccgccgcggcggcagtgatcgcagccgccctcgcgtcctccttcctcgccctgctgcagccgccccggcgcgccccggtcgccgcgggatccagggtcggcatgtcgaaggcgagggtctacgccgacgtcaacgtgctgcgccccaaggagtactgggactacgaggcgctcaccgttcaatggggtgagcaggatgactatgaagttgtcaggaaagttggaagaggtaaatatagtgaagtctttgaaggcatcaatgttaacaacaatgagaaatgcatcatcaagatactcaagcctgtgaagaaaaagaagatcaaaagggagattaaaatacttcagaatctttgtggaggtccaaacattgtgaagcttcttgatattgtcagagatcaacattctaagactcctagcttgatctttgaatatgtcaacaatacagacttcaaagtgctgtaccccacgttgacagattatgatatccgctactacatatatgagctactcaaggcattagactactgccattcacaaggcattatgcatcgagatgtcaagccccacaatgttatgatagatcatgagctccgaaaacttcgattgatagactggggcctggctgagttctatcatccagggaaggaatataatgttcgtgttgcttcaaggtatttcaaggggcctgagcttcttgttgatttgcaagattatgattattctttggacatgtggagccttggttgcatgtttgctgggatgatattccgcaaggagccattcttctatggtcatgataaccatgatcaacttgtcaagatcgcaaaggtacttggaacagaagcactaaatgcttatttgaacaagtaccatattgagcttgatcctcagcttgaagctcttgttgggaggcatagtagaaaaccatggtcgaaattcattaatgctgataaccaacatctagtatctcctgaggctgtagattttcttgataagcttctacgttatgatcaccaagataggctcactgcacgtgaagctatggcacatccgtacttcctccaagtgagagctgcagaaaatagcagagcacgaccacaatgatcttgtgtacctgctaaaatgatgatccagctgatgatccacgacggtactactttgagtttgtgtgaacgatcgtggaatgtgcttgtagccttgcatttgtaaactgtaattcactccgttggttgcgtttgatgaatgccgtgacatgcacataattatttatttctgtaatgttttaccataacaaaaaaaaaaaaaaaaacccaaa

SEQ ID NO: 3363 - DNA, 1592 bp, Oryza sativa
  Clone ID: PAT_MRT4530_67800C.1
gacatagctaacttagctagctagatcatcttagcttggagaagacagaagagtgttatcttggaaggacaacatggcaactgcagggaaagtgatcaagtgcaaagcggcggtggcttgggaggccgggaagccgctgtcaatcgaggaggtggaggttgcgccgccgcaagccatggaggttcgcctcaagatcctctacacggcgctctgccacaccgacgtctacttctgggaagccaaggggcaaactccggtgttccctcggatcttcggccacgaagctggagggattgtggagagtgtgggcgagggggtgacggagctttcccccggcgaccacgtgctgccggtgttcaccggcgagtgcggcgactgccggcactgcctgtcggaggagagcaacctgtgcgacctcctccgcatcaacaccgaccgtggcgccatgatcggcgacggccagaccaggttcaccgccaggggagggcagccggtgtaccacttcctcggcacctccacgttcagcgagtacaccgtcgtccatgtcggctgcgtcgccaagatccacccagcggcgccgctcgacaaggtctgcgtcctcagctgtggcatctccaccggatttggcgcgactgtgaacgtcgccaagccaccgaaggggtgcacagtagccatattcggcctgggtgcagttggtcttgctgccatggaaggtgcaaggatctctggtgcttcacggattattggcgtcgatttgaacccggccaaattcgaactagctaagaagtttgggtgcacagactttgtgaacccaaaagattacgacaagcccgttcagcaggtgatcatcgagatgaccaacggcggcgtggaccgcagcgtggagtgcaccggcaacgccgccgccatgatctccgccttcgagtgcgtccacgacgggtggggagtggccgtgctggtgggcgtcgccggcaaggacgcggcgttcaagacgcacccgaccaacttcctcaacgagaggacgctcaggggcacgttcttcggcaactacaagcctcgcaccgacctgcccggcgtcgtcgagatgtacatgaacaaggagctggagctggagaagttcatcacgcacagcgtgcccttctccgagatcaacacggcgttcgacctgatgctcagtggggagagcctccgctgcatcatcaggatggaggactagccatccaagatcgatgtcgccgccggcgatcgacggcgtgcggcgtactgtataaacggagaaaataagaggctaaaactacctatgcctacagcaataagctagccacggttgcaggaatgcggtttcaggtttgttcatggagaacaggggtggacaccaattatagatactgtgaattttctgaaaatttacaagacaaatatgaaattgcgcaaattacgatagcggattagcctttggctcgatcgatttgagcctatatatgctggctccaccgctacactgtttgccgcctttctgtattgcgcatctgctctctctaatgtaatgtgcaatctatatataactacattatgaaaaaaaaaaaaaaaaa

SEQ ID NO: 3364 - DNA, 944 bp, Oryza sativa
  Clone ID: PAT_MRT4530_67886C.1
cggacgcgtgggctggatctcgcccacccaccactccaccccctctcctctccgtgcgccgccgcagaattcctcgccgccgccgccgccgccgccgccgtgaggtccatcgagatcgcgaccggagcaggtgcaggttgcgatggcccgcgtgtacgtcggaaacctggatccccgcgtgacggcgcgggagctcgaggacgagttccgcgtctttggagttcttcggagtgtatgggtcgcaagaaagccaccaggttttgcattcattgattttgatgacaggagggatgctcaggatgcaattcgtgatatagatggcaagaatggatggagagttgagctgtctcgtaatgcaagcagtggtcgtggtggccgtgatcgatatggtagctctgagagcaagtgttatgaatgtggtgagactgggcactttgctcgtgaatgccgtttgaggattggttccgggggtctaggcagtggaaggcgtcgtagcaggagccgcagccgcagccgaagtcccaggtaccgcaggagtccaagctatggcagaagaagttacagccctgcagggcgctctccaaggcgtcgtagtgtgtcaccggctcgtgcacgcagctatagcaggtcaccacaatacaaccgtggccgtgatgaatctcctgcctatgataacggatatcgccgcagcagaagttagagctgaacctgatgtctaaagactgctgttacaaatgttactttgtgggttgtcagctatgaacaatgccctactccaaatatcatcatcaactctggactttgattaaggttctcataacttatctaccttattatgctttgtgtttgaagttatattactcgagaaacttatgattggatgtgtattcaactaaataaaactgtctttctgtgtgtcaataaggcatcggcctgcactgctt

SEQ ID NO: 3365 - DNA, 1140 bp, Oryza sativa
  Clone ID: PAT_MRT4530_68165C.1
agatataatagatagatagatagatagatagattatcttagccagaaaagggacatggcttccaaatttcctggtacaaaccaaatctaatgcaaattgatcttatcaattgtgtcgatgaaattttacaattttgatttccccttccagacaacaatcgcagaaagtgaccttttacatgtaccgtgtttgacaaaaagaaggtaaaccggaaaatacaaagcctgtgaacgtatcacacacgacgaatatcaaatcaagcaaacgtacgatgcatgcaaactgacacggatacttcaattaattcggttcatccacttttaagcgtagtcctggtcggcaacgggctggtatgagccgatgaacacgtcgccgtacacgagcccggcgaggccgccgccgatcagcgggccgacccagtagacccagttgccagcgaagttgccggcggcgacggcggggccgaaggagcgcgctgggttcatggagccgccgctgaacgggccggcggcgaggatgttggcgccgacgatgaagccgatcgcgatgggcgcgatggtgccgagcgatcccttcttcgggtccgccgccgtggcgtacaccgtgtacaccagcgcgaacgtgatgacgatctccatcacgacgccctccagctcgctgatgccggcgacgccgtgcgtcgggatggccttgccgtgggtgacaaacttgaggaggaggcaggcgatggaggcgcctagcagctgggcgatccagtagaagagtccggtgaggatggtgatgtggccgccgacggcgaggccgaacgtcacggccgggttaaggtggccgccggagatgttggcggcgacggaaacgcccacgaacagggcgagtgcatgggcgatcgcgatcgccacaaggccggccgggtcgagggcgccaccattggtcaattgcccataggcaatggcggatccgacgccagcgaagacgaagaggagggtggcgatgaactccgccacgtaggccttcacggacgtggcgctgaaggagtcacccaagcttccgaatgcgagcttcaccatttttaatctatatttttttccttattactctgataagtgtggagaggtctctacgcttgaaagagagcttggc

SEQ ID NO: 3366 - DNA, 2237 bp, Oryza sativa
  Clone ID: PAT_MRT4530_6816C.1
gcccggggaacgccgccgcccatttccctttctcttcctcttcttcttccttctcctcctactcctctgcgatggacaaagataagtgaagtgagcaggcgccaatgggtgcttttcttctgttcgtgtgcgtgctcgcgcctttcttgcttgtctgcgccgtccgcggccgccgccggcaggcgggctcgtcggaagcggcggcgtgcggcctgccgctgccgccggggtcgatggggtggccgtacgtcggggagacgttccagctgtactcgtccaagaaccccaacgtgttcttcaacaagaagcggaacaagtacggtcccatcttcaagacgcacatcctgggatgcccctgcgtgatggtgtccagcccggaggcggcgcggttcgtgctggtgacgcaggcgcacctcttcaagcccaccttcccggcgagcaaggagcggatgctgggtccccaggccatcttcttccagcagggcgactaccacgcccacctccgccgcatcgtctcccgcgccttctcccccgagtccatccgcgcctccgtcccggccatcgaggccatcgcgctccgctccctccactcctgggacggccagttcgtcaacaccttccaagagatgaagacttacgcgctgaatgtggcattgctgtccatcttcggggaggaggagatgcgctacatcgaggagctgaagcagtgctacctgacgctggagaaggggtacaactcgatgccggtgaacctgccgggcaccctgttccacaaggccatgaaggcccggaagaggctgggcgccattgtggcccacatcatctctgcccggcgcgagcggcagcgggggaacgacctgctagggtcgttcgtggacggccgcgaggccctcaccgacgcccagatcgccgacaacgtcatcggcgtcatcttcgccgcccgcgacaccaccgccagcgtcctcacctggatggtcaagttcctcggcgaccaccccgccgtcctcaaggccgtcaccgaagagcagctgcagattgccaaggagaaagaggcgtcgggcgagccgctgtcatgggcggacacgcggcggatgaagatgacgagccgggtcatccaggagacgatgagggtggcgtccatcctctccttcaccttcagggaggccgtggaggacgtggaataccaagggtacctgatccccaagggctggaaagtgctacctctgttccgcaacatccaccacaaccccgaccacttcccctgcccggaaaagttcgacccgtcccggttcgaggtggcgcccaagcccaacacgttcatgccgttcgggaacgggacccactcgtgcccgggcaacgagctcgccaagctggagatgctcgtgctcttccaccacctcgcaaccaagtacaggtggtccacgtccaagtccgagagcggcgtccagttcggccccttcgcgctgccgctcaacggcctccccatgagcttcacccgcaagaacaccgagcaggagtgaaaaccgaacagggagacaaaaagaagaagaagaatactagcatcagctaagctggggaaagctggcaaaaccaacatcaacggcgggcagcggcgccacgcagcgcgcgcgagtccattttcgcggcggtcaccgtccggggggacacctgttggcgccgcagtgggagcgggagacccgaacggtggattccgtattagcacggatcatcagagtccttgtacagattcttcagctaggaccacggttggcaatcgagaggaggagcagaggagttgatgaaaaaaaccaaacactacgtagacatctgagctagggagcgccacaaagaagtggcccttaattgtaaaaccaaccattttttatccttttttgcttagttttttttttggccaacaactataggagaagagtagagaagagaagagaaattggggagaaaatacagggaggatgaagaggccctgattgggatgtaagctaggttgcccgcctgaaagcaggctggcatgcagatgcagctataggtcgaataatcgaggcgagcgatgatggacggatggatcgattcatcgatcgccagagtcaaaagggaagaacgtcgtgatcccccgcgggctaagccaggccacgggagagcgactcctctgtaccgtttcgtccaactcaagagaaaatgaccttcttgagaaaaaaaaaaaaaaaaaaaaaaaaaaa

SEQ ID NO: 3367 - DNA, 825 bp, Oryza sativa
  UNSURE (1)..(825): unsure at all n locations
  Clone ID: PAT_MRT4530_68543C.1
  unsure (1)..(825): unsure at all n locations
ggcgattgggttcctcgaggccggccgggaaaaatatactccctccgtccctactcttctcttctctggtggtgtgggtgtgtccctgtctcccctctccttcctcctctcctttcccctcctctcttcccccctctcacaagagagagagagcgccagactctccccaggtgaggtgagaccagtctttttgcccgattcgacgcgcctttcacgccgcctcgcgcggatctgaccgcttccctcgcccttgtcgcaggattcagccatgaagggggccaaatccaagggcgccgccaagcccgacgccaagttggctgtgaagagtaagggcgcggagaagcccgccgccaagggcaggaaggggaaggccggcaaggaccccaacaagcccaagagggctccctccgctttcttcgtttttatggaggagttccgtaaggagttcaaggagaagaaccccaagaataaatctgtcgctgctgtaggaaaagcagccggtgataggtggaaatccctgaccgaagcggacaaggctccctatgtagccaaggccaacaagctcaaggccgagtacaacaaggccattgctgcctacaacaagggcgagagcactgccaagaaggcacccgccaaggaggaagaggaggacgacgagggagaatctgancagtccaagtcccgaggtcatgatgaggatgacgacgagggcagcgaagaggatgaagacgatgacgagtgagcctttcagtggnacagatgggagcagcaagacgctaaggggcggcgggcgtccctagggagctatccatcatcatcatcatc

SEQ ID NO: 3368 - DNA, 2041 bp, Oryza sativa
  Clone ID: PAT_MRT4530_68545C.1
cacatgtccaactacggccgggaaaaaaaaaaaaaaaaaaaaaaaaaaaaaaaaaaaaaaaaaaaaaaggcccgggctgcaggaattcggcacgaggaatcctcccgcccggcctcttctcttctctggtggtgtgggtgtgtccctgtctcccctccttcctcctctcctttcccctcctctcttcccccctctcacaagagagagagagcgccagactctccccaggtgaggattcagccatgaagggggccaaatccaagggcgccgccaagcccgacgccaagttggctgtgaagagtaagggcgcggagaagcccgccgccaagggcaggaaggggaaggccggcaaggaccccaacaagcccaagagggctccctccgctttcttcgtttttatggaggagttccgtaaggagttcaaggagaagaaccccaagaataaatctgtcgctgctgtaggaaaagcagccggtgataggtggaaatccctgaccgaagcggacaaggctccctatgtagccaaggccaacaagctcaaggccgagtacaacaaggccattgctgcctacaacaagggcgagagcactgccaagaaggcacccgccaaggaggaagaggaggacgacgaggaggaatctgacaagtccaagtccgaggtcaatgatgaggatgacgacgagggcagcgaagaggatgaagacgatgacgagtgagccttccagtggacaagatgggagcagcaagacgctaagggcggcgggcgtcctaaggagcctatccatcatcatcatcgtctactagaattattcagtttcacttcacatcgtgatgttttactttttctctcgtcctataacggatagcgctccttgttggcgccactggtgggtgttgtggtgcagccaatgtcttgtctccaccgtcaatgatccgcttgtacctagattactctttccattgtcatcggctaacattgtgataatatcagtttgcgtatgttagattaaattgtttctaaaaaaaaaaaaaaaaaaaaaaaaaaaaaaaaacaaaaaaaaaaaaaaaaagtcacaattcatcacactacaacaacgctaaaagcggatgcagcgtagcaaagatgagattcaggcaagggttgcacagctaaagaaggaactctccgaaactgattcgatatatgatacagagaaattggctgagaggattgcaaagctttctggtggtgtggctgtcatcaaggttggggctgcaactgagactgagcttgaggaccgccaactacgtatcgaggatgcgaagaatgcaactttcgcagctattgaggagggcattgttcctggaggtggtacagcgtatgtgcatctttcaactaccgtccctgcgatcaaagaaacaatcgaagaccatgatgagcgccttggtgcagacattattcaaaaggcgttggtagctcccgcttcactgattgcccacaatgctggagtggaaggggaagtggtagttgagaagatcaaggacggcgagtgggaagtcgggtacaatgcgatgaacgacaagtatgagaacttgattgaggcgggtgttattgacccagctaaggtgacgagatgcgcgctccagaatgccgcctcggtggctggaatggtccttaccacacaggccattgttgtcgagaagccgaagcccaaggctcctgttgctgagccggcagagggaacccttaccgtctaaacagtggtgaatttcttcagggtggctttgtttagatggttcataccaactgaaatggtagaatttttgtctgggagtttttggttcagatcaaccgaaaggtctagtgtaggattggtttccatttttgagattgaaggtgcaacctgcctgatctgaactcatatgtccatcaaagaaataatttgcatcattatcgtcatcttcggtttaaactttataaagtaaatcatatggtgtttcttcaaaaaaaaaaaaaaaaaaaaaaaaaaaaacggcctgcagcccggggatccactagttc

SEQ ID NO: 3369 - DNA, 581 bp, Oryza sativa
  Clone ID: PAT_MRT4530_68571C.1
ccggccgggatatacccctcgaacccgacgcgtctcgccgccgtcgccaccgaagtaatcccttaattgtgctaaatgtcctccggaggagaatgtgtatatggtcaagctggccgatcaggctgaaaggtatgtggacatgggtgaatacatggggaaggttgcaaagactgcatatgtggaagaggtcactgttgaggagtgcaatctcttgtctgttgcttagaagagtgagattggtgacctacgtgcctcctgtcgtaatggctcatccattgaactataaggaggaggctcgtgggaatgacgaacatggtactctgttcatggactaacgagaccagattgaatatgaactgagcaagatttgcgatggtgtcctgaagttgcttgtgtcactacttgtgccctcctctactgctgcacaatatacggtgctttacctcatgatgaaggttgattaccacaggtaccttgcgtgatttaagactggtgccgagagacatggagctgttgagatcactatgcgggcttacaaagatgctcaagatattgctctgttcggatcttgctctcaccca

SEQ ID NO: 3370 - DNA, 1590 bp, Oryza sativa
  Clone ID: PAT_MRT4530_68696C.1
gaaagactgacagagtttaattggagtttttgccgaagctgggagttcaatcacataagttagttccctttaaacctaatcttcaagtctagtgtagttagatggtttaagtctatagcaaaacattaggattaagtcattctatagcttctgttgtattagttagccacaaacttgtaaatgtcctattattttataatataaacccctttggagcccgcgcggtgccggacacgggcgtgcgccaccgtcgcgtacaaggcgatggagccaaacgcaggaggaggtgttgtttcttgcgatcttgggttgattgatatgggtgttctttgcttcggcgcttccaacatcctcctctgcgcggaggacagcagcagcgtgcttggcctgggcggctttggcggcggcggcggcgaggtggcggcggagctggggtgcggcggcggtggcggctttgatttctttggcttcggtggtggtgctgtgttccccatcgactccgatgagttcgtggcgttgttggtggagaaggagatggatcatcagcctcagcgggggtatctggagaagctggagctcggtggattggagtgttcttggaggaaagatgccattgattggatttgcaaggtccattcctactacaactttggaccactcagcctttacctcgcagtgaactacctggataggttcctctcctcgtttaatctccctcatgacgaatcttggatgcaacagttgctgtcagttagttgtctatctcttgctacgaagatggaggagaccgtggtccctcttcccatggaccttcaggtttttgatgcggaatatgtgtttgaagcaaggcatattaagaggatggagcttattgtgatgaaaaccctgaaatggaggctgcaagctgtgaccccattctctttcatcggctacttcctggacaagttcaatgaagggaagccgccgagctacacgctggcatcatggtgctctgatctcacagtgggcactctgaaagactctaggttcttgtcattcagaccttctgagattgcggccgcagtggtgttagctgtgcttgctgagaatcagtttcttgtcttcaacagtgcccttggagaatctgaaatccctgtaaataaggagatggttatgagatgctatgagctgatggtagagaaggcattggtgaagaagataaggaacagcaatgcaagctcttcagttccacacagcccgatcaccgtgttggacgcggcgtgcttcagttttaggatgtccgtgaagacaacccctgaaatgggtgaagaagaggctgcagctatgccaactgctattttactcatgcaatgcaaggagttgaagacttcagtcctcacacctgccatgctcgcctccgcctgcaccctgcacctgcacgggcgctgcaccaccaccgcctccccgtccatcgctgcgacgccgcgtgcagaggagcacgaggagtattcaactctctcgcaagccataaggctgtcgctgcaggcggcatcagaggaggaggcaggcaggatgcacagcacagcacagctcgccgcggggaagatgtga

SEQ ID NO: 3371 - DNA, 589 bp, Oryza sativa
  Clone ID: PAT_MRT4530_69125C.1
ggagttcaaggccatcctcttcgtgccccgccgcgcgcccttcgacctgttcgacacccgcaagaagatgaacaacatcaagctctacgtgcgccgcgtcttcatcatggacaactgcgaggagctcatcccggagtggctcggcttcgtcaagggcgtcgtcgactccgacgacctcccgctcaacatctcccgcgagatgctgcagcagaacaagatcctcaaggtcatccgcaagaacctcgtcaagaaatgcatcgagatgttcttcgagatcgccgacaacaaggaggattacgccaagttctacgaggccttctccaagaacctcaagctggggatccacgaggactcgcagaaccgcggcaagctcgccgacctgctccggtaccactccaccaagtccggcaacgagctcaccagcctcaaggactatgtgacccggatgaaggaagggcagaaggaggtctactacatcaccggcgagagccgcaaggccgtggagaactcgccgttcctggagaagctgaagaagaaggggtacgaggtgctgttcatggtggacgccatctacgagtacgccgtcggg

SEQ ID NO: 3372 - DNA, 3529 bp, Oryza sativa
  Clone ID: PAT_MRT4530_69157C.1
gtcctttaagccctccccctctctcctctcctcctctcactccccacaccaccaccacccatccgcgccctctcctcctcttccccggggatccagcacggctacgccgccgccgccgccgctgccgccgtgcaatgcccgtggcgcctgctctcccaagaaaagcttcccttcttggtacatggtcgtcgtctccccttccccgattgcctcgccgccgacattcccctcgcctcgccggaccgccgccccccctgctccgaggttagtttgctgcggattgggattcgtttgctgctgctgttgcaaaggtggaggagcaccagcagtcgcattttatcccgaaagattggggattgtatgcttccactgaaccccgatgcgccacgttagccgctgcaccatccctgattggaaaaataattttgtgtagacccctccaagtttcaagaaatggacattgtgcctgttgtagcattgtgctgctgcctggtcttgctgcccagttgggcctatggccttggatccatggcgtccatcgccgtgtcctacggcgaggacggccccgtgttctgcgggctcaactcggatggttctcacttggtcacctgcttcggcgcggatgcctccgttgtgtacggtgcccccagcaggatcccgttcgtaggggttactgcgggggatgggtttgcctgtggcctattgctcgacaccaatcagccttactgctgggggagcaactcctatgtcaagattggtgtgccgcagccgatggtcgagggagccatgtactcggagctcagtgcaggagacaaccacctttgtgccctacgaacatctgtcaaggggtttcacagcgtgaatggagatacatcggtgattgattgctggggatacaacatgaccgccacacataccgtcaccggagctgtatcggccatttcagctggttctgtgttcaattgtggcttatttgcacggaacaggacggttttctgctggggcgatgaatcggttagtggtgtcattgggctagctccgaggaatgtgcggttccagtctataggagcaggtggttaccatgtctgcggggtgctggagaatgcgcaggtattctgctggggtaggagcttggagatgcagcagatgtcaacacccagttctactgatgatggtgatgtgaacatagttccgatggatgcaatggtctccgtggtcggtgggcggttccatgcttgtggcatcaggagtcttgatcaccaagtggcttgctggggcttcacacttcagaacagtacacttgcaccaaaagggctcagagtttatgcaattgtggctggagattacttcacttgtggggtgccggccgagacatcgttgaagccaatgtgctgggggcatagtggcccattagcactaccaatggcggtatcccctgggatttgtgtatctgattcatgcagccatggctactatgaatacgcaaaccatggtgaagttggcagtggtagcaagacatgtaaacctgcaaattctagactctgcttgccctgcagtgttggttgcccagatgactcatatgagtcatcaccttgcaatgccacagctgaccgtgtttgccagtttgattgctcaaagtgtgcctcagatgagtgcgtgtcattttgtttgtcccagaaacggaccaagaaccgcaagttcatggcttttcagctgcgtatttttgtggcagagattgcatttgccgtcatattggtgttcagtgtgaccgctattgcttgcctgtatgtccggtacaaacttcgacattgccagtgttcaaagaatgagttgaggctggcaaagaatacaacatattctttccggaaggacaacatgaagattcagcctgatgtagaggacttgaagatcaggagagctcaggaattctcatacgaggagttagagcaagcaacagggggcttctcagaggattcacaagttggcaaaggcagcttttcatgtgtgttcaagggcattctgagggatggtacagttgttgccgtgaagcgtgcaattaaggcatcagatgtgaagaagagctcaaaagagttccataccgagcttgacctcctctccaggctcaaccatgcgcacttgctgaacctgcttggctattgtgaggatggcagcgagaggctcttggtttatgagttcatggctcatggatccctctatcagcatcttcatggcaaggatccgaacttgaagaagagactgaattgggccaggcgggtcactattgctgtccaagctgctcgggggatcgagtacttgcatggctatgcttgcccaccagtaattcaccgagacatcaagtcctcaaacatactgatagatgaggatcacaatgcgcgtgtcgctgactttggtctatctatattgggcccagcagatagtggtaccccactatcagagctgcctgcagggacacttggctaccttgatcctgagtactaccgtctgcattacttgacaacaaaatctgatgtgtatagcttcggagttgttcttctagagatcctaagtggcaggaaagctattgacatgcagtttgaggaaggaaacattgttgaatgggcagtaccattgatcaaagctggagacatttctgcccttcttgatcctgtcttatctcctccctctgatcttgaggctctcaagaagatcgctgctgtggcatgcaagtgtgtcagaatgcgagccaaagaccgcccttccatggataaggtaacaacagctctagagcgtgcccttgcactgctgatgggtagcccgtgcattgagcaacctattctgccaactgaggttgttcttgggagtagcaggatgcacaagaaggtatcgcagaggtcatctaaccattcgtgctccgagaatgatctcgttgacggggatgatcagcggattgagtacagagcaccatcttggataacatttccaagtgtgacttcatctcagaggaggaaatcctcggcatctgaagctgacatggatggacgaacaaccacagatggaaggaacgttgggagcagcataggtgatggattgcggtcgctggaggaagaaattagcccggcctcaccgcaggaaaacctgtacttgcagcacaacttctgatgaaatgtcaagaacagttgaaaattcaggcaactgtctgctgtttatggtcagcattgtgaattcagccaatgtgacctgccgttgctatattggaaattgcattgaaatgtttataaatccaatggtacctggccatctaaaagggagagagaactagctatagagagcactggaagaaattttagcagccggaggcatttctttgtagattattttaaatttttttggctctctttcctgatgttatttatatgtggatggtaacatttgatggatgctcatctgtagcttacagatctgtaccctaaacatcttttgcatgtctagtcttgctttttcctgcaaatttcaatgctgtatgccaatc

SEQ ID NO: 3373 - DNA, 2251 bp, Oryza sativa
  Clone ID: PAT_MRT4530_69460C.1
ttgtgctctggttttccgcagcgtcgggccgaccagtcgaattgtctcgcccagactggcacgacgctggtctgtgtgttttttttttttttttatgactatgcaagaatattattaactatggcagccatggatacatcatacattgaatcgcaaagaaaattattatcatacaacttctctacaaatctaatgtcaatgtttgatcctggtctataaatgaaggcaacacccgctgtcaatcaaactgagggtacatcaaagggtatcattctgtaaattggaccagggaatcggtatgtatatatatgctctctatcatttcttcttctcaacatactactgtcagtgccacgcagaagcagatatcagctttctgctcctccagccgagaagcatcgcgccgtccttctcatccaatgtgtatttatcggagtagcaggcgagaagcttccttatcaccgagttgacgtacgagctcaacgggtaaggcctgaagccggccatggtcagcctcgacttccacttgccaagcagctcatgcctctccaccctgtccttcccctcgcaggcgatgatgttgacgatgtccttggcgaggcagtgctgctccacgctgatcctctccttgttgtcccgcggcaggttggcgtcgatcgactcgaacatggcggagtagtactccatggtctccccaaacctcatcaagaaaggcgttgtgttggtgtgtgactcctgctctaccaaagtagtcaccttcggggacagccctttcaccatccggagcagaccatcgcgtgggttgttgacatccacgctctcgtccggggtgtggtgtagctggagtgtgaagtttacagacagtgcttcacctggcctgatctcaagcatctctttcgtgacttgtgtggcatagacagacagaggcgtaaactccagaggtattttgaattcttcagacatgcttttcaacattttccccacaatgtcaagaccttcaccacgagcatactctgacactgggtcatctatcccggtgatccgcacacgaggaggaccaccaggccttgcagctaatgcttgtatcagtgtgatccattgagtcccttgagcaatctgaaaatcaattatgtggatattgttctcagttctcaatgcttctgcaatcgccccattggctgccatatagccaaacttgaagtaagggcagatattgtatagaattctcatgtaggacaggagctccttgctctctggctcacggcacttcagagcacggtagatgtttgtgccagagtttccatgtctagcaaccaaaccctccagtaggtaagcacctagacgttggattggttccccgttgattgagaccactccacgagcctcctgaacaagcttatggaactcctctgtcctgtcctcactcagagcctcagcacacctggttaatagctgcttcacaattatctgagggtcttcccttaactccctttgccgtttctctggacgaaattcatagcttgctgtggggtatccaccagatgcaaactgtgaccgaccaactccaggtaacggctgccgtgattcatgactccatgttctcgaccgctgcctcacaagctgagcaggcttgatttcctcaaactcatgcttggtgctagttgttgcatcatctgtatcaggtgccatcagaacagtctcaatctcccgtaaggcgtgttgcatattatgtcttgatgtagcatacaacggatcagctcccacttgaatgttctcctggagaagaatacccgcctgtctatatgagctgtctgcttccaatggggagattggttgggctgaaatggtttctgtagagctctggttatctggagtgttggtaagagcagacaaattgtcacactcaaattgggaagagagaggggtgtatggggaatcgctgaactcgtacttcagtgggttagcttgccagggagagttttgcaagttgttctctgtaggaatttcgtacacaacgttagcgccagtcaatctgtactttaataactggtgcaagtccataataaatgaacggagattagtcgttcatgacctcctccgatctgcacagccccgacgccgcagcgatgccccgatccacttccactcctctctctctctctctctctctctctctctctctggttctcttttcgtgtgctgcgataattatgcccgagccgcctcgtgccgaattcctgcagcccggggg

SEQ ID NO: 3374 - DNA, 1985 bp, Oryza sativa
  Clone ID: PAT_MRT4530_6952C.1
cctcggcgctgccgtctcggtgtccggcggcccggcgactgccccgtcggtgccggccttgccttccggcgccgcggatggcgacgcgagggcggattgtagcggcggtggcgagcgttgtggtggcgtggctggcggtcgccgtcggcgtgaacggcggcgggtgcgaggcggagcgggaccgggtggaggcgctgccggggcagccaccggtggcgttcgcgcagtacgccgggtacgtggcggtgagcgaggcgagcgggcgggcgctcttctactggctcaccgaggccgccgccgccgccgccgccgccaccaagcccctcgtcctctggctcaacggcggtcctggatgctcatcgattgcgtatggagcatctgaagagattggcccatttaggattaagacaaacgggacagggctctatctgaacaagtactcatggaacagagaggcaaacctcctgttcctggaatcacctgccggagttggcttttcatactccaacaccacctctgatctcaagacatctggtgatgagaggacagctcaagatgcgttgcagttcttgatcagttggatgtcccgcttcccacagtatcggcaccgggatttctacattgctggagaaagctatgctggacattacgttccccagttggcaaggaagatcgttgagttcaacaaggcctcaccatatcctttcatcaacctcaaggggatccttgtgggcaatggggtgactgacaactactacgacaacatcggcacggtgacctactggtggacgcacgccatgatctcggacaccacctacaaggccatcatgtcgtcgtgcaacttcaccagcgccaacgtctccaggctctgcaaccgcgccatgagctacgccatgaaccacgagttcggcgacatcgaccagtacagcatctacacgccgtcctgcgccgccgccgccgccaacgccaccggccgccgccgcggcaaggccgccgtgctgaggttcaaggacaccttcctacggcgccggtcgttcggctacgacccctgcacggagacatacgccgagaagtactacaaccggccggatgttcagaaggccatgcatgccaacatcactgggattccttacagatggacagcctgcagtgatgtgctcatcaagacgtggcgagattcagagttctccatgctgccgacttacaagttgctgatgaaggccgggctgaggatatgggtgttcagtggcgacacggattcggtcgttccggttactgcaacgaggtttgcgcttagccatcttggactgaagacgaagatccgctggtacccttggtactcagctggacaggttggaggatggtctgaggtgtatgaagggctcacatttgcgtcagtgagaggtgctgggcatgaggtgccactgtttcagccaaggagagcattcaggatgtttcagtcgttcttggcaggggagccattgccaaaatcctgatggtttcctgccaacaactgatgtctagctacaaagtctagaaatctgtaaaagatgcttggtagaggtgcagtgtagttgataggtgaggagtgtgattgattggtgttgggaaaaggataataagagaataaggatggttgtgccatggaaaccatgggcatcgcaacaaggagctaataaacttgaagccttccgctctgtttaccactaaggttccatttggattggaggaatttcgctggaattttagaggaactgaactatttcctgtgaaaatcctataaaattcctgtgctctgaaggaaccctgagcaattatctcatcgaaaaagaatatatcatgtacgcaattcaacgcaaaagggagccatgaagtaatttgctgaatatagccatgtatagtgtcaccagtaacggaagtacctttatttatcatgaaaataagttccctgacatacagggataacatgcaaaaaaaaaaaaaaa

SEQ ID NO: 3375 - DNA, 6900 bp, Oryza sativa
  Clone ID: PAT_MRT4530_69536C.1
atggatgcctctgctgcatccatgctctggactctgatcatcatcctcgccgccgcagccgctgcctcctctgtccatccaccacagcagcagagctatggcgtcggctgcatcgcggcggagcgggcggcattgctctccttcaaagaaggtgtcatggccgacccgctgaggctcctcgactcatggcagggtgcaggagactgctgtcggtggaacggcgtcgggtgcagcaacaggaccggccatgtcgtcaagctcgacctccgcaacactctctactgggatgaccagcgccaagttagactggacaaccctcacgccatgcgtggacaggtaagcacctccctgcttgccctgaggcgtttgaagtatctttatctcagcgggaacaaccttggaggaccgggtatagccataccatcgttcttggggtctctcgagagcctggtctatctcaacctctcctgtatcgatttctttggagaggtgcctactcagcttggcaatctctcccggctgtcctacctcgacgttggcagcatgtattattctggacagattttctcatcggatctctcctggctgggacgcctctcttcactgaagtatcttgacatgagcggtgtcaatctcagcatggtttctgactgggctcatgtggtcaatatgcttcccaatttgagagttctcaatctcgaactgtgtcaactcacgagatcaaacccaccacttctgcattccaaccttacagttcttgagaagctcgttctttcttccaacaacttctatggaccacttgctactaactggttctggggtataaccacccttagaaccctcgaagtggagttctgttccctatatggccctcttcctgatagcttgggaaacatgactgcacttcaagttcttgacatgcaagataatgataatatcacaggaatgtttccaccaactctgaagaatctatgcaatttgcaagaagtcttcactgggactaacctgagcggggacataacagaacagatggagaggctgccaaagtgtgcatgggacaaattgcaggcattaaatctggatgcaaccaacatgacaggcaatcttccagtttggttggtaaacttgaccaacttgaaggaccttagtgtctcagggaaccagcttagtgggcctgtgcctttggggcttggagctcttactaagttgactatattgtatctaggccacaataacttgactggtatcatatcagaagactatcttgctaatctttgcaatatggttatattggacttgagctacacttctttagaggttgttgtgggttccacatggactcctccattcaagttaatcagagcacaactggcttcatgtcaactgggtccgggatttcctatcttgtttaaacaccaaaagggcattatctacattgatgtttcaaatgcaggcatagccgatgcaatcccaagttggttttgggatgaaatttcctatgcattttatgtggatatgtctcacaatcaaattgatggagaattaccagccaaacttgaagcgaggacaaggcaagaattgcacctcaattcaaaccagctaaagggctcaattccgcaattactcagaaatatcaccaagctagacatctctagaaactccttatctgcaccattgccttcagattttcaagctccggaattggcagcacttgtcctattctccaactacattccaggcagtgttccactgtccatatatttggaacaacaactccttcaaatccttcagtgcaaaaaagagaacttccctctctcttaccttggtctgccactgtcaacacacaaacttcgcattcaagatcttcgccctaccattgcgaaagtggacaaatacctggcaggttgggaggccagcctcttatcctatgcagaacggattgtcctgattaatgcagctcttaatagtatcccagtttatgccatgtctgccctcaagttgcctcttggaacgatcgaagaaattgacaaaaaaagaaaagcattcctttggactggagacgatagctgctcgggagctcgctgtctggttgcttgggatcgagtttgccaaccaaaggaatgcggaggattgggcataaaagatttgcaccttcagaacgaggcactcctgataaaacgtctcttccatcttcaccactcgaactcatcctgggcaaattggatttgggaggaattttcggacacctcgttacttcacctgggaacacactggagctccttgcagtccctcctgccgacgatgcgcaggctttccctagtctctatcggcgacgaagctcacacttccttttggtttgacaactggctccctgatggaccactatgtgactcctttgctgccctgctcacgcactctctcgacctagaaataacagttcagaccgtatttcaaacaggcctgcaacactgcttcgtccccaggttatcctcagtggctctagcgcagctagacgctcttcaggataaattgctttcggtccatcttcatgaatgcccagacttcagagccgcgaaatgttctcctcaattgccaatcttgtcagctaaacatatatatgaagccactcaggtctggctggatgcttgtccaaactggaagttcgtgtggcataacaaggcaccactcaaagctcaactcttcgcatggctcctggctaaggaaaggctaccgacaaagcataatctgagaatgagacacctcatggtcatcctatcagagagggcaacaatgattggtcctcggcgacgggcggcagcgaggcggggatgcagggcaccgccgcagagaagagaagacccggaggatgatgaggatgacgacgggcggcggtgccacgctgaggatattccaccacgccgccgctcgctgcgcgatgtcatcattggaaggggccggtcggttgagtcgcgggcggcggaaggggcgcgacaccggagccgcacgccgcatccttccagccgccagcgagcgcacggcaatgggcgccaaggccgctcacggaccaggcacagctcccaatgctcctgccgctgcagatcccgtcgcacgcgctccccaagctccttgactcctcgcggtcaggacggcacgggcgatgcaggcggcgcgacgaccaaggtggtcgctgtcagtggccaggctgatggcgaccagcagccagtcaacgctctcgtgagtctccccgaccctctgatccagatcctatgctcctcacctctcctccccttctcagacgaacagggggaccatgacccgatgctgccgctcctggcagagatcgctcccaagtcttcacgggaggcggagaacgagacgaagaggacgggtggggaagaaccgatactgggagaggataaggtggcgtcggcagctgagttgggccaggagaagatgggccatctcggcccagatgcgcagcaggcccccaagatggacctcctcgctcagtccactcaagatgacgaggcccaagcttccacaggagaccagcccaccctggtgcagcaggccgactgcgaggagcaacaccaggccacggtccagactcagcccatccacggaggagaaggtgaacgtgaaaaggtcgtcttatctcctctgttctcacagctgcagccgccgatcatcctgcaggcgccgctcgagctggcgccgcccggcgcggccaagacgaaggggtgcggacgcaaggtggtgcagatgccgtcacggcggagcggccgtaaggcgcgcttctcgtcggtgccggtgtccaagcgcgcagaagtgcgcctcatggaggagatggggctgctcaccccgggtgaaccggtcggggatgcggcggtggaggcttatgcaaagtccttcgacacaccacttccgttgcatgtcatcgccggtctgcgggtgctcacacgcctggatggagtgcacgacatgccggtgccaggagaggaaggaaccaccacaacggcggtgccgctgctcgctgtatggtcgatgcgactagcgctcccatgcagcaacggccttaagccagagctccttagtcggttgatgcgaatagcgctcccggtagacaccggccttcagctggttagtagcagagtagacaggctagaagatagtgaaattgcttctacatgttggaatgttcgcggactaaataacccagcacgaagagaggcagtcctcgaagcagccgagctggccagagcaggcatcctgtgcttgcaagaaacaaaattaagtagtatagaccaatggatcggcaaagagattgggggaaacaggttgtcgaacttcaatttccttcctgccaatggaactcgtggaggaattgccatcttctgggatgacacaattgttaacatggcgaatttctcccaaggaacacaccatctttcggtgatggcaacgaccataactgataacctcagcttcatcatcatagtagtttatggaccctcagaagactgtgacaaggaaaatttcctcgccgaattagtcacagccaagccaccaacagacacgccatggttggtcatgggggacttcaacatcatatacgaggctagggataagaataaccagaatttgaacaggcatctaatggggcgcttcaggctggatgtagccctggaaacaagaactctgacagcagaggaacaccaattcaggaaagacctcaagataagaattctagggctagcagcggtggaaaaggcgaggaagaagcaagcatctagggtaaaatggctaaaagaaggtgatgctaacacaaggttcttccacataaagatgaatgctcgaaggagaaaaaaattcattcattgcttgcagcaagatggaaataccctgcacacacacgaggacaaagcagctcaccttcatgcccacttcaactcaatcttagggacaagaagacagcgtggctgcacattaaattgggaagcattaggactgagtacaatacaagatgatagcatggatgagccgttcacagaggatgaaatctgggaagcaattaaaaactctccaaaggaaaaagtgccgggcccagatggtttcactggagctttctacaagagctgctggcacataataaaaaaggaaattgtggacgtttttgcaagctttcacaacctcacaggggggaactttggaagcatcaacagggccatgataacactgctgccgaagaaagactcgccacgctcggtgaatgactttagacccattagtctgatccactctgtggcgaagcttatatccaaaactttggcaatgagactggcagcactgcttggtgatttggtctcgcatgcccaaagtgctttcatcaagaagagatgcatacaagataactttctctatgtgcgcaacatggtccggtccttgcacatgcaacggaaaccatccctcttcttcaagttggacataacaaaggcatttgattcagtatcttgggaataccttgtcgaaatgctgcagtggagaggctttagtcagcgttggagaaattggattgtgcttctcctatcgactgcatcatctagaattttactcaatgggatagcgggagaaccaactacacacaggcgaggtctccggcagggtgatcccctctcgccctacctcttcatcctagcaattgacccgattcaacgactactcaacaaggccacgcaagaggggcttctatctccgttatcaaaccgagcagcgcagttcagaatatccttatatgctgatgatgcagcgatctttataaactcgatcaggaatgatgtcaacaacttgattagcatcctcaagttcttcggcgaggccacaggccttcaagtgaatctgcacaagagctcggtcgtgtccatcaaatgcgcagagcagaacctgtctgaggtgttggaaaatttcaatggacagcggggcaattttcccataacatatttgggattgccgctcaccccaggccgcatcaagagaatacacctgcaaccggtgatggacaagttgcaatcaaggttagcgggatggaaagggaagttaatccagcaatcagggcggaagacgctagtcatgtctgttctcagcttcataccaacctacttccttaccgccttaaagccgcctaaacagttcctcacagacatggacaagattaggaagaaattcctctgggccggcgatcaagagattagcggggggaagtgcaaagtgaattggaaaaaagtatgctccccaataaagatgggaggactaggcgtgttggaccttgataaattcgcgagagctttgagactccgttggctatggtttgagtgggagtgccctgacaaaccttgggttgggacaacacccccctgcgatgagttagatgagcaaatcttcgcggccgcaacaaaggtaacaattggtaatgggcggaaggcaaaattttggacatccaactggattggacaccagccgctgaaatacctagcgccagcgcttttcaaccactctaaaggaaagcaacgcttggttcaggatgcgttaaccaatgacaaatggattgaggatattaggcatgagctgtccatgccactgatccgagaattcttcgcagtgttccgccttatctgggataatgagacaaacctggaggaacgagttgaagacaccatcacctggagatggacaaataccggtaaatacacagcaaaatcggcttatttagcccaattcgctggtagaaaagactcaagggccgccaccttgatttggaagacatgggcgccatccaaatgcaaaaactttgcatggcttgtcctgcaaaacaggatatggacatccgaccgcttgcaagtctga

SEQ ID NO: 3376 - DNA, 2831 bp, Oryza sativa
  Clone ID: PAT_MRT4530_69540C.1
atggcaatgaccataactgataacctcagcttcatcatcacagtagttaatggaccctcagaagactgtgacaaggaaaatttcctcgctgaattagtcgcagccaagccaccaacagacacgccatggttggtcatgggggacttcaacatcatatacgaggctagggataagaataaccagaatttgaacaggcgtctaatggggcgcttcaggctggatgtagccctggaaacaagaactctgatagcagaggaacaccaattcaggaaagacctcaagataagaattctagggctagcagcggtggaaaaggcgaggaagaagcaagcatctagggtaaaatggctaaaagaaggtgatgctaacacaaggttcttccacataaagatgaatgctcgaaggagaaaaaatttcattcattgcttgcagcaagatggaaataccctgcacacacatgaggacaaagcagctcaccttcatgcccacttcaactcaatcttagggacaagacgacagcgtggctgcacattaaattgggaagcattaagactgagtacaatacaagatgatagcatggatgagccgttcacagaggatgaaatctgggaagcaattaaaaactctccaaaggaaaaagcgccgggcccagatgatttcactggagctttctacaagaactgctggcacataataaaaaaggaaattgtggacgtttttgcaagctttcacaacctcacaggggggaactttggaagcatcaacagggccatgataacactgctgccgaagaaagactcaccacgctcgatgaatgacttcagacccattagtctgatccactccgtggcgaagcttatatccaaaactttggcaatgagactggcagcacggcttggtgatttggtctcgcatgcccaaagtgctttcatcaagaagagatgcatacaagataacttcctctatgtgcgcaacatggcccggtccttgcacatgcaacggaaaccatccctcttcttcaagttggacataacaaaggcatttgattcggtatcttgggaataccttgtcgaaatgctgcagtgcagaggctttagtcagcactggagaaattggattgtgcttctcctatcgactgcatcatccagaattttactcaatgggatagcgggagaaccaactacacacaggcgaggcctccggcagggtgatcccctctcgccctacctcttcatcctagcaattgacccgattcaacgactactcaataaggccacgcaagaggggcttctatctccgttatcaaaccgagcagcgcggttcaaaatatccttatatgctgatgatgcagcgatctttataaactcgatcaggaatgatgtcaacaacttgattagcatcctcaagttcttcggcgaggccacaagccttcaagtgaatctgcacaagagctcggtcgtgcccatcaaatgcgcagagcagaacctatccgaggtgttggaaaatttcaatggacagcggggcaattttcccataacatatttgggattgccgctcaccccaggccacatcaagagaatacacttgcaaccggtgatggacaagttgcaatcaaggttagcgggatggaaagggaagttaatccagcaatcagggcggaagacactagtcacgtctgttctcagctccataccaacctacttccttaccgccttaaagccgcctaaacagtttctcacagacatgaacaagattaggaagaaattcctctgggccggcgatcaagagattagcggggggaagtgcaaagtgaattggaaaaaagtatgctccccaataaagatgggaggactaggcgtgttggaccttgataaattcgcgagagctttgagactccgttggctatggtttgagtgggagtgccctgacaaaccttgggttgggacaacacccccctgcgatgagttagatgagcaaatcttcgcggccgcaacaaaggtaacaatcggtaatgggcggaaggcaaaattttggacatccaactggattggccaccagccactgaaatacctagcgccagcgctgttcaaccactctaaaggaaagcaacgcttggttcaggatgcgttaaccaatgacaaatggattgaggatattaggcatgagctgtccatgccactgatccgagaattcttcgcagtgttccgccttatctgggataatgagacaaacctagaggaaggagttgaagacaccatcatctggagatggacaaatataccggtaaatacacagcaaaatcggcttatttagcccaattcgccggtagagaagactcaagggccgccaccttgatttggaagacatgggcgccatccaaatgcaaaaactttgcatggcttgtcctgcaaaacaggatatggacatccgaccgcttgcaactccgacaatggcccaataactacttttgccaactctactacaggaacttggagacggcgcaacatttattaaaggattgtccattcacgcgagaaatttgggacaaaataatggctaggatgaaccacaaccaacccttcccggtgcacaatccggacgagagtctagttgactggtgggaatcaagaacaaagcaacaaagcaaatgtcaaagtaaggggatgcagtcactgcacatgctcttgagttgggaaatctggtgcgagaggaacatgcgagttttcaaagataaagaacttcaaatccctcaactaacggcaagaataatggacgaaatacatacatggtcggcatgtggggcaaaatatcttgcgagaatagcgccttaa

SEQ ID NO: 3377 - DNA, 1490 bp, Oryza sativa
  Clone ID: PAT_MRT4530_69798C.1
cgggggatgaaagtgcagagatgaattattattgataaaaactgatcataaaacaagttagcagagaggaatgaattaattcacacaaatgatgtgacggttacatgttggtcaaggatttattctggataaaccatacagccttgaaaattaaattccctctatatatttgacaccgtagcaaaaattgtcaaatatgccgcataccactattgggcactcttcctgccgttttaagtgcttctcactggattgaaatatggatgagccatggcttcctttgctgtaggcctttcctggtgatcgtagcgaagcaacctgtctacaaaatcaatagcctcagggcttgctaggtgtctgttccccgagttaacaaacattgaccatggcttcctattatgtcttccaacaagtctttcaagctgcgggtcaagctcaagaccatacttttcaaggtaattgtagaaatcttctgttccaagaacctcggtaattttgactaattggtcgtagttatcctgaccattaaagaaagggtcgactcggaatatcattgcggcaaacatgcaaccaaggctccacaaatccaacgagtaatcataatctagcaaatccacaagaagttcagggcccttataagatcttgaagcaactctagcattatattccatcttgggatgatagaactctgctagaccccaatcaataagacaaagctggcgtttctcatgatcaatcatgatattgtgaggtttgacatctcgatgcatgatgcctcgtgaatgacaataatctagtgcattactaaagagactggtcggacagataacctttaataattcgtaaatgtagtatctgatatcgtaatccaatagtgttgggtagagtactttgaaatcagtattgttgacatattcaaagatcaaactaggtgtcttcgattcatcatccctgacaacatcaagtagctttacaatattcggtccgccatataagttttgaagtatctttatttccctctttatctttttcttcttgacgggcttgaggatcttaataacgcacctctcgtcacccccgggccggaatccctcgaacacctcgctgtacttccccctcccaagcttgcgcagcacctcgtacccatcctgctccccccattcgatgtcgagcgactcgtagtcccagtactccttgggccgctgggagttggcgtcggcgtagacgcgcgccacggaggcggcgcccccggggtgccgcgtggcgcggccgatgcgcggcggcatggggagcggcgcctcggctgcggctgccgcggcagcggcgtagacggtgggggcgagggggcggcggcggcggcggctgttgctgtggtggtggtgggggtgcgcgtagcgcggggccgcagcggaggagaggaggaggcggcggagcagctgcggcgcggtggcgagggggaggaggcggctgcgcgcggcgcaccaggccat

SEQ ID NO: 3378 - DNA, 3525 bp, Oryza sativa
  Clone ID: PAT_MRT4530_70006C.1
atggcagaaggcgtggtattcgctgctctatgcaaaattggatctgtcttggcatcatctgcaagcataacattaggtggacgtttagatgcaaacttgacaataataaatgagattgagagtcgaataaaacagatcgaagttgagctcaagttgatgcaagcattcctgcgccaagcgcaaaaacaagaaggctatagcgagcccactgaagtctacctgcaggaagtaagaaaagcagcttttgaaattgaggacatcatcgatgagtttctttacctgtctgttaagcacaagaacaggtttttcaatggggagttcatgagttacttccgtaaactcggtaaaacttcttggcacaaaattgctagagagctgaaggattcgcaatgtcaccttcagaatctccggaatttgtgggtgcagtatgagattcagcttccaaatggcaatagagtttcaaccgatgtggaggatcaccggcttccgcatcatctttcttacccagctgatgagatggtgggtgttgaacaagaaagaacaatgatgatgaactggttaaaaacatgttcgacatcggttatcactgtctggggtatgggaggatctgggaaaaccactcttgccaatagtatctatgaagatgagagaatcaagaatcagtttgattgccatatttggatcacagtgtctcagaagttcaacgcttctgacatcatgaggaagatggtacgtcacatgttgcaacggtgttcacccaacattgatagcatcgatggtagagacctggtagaaatcctgaagagaacattagaacatagaaagattttgcttgtactagatgatgtatggagcacagatgtttggatggacctggcaagtacagttgagagaagcaacaacaatggaaataaggtcgtaataacgactcggatcaaagatgtcgcttctttggcaagcgaagatcaggttcttcagctgcaaaagctgaatgatgcagattcttggtgtctcttttgcaggtgggcattcaagaaccgcattgatagatcttgtcctcaagaactagagtcattggggagagagatcatggtcaagtgtgatggtttgccattagcaattgtggttgtgggtaacatgctctcattcaagaaacaagatatggaagagtggagcaagtgcaatgatcagctaacctgggaattacgcgacagattgcgcgaccaggagttgagttcagtgatgaagattctgaaactgagttataagaacttaccgagccacctaaagaatgcatttgtgttctgcagcatctttccagaggattacatgataacaaagaaaaggctggtcagactatgggttgcagagggcctcattaagccggaaaagagaagaacagtagaagaagtcgccgaggagtacctgaatgagctgatagaccgatgcctgctacaggttgtggagaggaagcacttcagaaaggtgaaggaattccagatgcatgacattgtgagggagctggccatttccatatcagaggacgagaccttctgcatgacacatagtaaatcgcaccccggtgaacccgaatacaggtgccgtcgtttgtcgatacatgagcacaatgacaggatcaagtcggtttcagatccttctcgactccgctcgctctaccatttcgatgtaacctgttcttcttttccatctgtgggtacaccaagaagtgcaaggtatctgaatgttctggagctgcaggatgttcctatcacagttctgccagaagaattgtcaggcttatttaacttacggtacctcggtttgagaagaacaaagatcaagcagttgccacaatcagtcgacaagctgttcaatctccaaacacttgatgtttaccttacaaatgtagacaagttgccaactgggatcgccaagctgaagaggttaaggcaccttcttgcaggaaagttgagtgctccactgtattgcggcattgttgagaagtccagaggtgttcaagctccaaaggtggtgtgggagtctatggagctgcaaactcttaagggtgttcttgcaaacctaaatcttgtggaaaatttgggacacatgactcaactgaggacattggcgatcgaagatgtcggagaagaacactatcccaagctctttgcatccatcagcaaaatgcgctctctacgcacactgaaagttctttcagctgaaggtaatcaaggtctgaactttgaagcactgagcttaccaccacagaatttacgcaaactccatcttaccggaaggtttcaccatgctgtgatggaatccaatttctttcagacagttggagctaaactggagaagctgtatctcacaggaagtaagacgaacattgatccattgatctccatctcctgcctctccaacctgaaagtgctccagatcggagatgcatacgacggagcaagcttcgtcttccagagcggatggttccccaagctccacacactcatcatgtgcaacttgttgcacatcaattcgatgatcatggagcagcagacgttgcagaacctccagtggcttgcactggtcaacttccctgagctcaaggaggtgcctcatggcattgagcttctcttgtcactgcagaatttgatgctggtgaacatgcatgatgagttcatggagcgtatacagggccaagaagatccattgggcacaatgagcaggctaatggatagatgtttgaatgatgatgaaactgtgatcgatgctggcatgtgtaactacggcggtttgggtgtaccgaatctggagcttatgggtatagctcttcgttccaggtggacatggttgcaacggacctcctcaagcaaaccttggcaggggctagccattccggggtcgcaaaaggaaaggaacttcgttgcagcctctaccatctgtcaattaagagacggacaaactatcctcttctgggaagatagctggttgcaagagggttgcattcggtcctttgctccgaacatctatgataaaattccaccacgcgtgcgccggtgtcggacggtggctgaggcactaacaggtcgccaatggatcaaagacatccgaggagcacttgggatccaacctattctagaatatctaaagctttggtcgcttgtccaaatggtggatcttgatcctactactcctgattcaatcatctggaaatgggagagttcgggccaatacagctcaaaatccgcctataaggccttgttttctggtcgtgtcaccttcctttccaccccaatttggaagtcgctcgctccgcctcgatgctgcttcttcttgtggttggtcgcaatgaacagatgctggaccgctgaccgtctgcgcagtcgagggttgccacacccggatcgctgtgttctttgcgatcagtacgaggaaagcattgatcacatcttggtagcatgccttgtcaatgagccatccttccacaattggctttgtgagagccgaatgaagattggggagcggcat

SEQ ID NO: 3379 - DNA, 1592 bp, Oryza sativa
  Clone ID: PAT_MRT4530_70155C.1
atgccgcgcggccgctccaccaccaccaccacctcctcgtcggcgtccaaccccttccacgccttcgcctccaccctccccttcctcccctccccgtccccgtccccaacctccgcctcgccctcgccctcgcccccggctccccacctcgccgtccctctcatcctccccatcacctcctcctcctccgcctccgccgccgcggcttcccccgagtcgaaccgtggggcgcggatggccgcggcggcgtcaggcggcaaggcggggggtggaggtggtttggggaagggcgggggccccgcgttcgtggggcaggtgttcaccatgctcgacccctccgggaacggcctcatggccgtcaccacccgcttcgagctcccccaattcctcgccagcaggactcctatgtggttcaaaaggatcttatcgccattgaagaagagtgaaaatggtccagtatttaggttctttatggatttgaatgatgcagtatcttatgttaaacgcctaaatgtgccaagtggtatggtgggggcttgtcgccttgatgtggcatacgagcatttcaaggaaaaacctcaaatgttccagtttgttccaagtgaaaagcaggttaaggctgccaataagctcttaaagtctcttcctcaaaggagaagaaggaaaaaacttgatggtgtccccgtctttagtgctcaaaacttaaatattgccgtggcaacgaatgatggaattagatggtatacaccatatttttttgataaaaacttgttggacaatattcttgaagcttcaatggatcaacattttcactcaatggtccaaaatcgccacacacggcgtaggagagatattgttgatgatagtttgacatctgaaatgatggaagaaagtgcagacagtttccttgagcccccagaggtacaagagttgatgaatgagattggtccagttgggataccgctaaatgttgtaacaaaagcagcggagattcaatttcttgatgttgttgataaaatgcttctaggaaataagtggttgagaaaagctactggcatacagccacaattcccctatgtcgttgattcatttgaagaaaggactgctgctgcaattgacagggctgctactgccagtagtagttttactgcttcaaaggatgctgattgcttccaaattagtaaacaaccagaaactttggagtcagacgttgataacagcaaccgtggaaaacatgaaaactcaaataatggccaatctcacttcccatttagcaacctgcttcctaatatatggccaggtcatgatagaagtttcaaagcacaaggaagagacagagcattcagaagatgtgatgccagcatcaacaatgatttacaagccaacccacttctccccaaaatcacgatggttggtatctcaatgggcgaaggtggacagatgagcaaagccaacttgaagaaaacatggaagacttgactaaagagttagaacaagcaggcgagaagactatctttagcgacgagaaagacccactctttgttgccaacgttggcgattactcaaggataactaagattagctctacatga

SEQ ID NO: 3380 - DNA, 4613 bp, Oryza sativa
  Clone ID: PAT_MRT4530_70289C.1
atggtggtttcccccaccgtttgcaatgtgaagttggggcgtgtcctcatagacgggggtgcaacccccccctcccctccacagccgcgttcgcatccgccgccgcagccgcagccgccgccgccgacgccgacgaggagaggaggagagggaaggcgagagggaggtaggtaggtaggcagttagccatgtcgccggcggagccgacgagggaggagagcgtgtacaaggcgaagctggcggagcaggcggagcggtacgaggagatggtggagtacatggagcgcgtggcgcgcgcggcggggggcgcctccggcggggaggagctcacggtggaggagcggaacctgctgtccgtggcgtacaagaacgtcatcggcgcccgccgcgcgtcgtggcggatcatctcgtcgatcgagcagaaggaggagggccgcgggaacgacgcccacgccgccaccatccgctcctacaggggcaagatcgaggccgagctcgcccgcatctgcgacggcatcctggccctgctcgactcccacctcgtcccctccgccggcgccgccgagtccaaggtcttctacctcaagatgaagggcgactaccacaggtaccttgcggagtttaagtctggcgacgagaggaagcaggctgcggagagcaccatgaatgcatacaaggctgctcaggacattgctctcgcagatttggctccgacccaccccataaggcttgggcttgcactcaacttttcagtgttctactatgagatcttgaactcccctgaccgtgcctgcaacctcgcgaagcaggcgtttgatgaggccatatcagaactggacagccttggtgaagaatcctacaaggacagcactttgatcatgcagctcctgcgtgacaacttgactctgtggacttcagatgccaatgatgatggtggtgacgaaatcaaggaagccgcagctccaaaagagcctggggatcagtgagatgaattcggacgccagtctgatgcaccatctgttgttgttggggcaatggacattgatgtcttcggctttcagtagctatcttctagtacacgaactgtcgtcgcaccatcgcggaggagacgatgatgttcttaaattacttaagtagttctgggtcacgcttttgttcagttgataaatgatggctggatcctggttttcttgttccacgatgccagccacaggaaaaaccctactattctgcactgttagaatgctgttatattaaccatgtttgacaagacattttcagtatgtttgtatgaccgtcttggaagtgtttggttgaacctgtctcagggtctttggtccaagacattattcacctggcttgcttaactcgttttagagaacaaaaagcgcgacgaggacaaccctcactccgcgcatccccaccctgtgtcgactcgacccgggagagagcagggaggagaggcccccgagccgaacggcggcccgaggcccccgacggtcagagctggccctctgcccgcttgtccgacggtgccaggcgcccccgacccccaggatggccccggggccactgcgggaaggccgcgcctgtcgccctctgaccccgaggtcgtcggcacagaagtcgagtgcgcccctggtggcctctcggacgaagagcgccctggagatgcggcccctggcgaagaggatcggccccgccgaaaggtgcagcggcccgtctacttcgttagtgaggccctccgggacgccaagacccgataccctcaggcccagaagatgctttacgctattctgatggcttcgaggaagttgcgccattatttcctggcgcatcgggtctcggtggttacgtcttaccccctcggccaaatcttgcataaccgagagggtactggacaggtggtgaaatgggcaatcaaactctctgagttcgatttgcactttgaaccacgccacgcgatcaagagccaggccctcgccgactttgtggcagagtggaccccagctcccgagcccgtctccgtcctcgaggccagctcgggcccctcgcagctgcctcacaccgcctactgggtgatgcagttcgacggctccctatctcttcagggcgccggtgcgggggtcacgttgacctcgctgaacggagacgtcctcagatacctggttcgcctcgactttcgggcgaccaataatatggcggagtacgagggactccttgcgggactcagggtggcagctggactggggatccgccgcctgctggtgttaggcgactcccagctggtcgttaaccaggtctgtaaggagtaccgacccccaccgggcgcctttgaagaaaggcttgcccagccgtcggcgcgacccgaccccctaggggagacggacgcgcctgaacggcccccgaggcccgtcggagtccaggcctcgggacccgatgggagcgttcccagctcccttagattgattgcttggatcgctgagatccaggcgtacctcgcagataagactctacccgaggaccgcgaagggagtgaacgcgtccagcgcatctccaagcgctacgtgctggccttgcagaccatacctctttcgtggctgtttgctgtctgggggctcgatatcctgggtccgtttaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcacctcccccgcccaccccagaagcaatggccaagtggagcgcgccaacgcggaaatcctcaagggcctcaaaaccaagaccttcaacatcctcaagaagcacggcgactcatggatcgaggagctgccagcggtgctctgggcgaaccgaaccacgccaagccgagcaaccggggaaacgcctttcttcctcgtctacggcgcggaggcggttctcccatctgagctcaccctgaggtcccctcgggccaccatgtattgcgaggctgatcaagatcagcttcgcagagacgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctccgttcggctggccatgggcgacggcacagagctgcctaacccgtggaacatcgaacaccttcgtcgcttctacccctatggaaccatgaatagagtacccaccagttggggttttgtttattctagggtgaacaaggttaccactttggctccggcgtttatgttgtgggtcttgtgcgggtaccgtgtgcccacgggatccgtgtgggcccagggttccccaagaggggaaggctctcggtcgctttttggagcgcaaagggccggcacgcggttgcattggcggaacggcccggttgccgtggaccgccaacgggtccgggcgagtggacatgcggggcaccaaccggtccagcaacggcgcttcgtcgtcgtcgtcaaaagattccccacgttccccgtccccaccaaagccgcgttcgcatccgccaccacaaccgcaacccgccgccgccgacgccgacgaggagaggaggagagggaaggcgagagggaggcggagcggtacgaggagatggtggagtacatggagcgcgtggcgcgcgcggcggggggcgcctccggcggggaggagctcacggtggaggagcggaacctgctgtccgtggcgtacaagaacgtcatcggcgcccgccgcgcgtcgtggcggatcatctcgtcgatcgagcagaaggaggagggccgcgggaacgacgcccacgccgccaccatccgctcctacaggggcaagatcgaggccgagctcgcccgcatctgcgacggcatcctggccctgctcgactcccacctcgtcccctccgccggcgccgccgagtccaaggtcttctacctcaagatgaagggcgactaccacaggtaccttgcggagtttaagtctggcgacgagaggaagcaggctgcggagagcaccatgaatgcatacaaggctgctcaggacattgctctcgcagatttggctccgacccaccccataaggcttgggcttgcactcaacttttcagtgttctactatgagatcttgaactcccctgaccgtgcctgcaacctcgcgaagcaggcgtttgatgaggccatatcagaactggacagccttggtgaagaatcctacaaggacagcactttgatcatgcagctcctgcgtgacaacttgactctgtggacttcagatgccaatgatgatggtggtgacgaaatcaaggaagccgcagctccaaaagagcctggggatcagtga

SEQ ID NO: 3381 - DNA, 2246 bp, Oryza sativa
  Clone ID: PAT_MRT4530_70309C.1
gctcccagccctttacacccttccacccccgccccggtgcatcacccggcgctcctctcgaaccttccaaagtccaaaccctagtggtgacctcgcctcggcctcgaaaccctagccgcagatctcgcctctccttgccccgcgccatggacgacgacttcgagatgccgccgcccggcgccgacgacgacttgatgatgggggaggacgggatgggcgacttcggcggcgccgacgggccgccgctgaaggtcggagaggagaaggagatcgggaagcagggtctcaggaagaagctgctcaaggagggcgaggggtgggagacccccgaggtcggcgacgaggtcgaagtacactacactggcacactgcttgatggaaagaagtttgattcaagccgtgaccgtgggacacccttcaagtttaagttgggacaaggtcaagtgataaaaggttgggatctaggtatcaagaccatgaagaaaggcgaaaatgctgttttcaccattcctcctgatttggcctatggtgaatctggttcacctccaactattccagccagtgccacactgcagtttgatgttgagttgctttcttggacaagtgtcaaggacatttgccaagatggtggtatattcaagaagatactgaaggagggagaaaaatgggagaacccaaaagatcttgatgaaatggatcttgatattgttgtcgcgaaatatgaggctcggcttgaggatggcactgttatatcaaagtctgagggcgctgaatttactgttaaagatggtttcttctgccctgcgctggcgaaagctgtcaaaaccatgaaaaaagcagagaaagtgctccttacagttaagccacaatatggatttggtgagaatggtagaccagcagctggtgaggaaggtgctgtgccaccaaatgccactcttcttgttaatcttgagttggtttcatggaaaacagtcacagaaataggtgatgataagaaaatcttgaagaaagttctgacggagggtacagggtatgagcggcccaatgaaggtgcagttgttaaagtcaaaataactggaaaacttcaggatggtacaatatttacaaagaaggggcatgatgaaccagagccatttgaattcaagactgatgaagaggaggtcattgatggtattgaccgtgctgtgctaaacatgaagaatggcgaggttgctcttgtaacaattcctcctgaatacgcatttggttctactgagtcaaagcaggatctcgctgtagttccaccaaacagcactgtgatttatgaggttgagcttgtatcattcgtgaaggataaagaatcttgggacttgaacaataccgagaagattgagactgctggggcaaagaaagaagaggggaatgcattgttcaagctgggcaaatatgtcagggcttcaaagcgttatgagaaggctgcaaaattcattgagtatgacagctcatttagcgaagatgagaagaaacaatccaagcaactgaaggttacctgcaacttgaacaatgctgcctgcaagctgaagctgaaagattacaagcaagctgagaagctttgcaccaaggttctggaacttgacagccaaaatgtcaaggctttatacaggagggcccaagcttacatgcaacttgctgacctagagttagcagaggtggatattaagaaggcacttgaaattgatcctgataacagggatgtgaagttgacatacaagaacctcaaggaaaaggtcaaggagtacaacaagaaggatgccaaattctacagcaatatgttcgccaagatgaccaagcagccagccgaagacggcaaagctggatctggagctgaatcgaagcaaggatcggaacctgttactgctgcctaaggacaggacactcacgacatatcttagattttgtgtgctggctaatctttgttctagtggtgcactgatgagaaacgttacttcccaagttgtcgggcgatgatgattcttgttgagattttcaaattgcaatccatatttgaaccaatctcgtcaaaaaaaaaaaaaaaaaaaaaaaaaaaaaaacaaccatacgccatgtcgggtccagtttgccacgaaagatcaagagagcattagctgagatgtgaactagaagtgcagatgtttaatgcgagatatcaatgcagttgcgcaacattagatcaccaaaaaaaaaaaaaaaaaaaaaaaaaaaaaaaa

SEQ ID NO: 3382 - DNA, 481 bp, Oryza sativa
  Clone ID: PAT_MRT4530_70658C.1
tcgtaagaagaagagaaacaacaagaagtagtaatggcttcctctatgctctcctccgccgctgtggttacatccccggctcaggccaccatggtcgctccattcaccggcttgaagtcatccgctgcattcccggtcacccgcaagaccaacaaggacatcacttccatcgcaagcaacgggggaagagttagctgcatgaaggtgtggccaccaattggaaagaagaagtttgagactctatcttacctccctgaccttagtgacgtcgaattggctaaggaagttgactaccttctccgcaacaagtggattccttgtgttgaattcgagttagagcacggatttgtgtaccgtgagcacggaaacactcccggatactacgaaggacggtactggacaatgtggaagcttccattgttcggatgcaccgactccgctcaagtgttgaaggaagttgaagaatgcaagaaggagtacc

SEQ ID NO: 3383 - DNA, 2474 bp, Oryza sativa
  Clone ID: PAT_MRT4530_70933C.1
cccacgcgtccgcccacgcgttctccttcgatttctctcgcctccgcttctccactctccggtagatcccaccctccaccgccgccgccgccgccgtgctccggtgagccgccggtgagccggagactacagcgacgtcgcgcagagccgttgggcgggtaggcggttgggggctttgcccgagatggcgacgatggggagcctgatcgggctggtgaaccggatccagcgggcgtgcaccgtcctcggcgaccacgggggcggcggcgaggggggttccctctgggaggcgctgccctccgtcgccgtcgtcggaggccaggtacgcgtgctcgccaccaccctgcctacttagctctcagatgctaagccatggagggcaaatctggatagggtgctcgcgcccgttcggttgacgtttgtgatgcatccagagttcggggacgtcgtcggtgctggagagcatagtggggagggacttcctgccccgtggatcggggggcctcttgtcctgcagccccacaagacgtaggggggccaggagttagccgggttcctccacgccccgcggaagcgtttcactgactttgctgctgttaggaaagagattgctgatgaaaccgatcgcattactggaaaaacgaaagctatatcaaatattcccatccatttgagtatatattctccacatgttgtaaacctgacacttattgatcttcctggattgacgaaggttgctgtagaggggcaacaagaatctattgtccaagatattgaaaacatggttcggtcttatgttgataagccaaattctatcatactggccatatctccagctaatcaagatatagcaacatcagatgctatcaagcttgctagggatgttgatccttcaggtgacagaacctttggagtgttgacaaagcttgatttgatggataagggtaccaatgctgttgatgtacttgaagggaggcagtatcgtttgcaacacccctgggtgggaattgtcaaccggtcacaagctgatatcaacaggaatgtcgacatgctagcagcaagacgcaaagaaaaggagtactttgaaagtagcccagattatggtcacttggcacataaaatgggtgcagagtaccttgctaagcttctgtctcagcacttagaggctgtgatcagagcaaaaattccaagtattatagccatgattaacaaaacaattgatgaaattgaagctgagttggatcgccttggtaggccaattggaggtgatgctggggcacaactgtacacaatattggacatgtgtcgtgcgtttgaccgagtttttaaagagcacctagatggcggtcggccaggtggagatcgtatttatggtgtctttgaccaccaattaccagcagcactgaaaaagcttccatttgataagcatctttcattgcaaaatgttcggaaagtcatttcagaggctgatggttatcaaccccacttgattgcccctgagcaagggtacagaaggcttatagatagttcgctccactacttcaggggtccagcggaagcttcagttgatgcggttcatttggtcttgaaggaacttgttcgtagatcgattgcagcaacagaggagttgaagcgtttcccaacacttcagacagatatagctgctgcagcaaatgaaagcctggaaagatttcgtgaggatggtcgaaagacagttattcgtcttgttgagatggaggccagctacctaactgtagaatttttcagaaaactccctacagaaccagataagggggctaataataacactccagccaatgacagatatcaggacaaccatttaagaagaatcgggtcaaatgtatcatcttacattaacatggtttgtgagacattgaggaacaccattccaaaagctgtggtgcactgtcaagtgaaggaggcaaaaagaaacttgcttaaccgtttctatgctcatgtgggaagcaaggagaagaaacagctcagcgcgatgttggatgaggatcccgctttgatggagaagagggattccttagtcaagaggctagagctgtacaaatctgcccggaacgagatcgactcagtcgcgtggaaatgatcggttagcgaagtcacagctggaagagatagacatacatctgcgacacacagatcattgccgtagaatgctctaattccatttacgtctggattcacatggagatccgtacactattctttctttcttttttctttcatgcgagtgtcctttctaccttgtcagacaagtatatttccttggccatcttggcctttttgtatgatgttgatgatgatgagctggtcctccgggatcacactgatatgaatgcagatatatatattctttgttgaaaaaaaaaaaaaaaaaaaaaacacgaggctcctcctctctctctctctccctcgtgccgattcctgcagcccggggatcc

SEQ ID NO: 3384 - DNA, 1621 bp, Oryza sativa
  Clone ID: PAT_MRT4530_71768C.1
cgccacgcgtccggcggaggagaggagaggagatcagggggaggaagggtggccggcgcagcagatcggggcgggcggatttaggggaggagcgcgctagccgggagcggcggcgatggatgaggagtacgacgtgatcgtgctggggacggggctcaaggagtgcatcatcagcggcctcctctccgtcgatggcctcaaggtccttcacatggacaggaacgattactatggaggagaatctacatcccttaatctcactaagctctggaagagattcaaaggcaacgagaccgctcctgaacatctgggtgtcagcaaggagtacaatgttgacatggttcccaagttcatgatggccaacggtgcactggtccgtgtactcatccacacgagtgtgacaaagtatctgaatttcaaggctgtcgacggcagcttcgtgtacaacaatggcaagatccacaaagttcctgcaactgatgtcgaggccttgaaatctaatctaatgggcctttttgaaaagcgccgtgctaggaaattcttcatatacgtgcaggattacgaagaggatgatccaaagtcacacgaaggcctggatctgcacaaggtcacgacgagagaagtcatctccaagtatggcctcgaggatgacacagtggactttattgggcatgcattggcacttcatcgagatgataactatctcgatgaacctgcaattgacactgtgaaaaggatgaagctttacgcagaatcactcgctcgttttcaaggaggatcaccttatatctaccctctgtatgggctagcagagctccctcaggcctttgctcgtttgagtgctgtttatggtggcacatacatgctaaacaaagcagaatgcaaggttgagtttgatgaaaatgggaaagcatacggtgtcacttccgagggggagactgcaaaatgcaagaaggttgtctgtgacccttcatacttgcctgacaaggtgaagaaggttggaagggtggcgcgtgcaatatgcataatgaagcatccgattcctgacaccaaggattctcattccgtgcagatcatcctcccaaagaaacagctgaagcgcaaatcagacatgtacgtgttctgttgctcatatgctcacaacgttgcaccaaaaggcaagttcatcgcctttgtttctacggaagcagaggctgacaagcctgagatcgagctgaaacctgggatcgatctgctcggacctgtagaggaaacattttttgacatctatgaccgatacgaacctactaataccgctgacgaggacaactgcttcgtgacaaatagttacgatgcaactactcattttgagacaacggtgaaggatgtgcttgcattgtacagcaagatcactgggaaggaacttgatctttctgtggatctgaatgctgctagtgctgctgaatctgaagcggcctgagcgatagctacttcttccaattccttttattctttcatagatggatctgttcaattaaactacttcttgctattccagttccatttgaccttactgaaacaaagtacagtatcacggatttatatataattaaataatcttcatataaaaaaaaaaaaaaga

SEQ ID NO: 3385 - DNA, 1023 bp, Oryza sativa
  Clone ID: PAT_MRT4530_71830C.1
ccgggggccggattgggagccactgtgcaaacgtgtcgcccattctacaccgtctccatccatctcatctcgtcgtcttcccccccgcgagtccgcgaccccccgcgctataaaatccaaggccgcgatcgagatgcggaaatatcgagtcgccggattggtagccgccctgctcgtgctgcattcgctagccacgccgtccgctcaggccgaggcgcatcgcgcagggggagaaggggaggagaagatgtcgagcgacggagggccggtgcttggcggcgtcgagccggtggggaacgagaacgacctccacctcgtcgacctcgcccgcttcgccgtcaccgagcacaacaagaaggccaattctctgctggagttcgagaagcttgtgagtgtgaagcagcaagttgtcgctggcactttgtactatttcacaattgaggtgaaggaaggggatgccaagaagctctatgaagctaaggtctgggagaaaccatggatggacttcaaggagctccaggagttcaagcctgtcgatgccagtgcaaatgcctaaggcccatctcgtatcctatgtgtatcaagttatcaagaagatggggaataatatggtgtggatatagctattggacatgttaattatccacatgataatatggcttggatataaggatctcacacgataatatggcttggatatatagctattaaagattttacctatggcatatttcaatgtgtattagtactaagtaagaatgattgcaaggtgtattaactacaaatattgcaataaaagtccctgttactacaacttacaagtaaaaaaagttagtcctctgactggatagaactctgtaatcattgttcacgttgccttgttttgaactggatagttttgaaatttgataaaaaaacattatcataaaatcacctgacaccgtttaaaattggctattattattttacctaaacgtgctgcaacattcaatggagtattcagaagttgtactttaaaggata

SEQ ID NO: 3386 - DNA, 2729 bp, Oryza sativa
  Clone ID: PAT_MRT4530_71949C.1
atggcggccgatccctccgcggccgcggcggccgccccggacccggacggccccgacgccgtccgcctcacctggaacgcctggccgcgctccaaggtggaggcgagccgctgcgtcgtgccgctcgccgccgcgatctccccggtccgctcgcccgagtcgctcgcctcgccgccgctcccttacccgccgctccgctgcaagcccccctgctcggccctcctcaaccccttcgcccgcgtcgacttcgctgccaagatctggatctgcccgctctgcttctcccgcaaccacttcccgccccactacgccgccatctccgagtccaacgtccccgccgagctcttcccgcagtgctccaccgtcgagtacctcctcgccggcgccgccccggccgccggcgtgcccctccaccagggcggcccgcccgcgccgccgcccccggtattcctcttcgtgatcgacacctgcgtcatcgaggaggagctcgagtacgtcaagatgtccatgcggaaggccgtcgcgctcctgccggagcacgcgctcgtcggcctcgtcacgttcgggacgcaggtgcatctgcacgagctcgggttctccgatctcagcaagatctacgtcttccggggcaccaaggagatctccaaggagcagattttggatcagcttgggttggcgggtgcggggcgtccgggtttccccaagatgcctcagcagccaggggggcctcagatcaacgggatgcatcccccggcaacggccggggtgactaggttcttgctcccggtgtcagactgcgaatgcacgctcagcacgctgctggacgagttgcagcctgaccagtggccggtggagaccgggaaccgtgcgatccggtgcacgggtgttgcgttgagtgtggcggctggcttgctcggggcttgtatgcctgggactggcgcaaggatcattgcgcttcttggtggtccatgcaccgagggtcctggaatgattgtgtcgaaagatttgtcagagccagttagatcacataaggatcttgataaggatgcagctcctcacttccagaaagctgtcaaattttacgatggccttgccaaacaattggtcagtcaaggccatgtcttagatgtttttgcatctgctcttgatcaggttggccttgccgagatgaaggtcgctattgagagaacaggtggccttgttgtcttatctgaaagctttgggcattcagtatttaaggattcttttaaacgtatttttgagggaggggaacagtctctcgacctttcattcaatggcacgcttgaaataaactgttcgaaggacattaaggttcaaggtattattggaccatgcacatctttggaaaagaaaggagctctatgtgccgacacagttgttggtcaaggaaatacaacagcatggaaaatgtgtggtcttgacaggaatacttcattaacagtattttttgatgtctcaccgagtgagcggtcaagccaaccaggacatcagaatcccgatctgtatatacaatttgtaacaagttaccaacacccagaaggtcaaatgaggattagagttactaccatatgcagaaaatgggtggatggatctaccaacacagaggaattagtcgagggttttgaccaggaaactgcagctgttgtgttggcgagatacatctcgttgaaaatggaaatggaggaagagttcgatgcaacacggtggcttgatggatcggctctaatgcttttttcaagatgaggggattatcggaagcatgatgcatcttcatataacttgcattaagctatgttcttgtttgctcagcttaagttaaagctacgacgttcacaagtagttgaggttactccaggttttgacatactagtcacggctgatgttcgggttttcaataacagtccagatgagacagcttatttccggatgttactcaaccgtgagagtatcactaactcagttgccatgattcaaccatcattaatttcattctcttttgatttgcctccatctcctgtattcctcgatgtggcatcaatagcagcagatcgtatactgctacttgatgcatacttcagtgttgtcatcttccatggtatgacaattgctcagtggagaaacatgggttaccagaatcaacctgagcatcagcaatttgcacaattgttgcaagctcctcacgaggaggctcaaataataattaaaggacgatttcctgctccaagactagttgtctgtgaccaacatggctcacaggcaaggttcttgttggcaaagctgaacccatcggctacatataactcagcacatgatgttcctccaggttctgacatcatattcacggatgatgttagtttccaggtcttctgtgagcatcttcaaaggctggccgttcagtcctaaggacatgtatgcaaagttgtacaccgtatctgatagctatatttactgagtttggtaggtctgagttgtgggagatttctgctttccctttttttgacctcatgtgttcttattacatcgtgtcaggttttccgacatcagacaattttttcgggaaataatcttgaaagcatgtataagttgtccccataatattatttatccatcatatatacttctttatattaacctaactgaaatcttaaggtgtatagccaagtaggttttttgtggtcggatgttgtctcaaaaaaaaaaaaaaaaaa

SEQ ID NO: 3387 - DNA, 270 bp, Oryza sativa
  Clone ID: PAT_MRT4530_72502C.1
atgaagaagccgtacattgtacacaagatcattgcgtaccaggcgttattctatggccagcactcctttgcttgtgctgatcttctctggcacgtgaagggttatgctaaatgcaaattcttcctctggtttgcatttcagcagtgttgttggacggctgatctccttcggaagtgtggcatcgatagccactcggcctgccccttttgcgctcaggagcttgagacggcgaaccacatcctcctcgactgcgtgttcgctcgacaggtc

SEQ ID NO: 3388 - DNA, 1707 bp, Oryza sativa
  Clone ID: PAT_MRT4530_72558C.1
atgcaagatcaacgtgctggtcctgcaaagtctaaagaaaagaaaagagtaagccgccacaagcaggcaaaattaactactgtaattattaaagctgtgcccttaactacaaaagagttgagacaaaaaaaatcagagttgagagttgagagaagaagagttaagatgggtggagatgagcgggcagtggctgctccgttgctgcagcagcagcaagacggcggcggcggcgacggcgagaggaggaggaggcggtggtggtggggatggtgggacggggaggaggcggcggggcagctggcgttcgcggcgccgatggtggcgaccagcatggcctactacgccatcccgctggtctccgtcatgtacgccggccgcctcggagagctcgagctcgccggcgccaccctcggcaactcctggggcaccgtcaccggaatcgccctcatgccatggttaaatattaggggtgttctggctgcaaaagggctgcaaaaggataaattagatactggactaagcgggtctctagagacgctctgcgggcaaggttatggtgcaaaaatgtaccacatgatgggggtgtacctacaagcatccatcatcacatcggccttcttctcggtgctcgtctccctcctctggttttactcagagcctgtcctcatcttcctccgccaggaccctgaggtcacgagaacagcaacgctgttcctgcgttactccatcccggctcagtttgcctatggcttcatccagtgcaccctcaggttcctacagacacaatctgtggtgacaccgctggtggtgtttgcactcctgccactggtgcttcatttcgggatcacccatgcgttcgtgcactacctggggttcggctatgctggggctggtatgtcaacgtcagtgtcgctgtggctctccttcctcatgctcgctgcctatgtgtgcttgtcagaaaggttcaagcacacctgggagggcttctccaccgaggcatttcgccatgttctacctggcctaaagctggctatcccctctgcagtgatggtgtgctttgagtactgggcgttcgaggtgctggttttagttgctgggctgatgccgaattctcatatgagtacttctatcattgcaatgtgtgaaaacactgaagcgatatcatacatgatcacctatgggtttgctgctgctatcagcacaagggtgtcaaatgagcttggagctggtaacgttgcgaaggcgaagaaggcgcttgctgtgacgctggtgctctccctgctgctgggagtggcatttcttctgctcctaggccttggtcatgatctctgggcagggctgttcagcaaaagtgatgcagttataagcgaattcgcttcgatgactccgttgctcatcgggtcagtggtgctggactctacacagggagtcttgtcaggggtttcaagaggctgtggttggcagcacttggcagcatggaccaacctggtggcattctacattgttggcttaccactttctatcctctttggatttaagcttggccttcagaccaaggaccaaatgggaaagattagagctgacaatgaacggcaaagaagacggttttgtctgttgaggcttgaaagatctgaacttaccagtttagcagcagcatacgcctctctggttgaatcgaacattgaagtgaaaagttttagagcttag

SEQ ID NO: 3389 - DNA, 1878 bp, Oryza sativa
  Clone ID: PAT_MRT4530_7261C.1
ctaacaaattacgtaacggctgtcaagtttaatactagtagcagcagaggcagcgaaataagctgcggtagcaataacgaatttaactgtttcaatggttaacccatgaacagcaaacaccgaaggtgcaccggagttgcagagccccatcgccttggcgttgctgatggcgaacccgagagcttcttcagtggcttcgttgtcgaaggccttggcagtggctgcactcagcatcgggatcactcccctgacgatgaggctgtgccgcgcaggagcttcgtcgctgcaggtccagtcgaaggagtcggtctgtttcagctcaggaaccacgacggacagaatcggcatggatggcctgtacttggccaccagcctagcagttgttcctcccctagtcaggaccaagatgagcgccgccttggcagagttcgctgtacgcacagctgatgatgcaaggctctccaatgggctcatgggaattggagctgatgcggtaatggacttgaaaacagcggcatggtcgacgcatgactccgcttgcaggcagatcttggccatggtccgtacagccagttccgggtaagccccagcagctgtctcaccactgagcatgacacagtcagtgccatcaagaactgcattggcaacatcagtcgcttctgctctagtagggcggggagacttgatcatagattccaacatctgggttgcagtcacaactggcttgccctgaatattgcacttgaaaatcatcaccttctgtgcataaaagatcttctctatcggaatttccattcccaaatcaccccttgcaaccataaaagcatcagattgtgccaggatatcatcaaagttagccactccctcttgattctcaacctttgacatcagcattattgactttgcatgcttcccaagcaccttcctgacctctacaaggtctgagcctttacgaacaaaagacagagcaatcatgtcaatcttgtttgggacaccccatttaagaatatcctccttgtccttctcagtaagtgtcgggagatcaacaataactcctggaaggttaacattcttcctctcaccaagcatagcagtgttctcacaacggcagcgaaccaagccttgctctttatcacagtgaaggacagtaagagtgatggtgccatcagcacataatattacactgcctggcttcagatccaccgctagcttcttgtagctcattgatatcatgttgtcatcaccctttatgctataatcagttgaaactgtgatttcttgacccttcttcaactgtacgggttttccatctttcagaaatccagttcggatctctggcccctgtattttaagcaaatccaatataggtttaatgccattgagaaatcctgaacaaagtctttcagaaaattggtcatgtaccacacaaatcttatcatcgtctaagctgattttgagccaacaaaacatgactgatattgtcttttgaccagcagaatagtcagggggtgagaacccaagaatcagggacgagcaacggcctactgtgaaaacgaccgcacaaaagtcttgaagaaaataaaaggtggccaaaattaacaccccaagaacgaaatcacgcgccttggtgtcgagcatgacggcgcagaggatgccggtgctctccatggcggcgcggaggttgtcgagcgtctcctggtggtactcgtgggatccgtgggagaagttgaagcgcgcgacgcacatcccggcgcggagcagccgcccgatcatctccaccgacctcgacgccggccccagcgtgcacacgatcttcgtcttgggcctccgccgcatcacccccgcggctccctcctgctgctcctccatcaccgccat

SEQ ID NO: 3390 - DNA, 1197 bp, Oryza sativa
  Clone ID: PAT_MRT4530_72804C.1
gcgacggcgctgcgggagagcaagcctgtgtacctcagcatcagctgcaatctcccagggctgcctcaccgcacgtttagccgcgaccccgtccccttcttcctcgcccccaggttgagtaacaagatgggtctggaggctgcggtggaggccactgtcgagttcctgaacaaggcggtgaagccggtgctcgttggcggccccaagctgcgtgtggcaaaggcagggaaggccttcgtcgaccttgttgatgccagtggctacgcctacgcggtgatgccgtcggccaaggggctcgtgccagagacgcacccccacttcatcggcacctactggggtgccgtcagcacggccttctgtgccgagatcgtcgagtcggccgacgcctacctcttcgcagggccaatcttcaatgactacagctctgtcggctactccttcctcctcaagaaggacaaggccataattgtgcaaccggagcgtgtcatcgtcgggaatggcccggcgtttgggtgcgtcatgatgaaggagttcttatctgagctggctaagcgcgtcaacaagaacaccactgcttatgagaactacaagaggatcttcgtgcctgagggccagccgctggagagcgagccgaatgagccgctgcgcgttaatgtgctcttcaagcacgtccagaagatgctgaacagtgacagtgctgtgattgccgagactggtgactcctggttcaattgccagaagctgaagctccctgagggctgcgggtatgaattccaaatgcagtatggttccattggatggtcagtgggtgcattgctcggatatgctcagggcgctaaggacaagcgtgtgattgcctgtattggtgatgggagtttccaggtgacggcacaggatgtgtcaacaatgattcgctgtgcacagaacagcataatcttcctgatcaacaacggcgggtacaccattgaggtggagatccatgacggtccatacaacgtcatcaagaactggaactacactggccttgtggatgccatccacaatggagagggcaaatgctggacttctaaggtgaagtgcgaggaggagctgacggaggcgatcgggatggcgctgggggagaaagactgcctgtgcttcattgaggtgatcgcgcacaaggcgacaccagcaaagaactgctggaatggggatcga

SEQ ID NO: 3391 - DNA, 1841 bp, Oryza sativa
  Clone ID: PAT_MRT4530_72817C.1
ctcaccgacaccatccgtaggtcttccaggagctccttcctgccacgtcatcaatggcgatgatgggtggctgacagtcaaacgctccccacgcctcctccccttcccccctctctccctccatggcttccctcgcctcccctcctctcccctgccgcgccgccgccaccgccagccgcagcgggcgtcctgctccgcgcctcctcggccctccgccgccgcccgcttcccctctcctctcctccgcttcggcgcgcttcccgcgtgccccctgcaacgccgcacgctggagccggcgcgacgccgtgcgggtttgctctcaagctggtgcagctggaccagccccattatcgaagacattgtcagacctcaaggattcctgctggagatttttacggccacatacaattcgaggaactgccttgggatccatagcattagttgctagagctttgatagagaacccccaactgataaattggtggttggtattcaaagcgttctatgggctcgtggcgttaatctgtggcaatggttacatcgttgggatcaatcagatctatgacattagaatcgataaggtaaacaagccatatttaccaattgctgccggtgatctctcagttcagacagcatggttattggtggtattatttgcagctgcgggattttcaattgttgtgacaaactttatacttttcattacctctctatactgccttgctctatttcttggcaccatatactctgttcctccattcagacttaagagatatcgtgcgcctgcatgccttatcattgcaacggtccgtggttttcttctcaactttggtgtgtactatgctactagagcagcactgggtcttacattccaatggagctcgcctgttgctttcattacatgcttcgtgactttatttgctttggtcattgctataaccaaagatctcccagatgttgaaggggatcggaagtatcaaatatcaactttggcgacaaagctcggtgtcagaaacattgcatttcttggctctggtttattgatagcaaattatgttgctgctattgctgtagcttttctcatgcctcaggctttcaggcgcactgtaatggtgcctgtgcatgctgcccttgccgttggtataattttccagacatgggttctggagcaagcaaaatatactaaggatgctatttcacagtactaccggttcatttggaatctcttctatgctgaatacatcttcttcccgttgatatagagaccaagcaatctgatatggtctgcatgttgagtgcggcaaaaactagaagcccatatgaacagtgggagtaagggaacgaacatgccatccatgggaagactctgataactctctctcgcccgggctgtaaagggtaagcactgttgtgcatatatatgaaaggaaggtgataaagcagggatgctaaattgctactgggatcctcaaaggcttatagtggtcatcagtggaatgtgccttaataatttggttacctagcagagcaagtttttgcaggttattaggtaatatctttgagggaatgaacttagatttcattgttttaaggtctggtcacacaacgggtagtagtgctggagcggcaaaagacgaccttgttttacactaccaagggaggttaactctagttttcatgtgaccacttaccttgagagttgagaccatggaatcacttgtcgactcctcggcttgtatatttctagtgtcagcatttgcattctcctccacacttgtacttgaagagttgaagacaacttttttgtttgtgtatttctggagtgtcagcatttgcattcc

SEQ ID NO: 3392 - DNA, 348 bp, Oryza sativa
  Clone ID: PAT_MRT4530_73562C.1
atgcaggttggtggcaccgccgccgcggccgctgaggtgtccatgtcgtaccgggagacgaggagagaggaggaaaagaggaggggtaccaagatgaaggtcaagattcttcagtggcatggggtggcttcttggacatggaacgcccaggatgaaacatgcggcatatgcaggatggcatttgacggctgctgccctgattgtaagttccctggcgacgattgtccgctcatctggggttcctgcaaccacgccttccatcttcactgcatactcaagtgggtcaattctcagacatctacgccactttgcccaatgtgccgtagggagtggcaattcaagggctaa

SEQ ID NO: 3393 - DNA, 252 bp, Oryza sativa
  Clone ID: PAT_MRT4530_73807C.1
atggatcttgcgctggtgcggccacccccggccagcagccgcggcggcggcgacggaagcagggacgtcggaggcgatggcggggccggtgctgggaacggcgacggggcactgggggtgcgacgcgccgtgggcgagggccacgatgctgcggagacgggggcaggccggcggagaaggatgcgcgtgggcggcgttggctggagcgccgacgccgtcggcgggggcggtggcatgcttaccttactctga

SEQ ID NO: 3394 - DNA, 412 bp, Oryza sativa
  UNSURE (1)..(412): unsure at all n locations
  Clone ID: PAT_MRT4530_73817C.1
  unsure (1)..(412): unsure at all n locations
gccggggctctccgccgcctcctcctcctcctctccacctccgccgccaccaccgccgccgccatggccatcggatctctcatcgcgtcgaggctggccaggtccaccggccacgccctcgcctccgccgcctctcaggctccgatggcccgtcacgcggcggcgtctcctctgttgtccaggcttggatcagtggctcgtgcgttcagctcaaagcctgccgccgcggatgttattgggatcgatttgggaacgaccaactcgtgtgtctccgttatggaagggaaggcaccacgagtgattgagaatgcggaaggcgcaaggacgacaccctccattgttgccaagaaccagaatggtgatcttttggttggcataaccgcgagtcgtcaagncagtgaccaatggccag

SEQ ID NO: 3395 - DNA, 1861 bp, Oryza sativa
  Clone ID: PAT_MRT4530_74258C.1
acatgtcggccaccacgtccaattcccggcggctatgcaacggccggggacaggtcatacctgggcccaccttaccagaggctgtcaagatgggcccacacgccattcggattgtagtcggagggctcggagaaggcgagctctcgaccgccactactgtacacggcccagagcgagcctcctcctcctctgcaccaccggagatggcttccgccgcgctgccggaggccgtcgcgccgaagaagaagggcaacgtccggttcgccttcgcctgcgccatcctcgcctccatgacctccatcctcctcggctacgatatcggggtgatgagcggggcgtcgctgtacatcaagaaggacttcaacatcagtgacgggaaggtggaggttctcatgggcatactgaacctctactcgctcatcggctccttcgcggcggggcggacgtcggactggatcggccggcggtacaccatcgtgttcgccgccgtcatattcttcgcgggggcgttcctcatggggttcgccgtcaactacgccatgctcatgttcggccgcttcgtggccggcatcggcgtgggctacgcgctcatgatcgcgccggtgtacaccgccgaggtgtcgccggcgtcggcgcgtggcttcctgacgtcgttcccggaggtgttcatcaacttcggcatcctgctcgggtacgtctcgaactatgctttctcccgcttgccgctgaacctcgggtggcgcatcatgctcggcatcggcgcggcgccgtccgtgctgctcgcgctcatggtgctcggcatgccggagtcgccgcggtggctggtcatgaagggacgcctcgcggacgccaaggtggtgctggagaagacctccgacacggcggaggaggccgcggagcgcctggccgacatcaaggccgccgccgggcatccccgaggagctcgacggcgacgtggtgaccgtccccaagagagggagcggaaacgagaagcgggtgtggaaggagctcatcctgtccccgaccccggccatgcggcgcatcctgctgtcgggcatcggcatccacttcttccagcaggcgtcgggcatcgactccgtcgtgctctacagcccgcgcgtgttcaagagcgccggcatcaccgacgacaaacacctcctcggcaccacctgcgccgtcggtgtcaccaagacgctcttcatcctcgtggcgaccttcttcctcgaccgcgtcgggcggcggccgctgctgctgagcagcacgggcgggatgatcctctccctcatcggcctcggcgccgggctcaccgtcgtcggccagcaccccgacgccaagataccttgggccatcggcctaagcatcgcctccaccctcgcctacgtcgccttcttctccatcggccttggccccatcacgtgggtgtacagctcggagatcttcccgctccaggtgcgcgcgctgggctgctcgctcggcgtcgccgccaaccgcgtcaccagcggcgtcatctccatgaccttcctgtcgctgtccaaggccatcaccatcggcggcagcttcttcctctactccggcatcgccgcgctcgcctgggtgttcttctacacctacctcccggagacccgcggccggacgctggaggagatgagcaagctgttcggcgacacggccgccgcctcggaatcagacgagccagccaaggagaagaagaaggtggaaatggccgccactaactgatcaaactaaccgcaaaatcaccaaatcctaagggttttcttgcaaaaacgtgtgctgtactggctagctagcaagtagtagcagcaacgtgggaagattcgctgatccggcgttgctggagagc

SEQ ID NO: 3396 - DNA, 1344 bp, Oryza sativa
  Clone ID: PAT_MRT4530_7432C.1
cgcggtggcggcgtctaaactagtggatccccggcctgcgggtccccgggctgcagggcctcgcctcgcctcacctcacctcaccctccgcctcgtctccttcccccctttcctcaacccacgcacgccctctctcccatcccagccgtagccgcgccgtgacttgtctcgatcggcggcgaggaggagggcttccgttccctggccggtgggggaggatcaggcgggggggcggcggggagggggaggagatcggtctcggtcgatccgcgcgcggcggcgatggcgcgggagaggcgggagataaagaggatagagagcgcggcggcgcggcaggtcaccttctccaagcgccggcgcggcctgttcaagaaggccgaggagctctccgtgctctgcgacgccgacgtcgcgctcatcgtcttctcctccacggggaagctatcccacttcgcaagctccagtatgaatgaaatcatcgacaagtacaacacacattctaataatctggggaaagcagaacagccttcgctcgacttgaatttagaacatagcaagtatgcacatttgaatgagcaacttgcggaagctagtctccggcttagacaaatgagaggtgaggagcttgagggattgagcattgatgaactccagcagctagagaagaacctggaagctggtctgcacagggtgatgctgacaaaggatcaacaatttatggagcagatcagtgaactccagcggaagagttcacagctggcagaggagaacatgcaactcagaaaccaggtatcccagatatcaccagctgagaagcaagttgttgatactgaaaattttgttaccgaaggacagtcctctgaatctgtgatgactgcattgcattctggaagttcacagtcgcaggataatgatgatggctcggatgtatccctgaaattagggctgccttgtggtgcatggaagtaactgaaaggaaaaaaaaagcatccttgcagatctggttggagtcgttgcggcatccaggggagaaacgcttgtgttattcccaaacccagactgcaataatataatcttgcgttggaagcgagatcagttaacctgatttatcatccttgtggctgcatgatgcgatgttccgcttgtactgttcgctaggatcttgactaaactttgagatctatgtgccgtttaattatcccatcgctattggcactccttatgcgatacatcatatatgcactttgttgctatcttaattatgatgcgtcttttgcagcgttctaaaaaaaaaaaaaaaaaaaaaaaaaaaaaaaaaaaaaaaaaaaaaaaaaaaaaaaaaaa

SEQ ID NO: 3397 - DNA, 1940 bp, Oryza sativa
  UNSURE (1)..(1940): unsure at all n locations
  Clone ID: PAT_MRT4530_74368C.1
  unsure (1)..(1940): unsure at all n locations
cggcacgaggggacctcccctgtgccaagcggccgcgcatcgcagccgagacgagccgccccccgcaccgcactctccgccgccggccgcgccgacctcctccgccgcgccgcctccccggcgcgcgcccccgtcaccctctctcgcctcgccgccgccgccgctgcctcctcgtgaggggggacggtggtgggggcctctgcctatggcgagcggcgacggcggcgacgacgcgggcgtgaagcgcgtggcggaccgctacctgaagcgcgaggtcctgggagagggaacctacggcgtcgtcttcaaggccgtcgacaccaagactgggaatacagtcgcaataaagaaaatccggctagggaagtacaaggaaggtgtcaatttcactgcattgagggaaattaaacttcttaaggagctgaaagattctaatattatagagctgattgatgctttcccttacaagggaaacttacatcttgtatttgagttcatggagactgatttggaagctgtcatacgagataggaacattgtattatctccagctgatacaaaatcttatattcagatgatgttaaaaggtttagccttctgccataagaaatgggtgctacacagggatatgaaaccaaataatttactcattggcgctgatgggcagcttaagcttgctgactttggtctggcgcgcatatttgggagtccagagcggaacttcactcatcaggtctttgcacgatggtaccgagcaccagaattattatttggcaccaagcagtatggatctgcagttgatatttgggctgctggttgtatttttgctgaactgctgcttaggcgaccgtttctccagggttctagtgacattgatcaacttgggaagatctttgctgcatttggaactccaaagtcttctcaatggccggacatggtttatcttccagattatgttgaataccaatttgtctctgcacctccacttcgctcattgtttccaatggccagtgatgatgcattggatcttctatcaagaatgtttacatatgatccaaaagcaagaattacagctcagcaggctctagaacaccggtactttttatcagtaccagcgccaacaaaaccatcacagcttccaaggccaccacctaagggtgattcagggaataacaagataccagacttgaacctgcaggacggccctgttgttctgtccccgccaagaaagttgcgcagggtgactgcccatgaagggatggaagtccatatgcatcgggcggatagaacagaagagcatccttcaggggcaaggcacatggatgacatgtccagccagagttctagaataccaatgtcagttgatgttggagctatttttgggacacgacctgctcctagaccaacgttaaacagtgccgacaagtctcgtttaaaacggaaacttgatatggatccagaatttggatacacagagtaaatcaccattttttccatactggcttgttgatttttaaaatattctttggggagatagttccactatctaccaacaaaagaggattgtgtcgaaagccataaaaacttcactgaagggcgctgacaggatggcacagccaactatgctgttatcgtttttgactaccaaagccggctcaggaagaggaaactgaagagttacgtgttacgatgctaatttacaccaggacgtgcacatgccatttcattttggctggcatacataaatctgtaatctttattgcatagatgagtttgcttgtgtgagcatgtttcttccagtgttcgcaaagattattatgaagtttatgtctcaagttctttctggtgtcaattttcgttcacttctngtatggacattgaattttgattgttgtttagtcggtcatcttattcttaggtacaaaaaaaaaaaaaaaaaa

SEQ ID NO: 3398 - DNA, 1520 bp, Oryza sativa
  Clone ID: PAT_MRT4530_74539C.1
atggcggtgggtgaggtcctaacagaaaggcgacgtgaaacactgacaactgatctggtgttgattccaatttgtagacaagaacccaaaatatcttccattgttccagaggaggctgctgctggtgagtacttagccattatctctgcatcctatgtgacaaacagaaactggacagttttaccagtccaaacaaagcaagtttcagacttacagcaacaagaagcaaagctttgcaagcagagttacatcagagttacttgcattacatattctgagaccgatctgagctgcgggccatcgtcgatgacggagctgaccgcggcggcggcgccggctgggtcaggatcgtcggcggcggtggcggcggggagcagcgagaagatggggagggggaagatcgagataaagcggatcgagaacacgacgaaccggcaggtgaccttctgcaagcgccgcaatggcctcctgaagaaggcgtacgagctgtccgtcctctgcgacgccgaggttgccctcatcgtcttctccagccgcggccgcctctacgagtacgccaacaacagtgtgaaatccaccgttgagaggtacaagaaggcaaacagtgacacctccaactctggcacagttgcagaagtcaatgcccagcactaccagcaggagtcctccaaactgcgccaacaaatcagtagcttacagaacgcaaacagtaggaccatagtgggggattctatcaacaccatgagcctcagggaccttaaacaggtagagaacaggctggagaaaggcatagctaagataagggctagaaagaatgagctgttatatgctgaagttgagtacatgcagaaaagggaagttgagctgcagaatgacaacatgtacctgaggagcaaggttgttgagaatgagaggggacagcagccactgaacatgatgggggcagcatcaacaagtgaatacgatcatatggttaataacccatatgattccaggaactttcttcaagtgaacatcatgcagcagcctcagcattacgcccatcagctgcagccaactacccttcaactcgggcagcagccggccttcaattagttttggtgtagacaccgtacgtacacacgtacgttagatgaaatctgaaggcgtcgatacccgcggctacgtaacagcgtgatcaacctgaagaaatcgatgcagtaattctatgtgttcgtcagatcatcataaccagtattgtcattaggcgttgtgaaaaaaaaatgtgtcagcatgcattgcaagctagcgtttgtggctgctcatcagctgcatgcgtaattgcgtacgtgcacaaattaaacagaccttgctaccattgtgccatattgtgtgtgttgtatgatatatatatatatatatatatatatatatatatatatatatatataaacagcacgtttgtgctctgattcgtgtaactgatcagcagatcaaactctaccactgccgatatatatgtgaggaccatggattgatgc

SEQ ID NO: 3399 - DNA, 2309 bp, Oryza sativa
  Clone ID: PAT_MRT4530_75365C.1
cgcaaggcgtaaagtttcaggggaataaccattttcctaagagaattcacgttttctgtgggcatgaagtcaacttacaatttataaatcttccattcacacttacagtatgtaaagagaattcccacccaaaatttctctcatgaacagaccaaaagatgagggcattatattcatgggcatgtgccaaataaatgtcaccttaagcattccatttcagttggaggtgtttcactaacagagaggacgatggtttccagagaagggtgcgcgacttgtgctataatgtattggcaaatgcatgcgctttttattctgtggacatgtcaactcaaactttcttgatcaagtacatgcagctgacagtaacaaaccacaggccttcgtgaagttggatgagaagcaaatctgcaagatgcctgatggtatgtctcgaatgagctagggcaagaatgcccacccaacttggacaatgatcactcgtactcaaattgtacatcaacatgcacatacttcctcatgaggcagactataaatgaagtaaagcttgctagcatctggcgctcttcgcgtgtttttgcctcagaaagaacaccatgaatgacaagtttcttgagatttgggcacctctcgatcattccaaaaacccagggtccaaaatgctcacttataactgtccaaccaagttccaagactgaaacattatccagtggtgacgatccttgcaggctataatgaagtagcccatctcgtaactcataactcaatgaaagatgccttagaagaggaaatgaaacagcaatggtttctgagtccacaatctcatcctcatcatcaaacacaacaccccaaaatcgtagcatccgcaagttagatgctctggatatcatactgtacagctttggccggactatagtaaagttactcacatccactacctccagatgatctgtgctctccccaatatccatatgagtaacactaacatcgtcaatcttgagatgctttagagtacccttcccaatgagctcaaacaaatcaaggttcaaagcatttaggtttagaacttccagattatctgtatcaagtatgatcttgtccacaccaacagattttgcaaataggctcttcaaggtatggctagtcagctccattgtagactgtggatctgaagtgacaacctcaaggaaatcaagtgccagtgactctatctttgggcaagcagccactaaaaggctcaaatccaaggctgaaatgctcacatgccttaaagaaagggatttcagacaggtgaatctctgataacttggttcaacaccagtgattgtgttatggtctaaatccaacacctccaatttctgcctcccacatttctccaggatgttcacgttagggtttgtccgaacattgtaagacaagctccggagtgtttccctggtatacatgagccatgcaatcacaggtgctgccgagaactcatgggtacgatctatgtgaatagagaggcactgcagccccattgtctgaaatatagtctgtgtgatgacaatctccagctggcgtgtagtcatgtcccgagggaagtcatcggaattgaacgataatgaatggaggtgcttcctgcatgccgtccgccacttccggcacaccccagaggcaaccatgacatcacgtgcagcgctaagatgtgcaagaatgttgccaatgacttcaacaggaaggtgctccatattggccgccgaaaaattacccaacctggtcaggtacaacctaattggaaacttttcctatccagaggagcagcggcagacttaacatagggcatggaaaattcagttgaaccacatagatttctggaaaaaaaaggtaactgcgcccgcacctagagtaccaaaattatttggttcaactcatgttgatcttgacctctgaagaagaataagtaccgatttttttaaaaataagaaatcaatccaaacccggatggatctacgctgcacgtgcgctagcccagcacgccgcggaggagtcgggagaggggggggggcgaagggggctgcgacgcctctcgacgagagaaaggcttccggcgcccccccagcgccggcggcgcgcgcgcgaggtcgccgatggcgatgaagcgcgacagatcgcgaggaagaagggcgacaaattcgagacccgagaagggacgaaattggggggagaaattaggggaagagacacattgtgaggacggcgagggaggaggaggaagaacagtggaaagacggggaaaatctcaggagacaagcagacgccaacgaacc

SEQ ID NO: 3400 - DNA, 2177 bp, Oryza sativa
  Clone ID: PAT_MRT4530_75414C.1
attacaagcatacattcctcacatcaccgaattccaccttctcatgcggcttctacccaattgggacaaacgccttcaccttctccatctggctcaccaacacggcgggcaaaacagtcgtctggtctgcgaatcgccggtcaccagtgaatgggcatggatcgaaggtgttgctgcatgatgatggctacctggtcctgatcgatgtcaatggttccacggtctggacgagcaccatgagtgcaggcgaggggtcgacggctgcgctgctggagagtggaaaccttgtggtcagagattcaagcggcacaatcttgtgggaaagcttcacttccccaacggataccttgctacctgcacagcaattgaccaaagacacgaggttagtatctggataccatagcctttacttcgacaacgacaatagccttcgtcttgtatacaacggacctgagttctcaagcatctactggccaaatgatgattacaccatgttccgggatggcatcaaagtcaagaacaactccaggcttgcagtcctcgatgacaaaggcggtttcttctcaagtgatgctcttacagtacaggcttctgattttggtctcgggatcaagagaagactgactcttgactatgatggcaacctccgtatatacagccttgacgcatcagatgggagttggacagtcacatggcaagccatagtggagatgcattatgtgcacggcatgtgtggaaagaatgggatttgtgagtacttaccagaacttcgttgttcgtgtcctcctggattcgagatggttgatccacagaattggagcaagggttgtagaccgacatttagctataattgtgggaaagagaggtacaagttcattgagattccccaaactgatttctatgactttgatcttggctttaaccagtccatctcatttgaagagtgccaaaatatctgcttgagcacgtgctcttgcattgctttctcttaccggctaactggaactggtgtttgttaccctaaaggcctcctgttcaatggttacaagtctcctgcattcccaggaactttatatcttaaagtgccctacagcacaaatttacaggcctcatcaacacaatcagctctcacatgctcccctggcacagagggaggttacatgatgataagaaatcaattcagggggtttacttaccaagagctgaaggaagcaacaggaaaattcagggaagagcttggaagaggtagttctggaatcgtatacagaggagtactcaaagataagagggtcattgcagtgaagaagctcatcgatgtcacacgaggcgaagttgaattccaggcagaaatgagtgttatcggtaagataaaccacatgaatttggtcaggatatggggcttctgctcagaaggaaaacataagctactggtttatgaatatgtggagaatgagtcactggacaggtatctgttcaataccatgggtactgaaagattgctcgtgtggaaagatcgtttcaatattgccttgggagcagcaagggcactggcttatctccaccatgactgtcttgagtgggttttccattgtgatgtgaagcctgagaacatactcttgacccgagatttcgaagccaagatagcagacttcggactatcaaaattgtataagagagagggctccagcttcaacttctcacaaatgcgaggaacaatgggctacatggctccggagtgggcaactaatttgccaatcaatgcaaaggtagatgtctacagctatggagtggtgcttctggaaattgtggctggacagagaatttcaagtcatacaaccagggaagggaaagttaccaagttaaagcaatttatcgagaatgtaaaggaagctcttgctactggggatactaagtgcatagtggatgccatccggttcgggatgaagcagccacgcgccgccgacatcgtccgccccgactccaccaacgatggctgcaactcctgctcgcgcatgccgaggcggcctctgtgctggcgctcctcctgcgcgcgttcggctgcccttggcgagcggcgcacaccttggcctcagcctctgcttcgcgggggccgcgccgtaggccgtggacgtgccgcggctggtgctccacttcgacagcgctgggtcatggagtag

SEQ ID NO: 3401 - DNA, 2319 bp, Oryza sativa
  Clone ID: PAT_MRT4530_75416C.1
ttactcttcacaatccaggagacttttgacaacttcatgcatggtcggcctcttgcttctttcttcttcaagacatgatacagcaactatcaacataaccattgcctgctcagaattaaattgcccatgtagcctaccatccactatgcacttagtatccccagtagcaagagcttcctttacattctcgataaattgctttaacttggtaactttcccttccctggttgtatgacttgaaattctctgtccagccacaatttccagaagcaccactccatagctgtagacatctacctttgcattgattggcaaattagttgcccactccggagccatgtagcccattgttcctcgcatttgtgagaagttgaagctggagccctctctcttatacaattttgatagtccgaagtctgctatcttggcttcgaaatctcgggtcaagagtatgttctcaggcttcacatcacaatggaaaacccactcaagacagtcatggtggagataagccagtgcccttgctgctcccaaggcaatattgaaacgatctttccacacgagcaatctttcagtacccatggtattgaacagatacctgtccagtgactcattctccacatattcataaaccagtagcttatgttttccttctgagcagaagccccatatcctgaccaaattcatgtggtttatcttaccgataacactcatttctgcctggaattcaacttcgcctcgtgtgacatcgatgagcttcttcactgcaatgaccctcttatctttgagtactcctctgtatacgattccagaactacctcttccaagctcttccctgaattttcctgttgcttccttcagctcttggtaagtaaaccccctgaattgatttcttatcatcatgtaacctccctctgctgaattctgaatgtcattccttatggaaagaaaccaccaagctgttagaatgaaaattagttccaaggctccgaatactccagggaatatatagaaatatagccatcttgggtgatctgaaggtgttgcaatctcctgactgccaggggagcatgtgagagctgattgtgttgatgaggcctgtaaatttgtgctgtagggcactttaagatataaagttcctgggaatgcaggagacttgtaaccattgaacaggaggcctttagggtaacaaacaccagttccagttagccggtaagagaaagcaatgcaagagcacgtgctcaagcagatattttggcactcttcaaatgagatggactggttaaagccaagatcaaagtcatagaaatcagtttggggaatctcaatgaacttgtacctctctttcccacaattatagctaaatgtcggtctacaacccttgctccaattctgtggatcaaccatctcgaatccaggaggacacgaacaacgaagttctggtaagtactcacaaatcccattctttccacacatgccgtgcacataatgcatctccactatggcttgccatgtgactgtccaactcccatctgatgcgtcaaggctgtatatacggaggttgccatcatagtcaagagtcagtcttctcttgatcccgagaccaaaatcagaagcctgtactgtaagagcatcacttgagaagaaaccgcctttgtcatcgaggactgcaagcctggagttgttcttgactttgatgccatcccggaacatggtgtaatcatcatttggccagtagatgcttgagaactcaggtccgttgtatacaagacgaaggctattgtcgttgtcgaagtaaaggctatggtatccagatactaacctcgtgtctttggtcaattgctgtgcaggtagcaaggtatccgttggggaagtgaagctttcccacaagattgtgccgcttgaatctctgaccacaaggtttccactctccagcagcgcagccgtcgacccctcgcctgcactcatggtgctcgtccagaccgtggaaccattgacatcgatcaggaccaggtagccatcatcatgcagcaacaccttcgatccatgcccattcactggtgaccggcgattcgcagaccagacgactgttttgcccgccgtgttggtgagccagatggagaaggtgaaggcgtttgtcccaattgggtagaagccgcatgagaaggtggaattcggtgatgtgaggaatgtatgcttgtaatcttccaccgagaaagatgagccggtgtgcaatgtcagccggggtgaagcagaagtgcagaacaccaaaagagagaggaagaatgaaaggatgatcagatagagaaactttgccat

SEQ ID NO: 3402 - DNA, 2411 bp, Oryza sativa
  Clone ID: PAT_MRT4530_75440C.1
cgggctgcaggaattctcctccagtcctcttctcttcttcctccctcccttcgcccactgaatcgccaaaaaaattcccctcctccactccatctctataaaaatcctcccccaaatctcgcctcgtttagccgcacaactcacacaactctctctctctctctctctctctctctctcgtcgtctgcaagcttccgcctcccggatcgcggcgaccaccggaggaggagggagcagccatggcggacatcgacatggcgaacatcgacatggggaagatcctggcggggctggagaacgacgacgcgcgggtgcccaagaccaagctggtctgcacgctcggcccggcctcccgctccgtccccatgctcgagaagctgctccgcgccgggatgaacgtcgcgcgcttcaacttctcccacggcacccacgagtaccaccaggagaccctcgacaacctccgccaggccatgcacaacaccggcgtcctctgcgccgtcatgctcgataccaagggtcctgagattcgtactggatttttgaaggatggcaagccaatcaagctaacaaagggtcaagaactcactgttaccaccgattatgagatcaagggtgatgagaacatgattaccatgagttacaagaaactgccagttgatgtgaagcctggaaatgtcattctctgcgccgatggtacaatctctttgactgttttgtcctgtgatccaaaggctggaactgtgaggtgtaggtgtgagaacacagcaatgcttggcgagagaaagaattgcaatctgccaggaattgttgtggaccttcctacactgactgagaaggataaagaagacattttgggatggggtgtgccaaatgacatagacatgattgctctgtcgtttgtccgtaaaggatcagatttggttaccgtcagacaacttcttggacagcatgcaaagcgcatcaagctgatgtcaaaggttgaaaaccaagagggtgttgtaaacttcgatgagatcttgagggaaacggatgcatttatggttgctagaggtgatcttggaatggagattccagttgagaagatattccttgcacagaagatgatgatttacaagtgcaaccttgctggaaagcctgttgtgactgctactcagatgcttgagtcgatgatcaaatcaccacgtccaactcgtgctgaggcaactgacgttgcaaatgcagttcttgatggaactgactgcgtcatgcttagtggagagagtgctgctggagcataccctgaagtagctgtgaagatcatggcacgtatatgtgttgaggcagagtcttcccttgacaacgaagctgtcttcaaggagatgatcaggtctgcgccccttccgatgagcccattggagtctctcgcatcctctgctgtacgcacagccaacaaggccaaggcagccctgattgttgtcttgactcgtggtggtaccacggcaaagctggttgccaagtatcgtcccagggttccaatcctctctgtggttgtccccgtgttgacaaccgattcattcgactggacaatcagctcggagggcccagcaaggcacagcctaatctacagaggtcttgttcctctcctggctgagggttctgccaaagccaccgattcggagtcgacagaggtcatccttgatgctgctctcaagtcagctgtacagaagcagttgtgcaagcctggtgatgctgttgttgctctgcaccgtattggcgtcgcatccgtgatcaagatctgcatcgtgaagtaatcgctacacggtgtcttcttagcgccattttgctgggttaagtggcaaaacaaaaactgctatgcttgtttttactcccatagtccatctttgggagacaatttaattaccgtatcagcccctgcagttcgcagggtgcctttcgttacatagatttgctggtaaaatgaggagagatagaactccattatgtagagctctatttatcgtcgatgccatgtagtatggcaggtggtttctattccatgcctgcacaattttctggtagctactgtgttgtttgattactgttttttcaggtgatgtcgatggagttgataataatattggcatcattgtcgttgtatacgagttaaaaaagaatgtcccaggattcatcaggaataaaatatacccatatggccatatggatttttgtcttgtttaagattccggtgaccggggtacgaaatcttggttggtaatcggcggcctgagccgtttaacggtatactaattgcatgaactatgtattctgcaacgttatttgtggtaatacattattatgttccatttgctgtatctataaaacaatggttgatcaaaaaaaaaaaaaaaaaaaaaaaaaaaaaaaaaaaaaaa

SEQ ID NO: 3403 - DNA, 3152 bp, Oryza sativa
  Clone ID: PAT_MRT4530_7604C.1
gctcgagcgggacagcgccgacgcgctccgccgcgtcccgctcgcctgccgcgacgcgctccgcctccgcgacgacgccgtctcgctccggtcccatctcgcctccgtcctccagtcgctctcccaggctgagggttcatctgcagagtcaataactgcactagcacgaattgatactgtgaaacaacgaatggaagcggcgtatgcaacattacaggatgcggctggactagctcagttgagccaaagtgttgaggatgtattttctagtggtgatcatggtggtggtggacgcgtcggagttcggggcggaggggttcgacccgaagcggtggatcaacgcggcgctggacgcgcgccacccgtcggagccgctcgaccgcttcctcgccgacgccgaggagcgcctccgctcggccgccgacgacgccgcggccgcgctcgagcgggacagcgccgacgcgctccgccgcgtcccgctcgcctgccgcgacgcgctccgcctccgcgacgacgccgtctcgctccggtcccatctcgcctccgtcctccagtcgctctcccaggtgcgcccccgctcgcctgctagttggatctggatctcacagttcactcgtgcacaattttatgtgcatgtaaactttgagtatgctgtagaggacattcaaatccagcagttcagtgatgcccataaaactatgcctatagtctattataatgggataccgtcacttatatcatttagttcatataggtattcagtcccatctacatttcataaattctgtattactgatgatgatgatttcttcaatcaggctgagggttcatctgcagagtcaataactgcactagcacgaattgatactgtgaaacaacgaatggaagcggcgtatgcaacattacaggatgcggctggactagctcagttgagccaaagtgttgaggatgtattttctagtggtgatcttccaaaagctgcagaaaccctggcaaccatgagacattgcttgtcggcagttggtgaggttgcggagttcgctaatgtgagaaagcagcttgaagtattggaagaacggctagatgacatggttcaacctcgtttggtggatgcactttctaaccgcaagcctacaaattttggttggaaggtcgatgctgtgcaagatcttcgtggaatactgatacgtattggcagattcaagtcactggaggtgcaatatactaagatccatgtcaagcctctaaagaaactttgggaagattttgatctaaaacagagagctaagcgggtagagatggagaagtatggtggagaaagcataaacagtctctcatttgctagctggcttccaaatttctatgatgagacactactttaccttgaacaagaatggaagtggtgcctgactgctttccctgaagaatacaaatcactagtcccaaaagtacttgttgaaaccatgagtgagttgaattcaagttttgtctctcgtgtcaacctagcaactggagatgctgttcctgaaactagatctgttgcaaaaggtatactagatgttttatcaggtgacttgccaaaaagtaccaaattgcagaataagcatcttggagcactgatcgacctgcacaacatgacgggcacttttgctcggaacatccaacatttattttcagagtcagatcttttagttctgctgaatacattgaaagctatttattccccatatgagacttttaaagcaaggtatgggcaaatggagcgtgctttactttctgctgagatggctggtatagatatccgtggggccattgctcgtggtgtgggtgcacagggtatagagctgagtgaaactgttcgtagaatggaggaatccatcccacaaattatagtgcttcttgaagcagctgtcgagagatgcattagtcttactggtggttcagaggcagatgaactggtattggctctagatgacattatgctgcagtacatatcaaacctacaagaaactttaaaatcccttaggattgtatgtggggtggataatactgcacatagtgattcctctaaaaaggaagcaggactagagaaaaaagaagcacaacgattggtcgatgtctctgaagaggaagaatggtctattgtccagggtgctttgcagattcttacagttgctgattgcctaactagcagaacctcagtttttgaagcttctttaagggctactcttgccaggattggaaccaacttttctatttctggttttggttctagcctagataaatcaactgcagcaaatggtgatgagaatgcagaagtgcctatcacagggagggcagcacttgatattgcagctattcgcctcaccgatctaccagacaagtctaagaagctcttcactgtactagaacaggcaagttatatatttttaaattatcttgctagtgtcacaacactagagttatcacatgtttctctgatttgtttgaacagcctgattgcaaacttaggtggtagtattaagctagattatctgtcaaaagatccaaggttccatgctctacctctgacatcacaaagagttgcggccttctcagacacagtaaatgaactcgtctatgacgtgctcatatctaaagtccgacagcgtctcaatgaggttgctcgcctcccaatttggtcatcggtggaggaaccaggtggccttccccttccaagcttcagtgcctacccgcaggcatatgtgaccagtgttggggagtatctcctaactttaccccagcagttggagccacttgcagaaggtatctcaggcggtgaggctggcaacgaggaggctcagttctttgctactgaatggatatttaaggtcgcggaaggcgccaccgcgctgttcatggagcagctgcgagggatccattacatcaccgaccgaggcgcgcagcagctggcggcggacatagagtacctgagcaacgtcctctcggcgctgtccatgccgatcccacccttcctcgccaccttccacacctgcatctccaccccgagagaccaggtccgcgacctcatcaagtctgacggcggcagccagctcgacctccccaccgcccatctggtctgcaagatccggcgcatctcgtcatcagattag

SEQ ID NO: 3404 - DNA, 399 bp, Oryza sativa
  Clone ID: PAT_MRT4530_7616C.1
atgagcgaacacgcagtcaaggaggatgtggttcgccgtctcaagctcttgagcgcaaaaggggcaggccgagtggctatcaatgccgcgcttctggaggagatcagccgtccaacagcgctactgaaatgcaaaccagaggaagaatttgcacttagcagggcccttcgcgtgccagagaagatcggcacaagcaaaggagtgctggccaaagaagaacgcctggtacgccgaacgcgccgagtagcgctagtcactcgtccaacgccagaaaagacgatccccgacacccggcgtaagttgaatgtggagcaccgcatcccaaacaagaagaaattgggagatgaccgggacaatgagggcgccgcggatgtcagaaatccaggcgttgtttgctag

SEQ ID NO: 3405 - DNA, 2029 bp, Oryza sativa
  Clone ID: PAT_MRT4530_76302C.1
gttgttttcacttctaatcttccactattagtagtacggttgccacactgctagccaatccacttcgattggttccaccgcgcctaccgagtttcccttgctaggcagtagagagagtctgtgatcgagagagaagaggatcgagcagctagcaagccggcgggcgccatggtgctctcgcacgcgagctccggccgggacgacgccgtgcgctgcaccttcgcgacgcgctacgcctgcgagacgctgccgcggttcaggatgccggagcagtcgatcccgagggaggcggcgtaccagatcatcaacgacgagctgatgctggacgggaacccgcggctgaacctggcgtccttcgtcaccacgtggatggagcccgagtgcgacaagctcatcatggactccgttaacaagaactacgtcgacatggacgagtaccctgtcaccacggagctccagaaccgttgtgtgaatatgatagctcacctgttcaatgcaccaatcaaggaggatgaaacagctattggagttgggacggtgggatcctcagaagcaattatgcttgcaggactggcattcaagaggaagtggcaaaacaaacggaaggaacaggggaagccatgtgacaaacccaacattgttactggtgctaatgttcaggtttgctgggagaaatttgccagatattttgaagtagaactgaaggaggttaagctcagtgaaggatactatgtcatggatcctgtaaaggctgttgaaatggtggatgagaacactatatgcgttgcggccatcttgggctctactctcactggagagtttgaggatgttaagttattgaataatctcctaacagaaaagaataaggaaactgggtgggatgtgccaattcatgttgatgcagcaagtggaggatttatagcaccttttctataccctgagcttgaatgggacttcaggctaccactggtgaagagcatcaatgtcagtgggcacaagtatggccttgtgtatccaggtgttggttgggtcatttggcgaagcaaagaggatttgcctgaagaactcattttccatataaactatctggggacagaccagccgacgttcactctgaacttctccaaaggttccagccagataatcgcacagtactatcaactaatacgcctgggattcgagggatacaagaacatcatgcagaattgcatggagaacacagcaatactaagggaaggcatagaggcgactggtcgattcgaaatcctctccaaggaggccggtgtgcccttggtggcgttctcgctcaaggacagcggcaggtacaccgtgttcgacatctccgagcacctgaggaggttcggctggatcgtgccggcgtacaccatgccggccaacgccgagcacgtcgccgtcctccgcgtcgtcatcagggaggacttcagccggagcctcgccgagcggctcgtctcggacatcgtcaagatcctgcacgagctggacgcccattcggcccaggtgctgaagatctccagcgccatcgcgaagcagcaatcgggcgacgatggcgtggtcaccaagaagagcgtcctggagaccgagagggagatcttcgcgtactggagggaccaggtgaagaagaagcagaccggaatctgctagtgtggctctgtgagaaatgcttgaataacgtggcatgctcgatttgtgcatgggatggccggatcggatgggactgactggcggtgtacggacatggctgcccttgttcttatgttgaactgttgatgtagaaaaatgtgtggcctttgtatggttgtaagccatctacgtaccatggacttcagctatttggtggtttgttttcaacttttccatgtacacctggggcttgccaatctccttcctcctctttttaatctctataattatgggcaaagttttattattatttaggacgaaataaccaatcgattcaacttgacataccatcttttaataatagaaatggattacatttccagcttct

SEQ ID NO: 3406 - DNA, 3618 bp, Oryza sativa
  Clone ID: PAT_MRT4530_76315C.1
atggatgacggggacctcgatttctccaacccggacacattcctctgcccggccgtcggtggtgctgaccccgacggcagctgctccatggaacagctatttcgacgacatcctcaaggatacggagcaccatgcatgcacccacacccacacctgcaacccgcctgtgcatgacctctcacacacccacacctgcgtccatgtccacaccaagatcgtctccgccccatccgacactccgtcggatgctgccgagaccgccgagtccccgacggagaacaatgcctccaagaagcggccgtcgggtaaccgtgccgctgtgaggaagtacagggagaagaagaaagctcacactgcctcgctggaggaggaggttgttcatttgagggctctaaaccagcagctcatgaagaagctccagaaccatgccacgctcgaggcagaggtatccaggctgcggtgcctgctcgttgatattagaggaaggattgaaggggagattggggcttttccttatcagaggccagtgaagaacatcgatttggtttctagtgttgatcagggaagttatcttggtggtgcccaggttatgaactcctgtgactttcgatgtgccgaccagatgtattgcagtccagggatgcaggtgagaacaatgggcgaggatggcgctgtgagtggtcaggtgttggggcaaggtgcctgtgatattgccagtatccaatgccaaggtgcaaaatctggatctgcaaagctcccagtctgtggggctatggagcatggttattacggcatcccgggtcgacccacgggggcagtcaagccgcggcgaggcgacgaactcatcacctccactctctgctgcaacacgagtgaatcggaggcggcacgatgcgcaagtgggcgctctcctccgcgctcctcctcctcctcctcctcaccacactccccgatccagctaagaagctccaagtcaatgctgatgacagcactgatgagttagttgatccgccgaaggtagaggagaagattggtggtgttccccatggcctgtccacggactctgaggttgttcagagggaggctgagtcaatctcgaggaagaccctcaggagctcagcggagaaatttgagttccaggctgaggtgtccagactcatggacatcatcatcaactcactctacagcaacaaggacattttcctgagggagctcatctccaatgcttctgatgctttggacaagattaggttcctggctctcactgataaggaggttttgggcgaaggtgacactgctaagcttgaaatccagattaagctggataaggagaagaagattctctccattcgggataggggtattggtatgaccaaggaagatctcattaagaaccttgggaccattgccaaatctggaacttcagcttttgtggaaaagatgcagactgggggtgacctcaatctcattgggcaattcggtgttggtttctattcagtatacttggttgctgactatgttgaagtgatcagcaagcacaatgacgacaaacagcacgtctgggagtccaaagctgatggatcattcgctatctctgaggatacatggaatgaacccctgggccgtggaactgaaataagactgcacctccgagatgaagccaaggagtacgtggaagaagacaagctaaaggatttggtgaagaagtactctgagttcatcaatttccccatttacttgtgggcaaccaaggaggttgatgtggaagtgccagctgatgaggatgagtcaagtgaatcaagtgaagaagaggaatcatcccctgagtctacagaggaagaagagacagaagagagtgaagagaagaagcccaagacaaagacagtaaaggaaaccactactgagtgggagcttctgaatgatgtgaaggctatatggcttcgtagccctaaggaggttactgaagaagaatacacaaagttttaccactcacttgctaaggactttggtgatgacaagcccttgtcttggagccacttcactgctgagggagatgttgagttcaaagctttgctctttgttcctcccaaggctccacatgatctctatgagagttactacaactctaacaagtcaaaccttaagttgtatgttagaagggttttcatctctgatgaatttgatgagcttcttccgaagtatctcagctttttgaagggtctcgtcgactcggacacattgcctctcaatgtatcacgagaaatgctccaacaacatagcagcctgaagaccatcaagaagaaactaatccgcaaagctcttgacatgattagaaaacttgctgaggaagatcctgatgagtacagcaacaaagataagacagatgaagaaaaaagtgcaatggaggagaaaaagggccagtatgccaagttctggaatgagtttggaaaatcagtcaagttgggcatcattgaagacgcaactaacaggaaccgtcttgcaaagcttctgagatttgaaagtaccaagtcggaaggcaaacttgcctctcttgatgagtacatttcaaggatgaagccagggcagaaggacatcttttacattaccggaagcagcaaggaacaattagagaaatcaccgttccttgagaggctaaccaaaaagaactacgaggttatctacttcactgaccctgttgacgagtacttgatgcaatacctcatggactacgaggacaagaagttccagaacgtctccaaggagggtctcaaactcggcaaggactctaagctcaaggacctcaaggagtccttcaaggagctgaccgactggtggaagaaggctcttgacaccgagagcgtggactcggtgaagatcagcaaccggctgagcgacaccccctgcgtggtggtgacatccaagtacgggtggagcgccaacatggagaagatcatgcagtcacagaccctctcggatgccagcaagcaggcgtacatgcgcggcaagagggtactcgagatcaaccccaggcaccccatcatcaaggaactccgtgacaaggtcgcccaggacagcgagagcgagagcttgaagcagacggcgaagctggtgtaccagacggccctcatggagagcggcttcaaccttcctgatcccaaggacttcgcctccagcatctacaggtcggtgcagaagagccttgacctgagccccgacgcggccgtggaagaggaagaggaggtcgaggaggccgaggttgaagagaaggaatcatccaacatcaaggaggaggcggagccgtcgtcgtatgataaggacgagctgtagtgatgtgtcgccaccaactgttgtttttttatctagctcttgtgttaggttgtttaaaaatgtgatggtttcgagggacgtccatttttccatgcgaaaatgcatagtaccatgatacggggattttgtcgatgtacgtagtttgtgatactctagttcaaattaatggccgtctaatttcgatcaaaaaaaaaaaaaaaaaaaaaaaaaaaaaaaaaaaagaaaagcccacgtccggaatactaccttatttcatgacgtgattattcagggaacggacttggaagtagc

SEQ ID NO: 3407 - DNA, 1256 bp, Oryza sativa
  Clone ID: PAT_MRT4530_76352C.1
ccggccgggacccccaacccacgcctccctcgcatcgcccctccccgaccccgccgagatcggagcaggcgccgcctccctcctcccgcctcctcctccgccatggcgccgtctctgctcggggggttcaccaagtcgctggccatgacggtgctctcggagatcggcgacaagaccttcttcgccgccgcgattctggccatgcgctatccccggaagcttgttcttgctggttgtctcacctcattaacagtgatgacggctctatcagtttcacttggttgggttgcgccaaatctgatatcacgcaaatggactcatcatgtgaccactctgctattctttgtgtttggcattttgtcattgtgggaaggcttcaaagaagatggagattcagaagaattggctgaagtggaagctgagctggatgctaattttaaaagcaacaaagcagaatcgaaaagtaaatctaaggcaaatgatgataaaaagaagcagcaaagaccatttgttttgcagttcttctcaccaatctttataaaggcattttccattacattctttggagagtggggtgataagagtcaaattgctactattggtttggctgctgatgaaaatccattcggtgttgtcctggggggagttctggcccaagcactctgcactaccgctgctgttatgggtgggaaaagcttggcctctcaaatatctgagaaaatggtcggattgtcgagtggagtgctattcctgctgtttggtatcatgtcatacttgtcaggaccagaaggagaattataatgcccccagaaagtcatgcataaggagaattatcatgttcatcatggccggttaacaagcttgttttcactacgacttgatctcatcttagtaggtggacgatggcgacgaaagcgctgatcctttgcaaggaggatggcgattacttagcttagtcaacacattgtaaacatttcactcatcattcataaataacaagatggtaccaaagactctactggttgcttcgtgttagtcccagcaccagacaacattcagccaaaactgtcggagtagttgctgcatactaccatactatttttttggtcgcaactatgcataagaactgctagtcttcggactaaattgcctggactgaagaggggttacaaatcataaaaagtgatttcagaattagttgtttttctaaaaaaaaaaaaaaaaaaaaaaaaaaaaaaaggggaggggcctcgtgc

SEQ ID NO: 3408 - DNA, 585 bp, Oryza sativa
  Clone ID: PAT_MRT4530_76521C.1
atggggcgcgggaagatcgagatcaagaggatcgagaactccaccaaccgccaggtgaccttctccaagcgcaggagcgggatcctcaagaaggcccgcgagatcagcgtcctgtgcgacgccgaggtcggcgtcgtcatcttctccagcgccggcaagctctacgactactgctcccccaagacctcgctatcaagaatcttggagaagtaccagaccaattccggaaagatactgtgggatgagaagcacaagagccttagcgcggagattgatcgaatcaagaaagagaacgataatatgcagattgagctcaggcacttgaaaggtgaagatctaaactctctgcagcccaaagagctcatcatgattgaggaggcacttgacaatgggatagtgaacgtgaatgataaactgatggaccactgggaaaggcacgtgagaactcaccagcaagatatagcgctgagcgggagcatgagggatcttgagcttgggtaccatccagacagggactttgcggcccagatgccgatcaccttccgcgtgcagcccagccaccccaacctgcaggagaacaattaa

SEQ ID NO: 3409 - DNA, 1287 bp, Oryza sativa
  Clone ID: PAT_MRT4530_76522C.1
gcacgaggagcaaagccaacggaagcaaagtaaacagggcatgcccgttctggacctcccctactgaaccgcctcgaaagcctcctcatcaccattcctcttcctcccatggcgaactcctttactcctcctccacccccaccgcctcgcccatccacaccgacgccaaggcagcgcttgttcttgttgttgttgttgttgttggcttcgctttgctgctaagctagctggaggaaggaggaggaggaggaggaggcgggatggggcgcgggaagatcgagatcaagaggatcgagaactccaccaaccgccaggtgaccttctccaagcgcaggagcgggatcctcaagaaggcccgcgagatcagcgtcctgtgcgacgccgaggtcggcgtcgtcatcttctccagcgccggcaagctctacgactactgctcccccaagacctcgctatcaagaatcttggagaagtaccagaccaattccggaaagatactgtgggatgagaagcacaagagccttagcgcggagattgatcgaatcaagaaagagaacgataatatgcagattgagctcaggcacttgaaaggtgaagatctaaactctctgcagcccaaagagctcatcatgattgaggaggcacttgacaatgggatagtgaacgtgaatgataaactgatggaccactgggaaaggcacgtgagaactgataagatgctggaagacgagaacaagctgctggcttttaaactgcaccagcaagatatagcgctgagcgggagcatgagggatcttgagcttgggtaccatccagacagggactttgcggcccagatgccgatcaccttccgcgtgcagcccagccaccccaacctgcaggagaacaattaagctgctaggttgccccgccacttcgatcagttatctcatccactgatccaccactggattgaatgtcctagtgcattgtcaactgtatccctgttttcatgtctgtttcgatgaactattgagcatgtcatatgtgagttgctttgtgtgccaatatatagtctgtctctagtacaagctctgtgcttgccattctgcctcgctgtagatagcaccagcaatggagctagctcagatatcagtaacttcgtgcaagctgcaaggtatgcttgtgttatcaccgcatttgtcagatggtgaatagtagtttgtgattgtaacaaacaatttatgcaagcttggtttcatgctaaaaaaaaacaaccgaatttcaaaaaaaaaaaaaaaaaaaaaaaaa

SEQ ID NO: 3410 - DNA, 2016 bp, Oryza sativa
  UNSURE (1)..(2016): unsure at all n locations
  Clone ID: PAT_MRT4530_76548C.1
  unsure (1)..(2016): unsure at all n locations
tttntttttttntnttttttttttttttttttttttttttttttggcaaccaaaaatcgatttcagatttattgacaataatacaggtatgagagtctgaaatcatttctaaccacttacaacacttacaacagcggctaattacatgcgcaacttattcgaagaccactgaaattcacattttcctaatcaaaacatggcaagtcggatatctgacgtactcacctgaggatttggtgggcggctatttgcagcagaaactctggagccccactcaagaagctccttacttgtgtcatccttgtgtacaatcacctctatgaagcacaagcaatccttcttaggtccctgagcttcttcaattgcttccttcagttcctcctcggttcggacctttgccgtgtagcacttcccctcgccattatggaacgcttccaccacaccggtgtagttccaattcttgatgacattgtaaggaccgtcatggatctccacctcgatggtgtaccctccattgtttatgaggaagatgatgcttttctgcccccaacgaagcattgtcgacacttcttgtgccgtcacctgaaagcttccatctccgatgcaagcaatgactcgcttatccttagcagcctttgcatatcccagagttgcacctaccgaccaaccaattgatccatattgcatttgaaattcgtacccacagccctctggtagctttagcttctggcaattaaaccaagagtctccagtctcagcaatgacagccgagttggctgacaacattttctgaatatgctggaaaagtacattcactctcaatggctctccaggctcagacaaaggaggttcacccggaggcacataaatccgacgatagttctcatatgcagccgtgtttttcttcagccgtgctgaaagtgcatgcaggaagtccttcatcagaacacacccaaacgcaggcccatgacctatcaccacccggtctggctggacgatgatggccttctccttcttgagaagtagtgagtatccaaccgagctgtagtcattaaatattgggccagcaaatagatatgcatcagctgactcgacgatctcagcacaaaatggagtgctcacagcaccccagtacgtgccaataaacctaggatggtgctctggcacaagaccctttgcagaaggcatgaccgcaacaggataaccacaggcatcagccagctctacgaaggatttgcatgctttggccaccctcatttttggtccaccaacgaggactggcttgactgctttgttcaggaaagctgcagcagtttccactgctgcctccaggttcatctggtttgataatcttggggacaggaagaaaggaacagggtggcggctaaaggtgggatgtgggatagaggggaggttgcagctgatgcttatgtaaacaggcttgctctcctttattgcagtggagatggcagcatcaatctgctcatgtgcatcctccaagttgttcaccaccgcctgatagcaagtgacagtctggaagcacctgagctcctgcgtgaaatcaggcagcccgatggtgtgatgcaggatgcggttgctcccgtagtcgttgctgttggggcccccaacgatgcacaccacggggaggttctcgctgaacgcgccggcgacggcgttgatggcgctgaggccaccgacggtgaacgtgacggcgcacgccccgaccccgccgccgcgcgcgcgggcgtacccgtcggcggcgtacgccgcgttgagctcgttgcagcacccgacgagccgcaccccgccgtgccccgcccccgcctccgcctcgagctcgtcgagcagcgtgaggttgaagtcccccggcaccgtgaacacgtcgcgcgccccgacctccgccagccgccgcgcgaggtgccgccccagcgtggcctccctcggcgcggagttcgccgcgggggcaggcgccgccgcatcggaggccgtcggcaccgagccgatcgtggtgtccat

SEQ ID NO: 3411 - DNA, 2392 bp, Oryza sativa
  Clone ID: PAT_MRT4530_77185C.1
ctctcatctcctcctcctgtgttcgtgttcttcttcttcttgtagcagcgcttaaccaacccatcattagcgaccaaacctctctccctctccccctctgactaatcaaaattaaacaatttcgatctccaccttcctcttcttgattccagttccaccagagagagacagggtcttctctaatccatgtggtgcttgttggtctcgcttgcttcgtcttcgtcttcgtcttcctcttctcgcacctagtcccgcctcgtcgcctcctccggagaccggagccggacgggacggttgccggcgagcggcggtcgctttcttctctcggccctactcacgttattttcagtgactcttcttccaaaccaagtggtaaagccaggattctaccattacaatgacgatctgcagctgtgaggagacgatcaatgagtttgagatgttaacgcgtgatgctgcgcgtgtgcagaaggatacactgaaaaagatccttgagataaatgctagtgctgagtacctgcagaactttgggcttggggggaggactgatgccgagagctacaaatcctgcatcccattgtgtgtgcacaatgatattgagccctatatccagcggattgttgatggcgatacctcaccagtggtcactggagaacccatcaccaacctctctctcagttccggtacaacacacggaaagcccaagttcattccattcaatgatgaattacttgagaccacacttcaaatataccgtacatcttacgcgtttaggaaccgtgaataccctattggccaaggaaaagcactgcagtttgtttatggtagcaagcaagtcataacgaaaggtggcattcttgcaacaactgcgacaacaaacttgtataggagacagcgctataaggaaggcatgaaggatatccagtcgcagtgttgcagtcctgatgaagttatctttggccctgatttccaccaatccttgtactgtcacttgctgtgtgggttaatatactcagaggaggtccattcagtgttctcaacatttgctcacagcctagtccatgcattccaaacattcgaggaggtttgggaagatctatgcactgatataagagacggtgttctctcaaagaaagttacagcaccatcaattcgtgaggctgtttcaaaaatcctgaagcccaatcctgaacttgctgactcaatatacaagaagtgtattggtttgagcaattggtatggagtgatcccagcactgtggccaaatgcaaagtatgtgtatggtatcatgacaggatccatggagccatatctgaaaaaattaaggcattacgcagggaacttgccacttataagtgctgactatggcgcatcggaaggatgggttggctctaacatagaccctactgtgccaccagagcaggtgacatatgctgttctcccacaagttggttattttgagttcattcctttggagaaaccaataggggaggagacagaaaactccgcctccattcattacatagaatcagatccagttggcttgactgaagttgaggtcggcaaaatctatgaagttgtaataactaactttgcaggtctatatcggtacaggctaggagatgtcgtgaagatagcacgcttccacaactccacacctgagctccaattcatctgtcgcagaagcctagtgctgagcatcaacatcgacaagaacaccgagaaagacctccagttggctgttgaggaggcatcaaagttcctggaaggagagaagctcgaagtcatggatttcacgagcttcgtggaacgatcaagcgatccagggcgctacgtgatcttctgggagctgagtggcgatgcgagtgatgaggtcttgagcagctgcgcaaatgccttggatctagccttcattgacgcaggctacacgggctcgaggaagatcaagacgatcggcccccttgagctccggatcctcagaaagggaaccttcaaggagatcctagatcatttcctaagccttggtggtgcggtgagccagttcaagacaccaaggtttgtgaacccatcaaacagcaaggtgttgcagatactgagtagaaatgtcacccaaagttatttcagtactgcctatggattttgatacaaagaaacatattagatgctagcagctgcatgtaattacctttttacctcttgtttttcagctttactgtagtctccaccggaagaaaacgtttggtttagtctcttgaataatctattttcttatcctgtttgtgactatctagaatctatgtaaatggcccagctctagtgaaagttatggtgatgttatcaggaaagaaaatgtaaaatattacgttaattataaactatccttctttttacc

SEQ ID NO: 3412 - DNA, 909 bp, Oryza sativa
  Clone ID: PAT_MRT4530_77608C.1
atgtcgacgtgcgactcaatgaaaagcccagactttgagtatattgataatggggattcctcctcagttctaggttccttgcagcgaagagcaaacgagaacctgcgtatctcagaggatagagatgttgaagaaactaagtggaagaaggatgctccttccccaatggaaatcgaccaaatttgtgatgttgacaataactacgaggatccgcagttgtgtgctactcttgcttctgatatctacatgcacttgcgcgaggccgagaccaggaaacatccatcaaccgattttatggaaacactccaaaaggatgtaaacccaagcatgagagcgatcctgatagactggcttgtggaagtcgctgaagaatatcgtcttgttcctgatacattatacctgacagttaactacattgaccgttatctttctggcaatgagatcaatcgtcaaagactgcaattacttggagttgcttgtatgcttattgctgcaaaatacaaggagatatgtgcacctcaagtagaagaattctgctatataactgacaacacatacttcagagatgaggatccagcattgcatcttgagttcctagccaattatgttgctgagctatcactgctggagtacaatctactttcttaccctccttcactagtagcggcatcagctattttcctggccaaattcatactgcagccagcaaagcacccttggaattccacccttgctcactacacacaatacaagtcgtcagagttaagcgactgcgttaaggcattgcaccgccttttctgtgttggtcctgggagtaaccttcctgcaatcagggagaagtatacccaacataagatatatgcagctgatgtgatcgacttaaacatgatgattcagcgagattcttag

SEQ ID NO: 3413 - DNA, 1494 bp, Oryza sativa
  Clone ID: PAT_MRT4530_77611C.1
atgtcgagcaacctagcagcctcccgccgctcgtcgtcgtcgtcctcggtggcggcggcggcggcggcgaagcgacccgcggtgggggagggaggaggaggaggaggagggaaggcggcagcgggcgccgccgcggcaaagaagcgcgtggcgcttagcaacatcagcaacgtcgccgctggtggtggcgccccagggaaggccggcaatgcgaagttgaatttagctgcctcagctgcaccagtgaagaagggatctttggccagtggccgcaatgtgggcacgaatcgggcctcggcggtgaaatcggcttccgccaagccggctccggccatatcccgccatgagagcgccacacagaaggagtctgttcttcctcctaaagtgcctagcattgtgccgactgctgcactggcacctgtcactgtaccctgcagcagcttcgtctcccctatgcattcaggagattcagtttcggttgacgagacgatgtcgacgtgtgactcaatgaaaagcccagaatttgagtacattgataatggggattcctcctcagttctaggttccttgcagcgaagagcaaacgaaaacctgcgtatctcagaggatagagatgtcgaagaaactaagtggaagaaggatgctccttccccaatggaaatcgaccaaatttgtgatgttgacaataactacgaggatccgcagttgtgtgctactcttgcttctgatatctacatgcacttgcgcgaggctgagaccaggaaacgtccatcaactgattttatggaaacaatccaaaaggatgtaaacccaagcatgagagcgatcctgatagactggcttgtggaagtcgctgaagaatatcgtcttgttcctgatacattatacctgacagttaactacattgatcgttatctttctggcaatgagatcaatcgtcaaagactgcaattacttggagttgcttgtatgcttattgctgcaaaatacgaggagatatgtgcacctcaagtagaagaattctgctatataactgacaacacatacttcagagatgagtgctggaatgaatcgaactctaataactctcttattgcctacaacaggagatttgtccgtgttgcacaagtatcggatgagcttttcatcgtgcaggatccagcattgcatcttgagttcctagccaattatgttgctgagctatcactgctggagtacaatctactttcttaccctccttcactagtagcggcatcggctattttcttggccaaattcatactgcagccaacaaagcacccttggaattccacccttgctcactacacacaatacaagtcgtcagagttaagcgactgtgtaaaggcattgcaccgcctttttagcgttggtcccgggagtaaccttcctgcaatcagggagaagtatacccaacataagatatatgcagctgatgtgatcgacttaaacatgatgattcagcgagattcttag

SEQ ID NO: 3414 - DNA, 2189 bp, Oryza sativa
  Clone ID: PAT_MRT4530_77613C.1
cggcacgagggccgcccccgggtccggtcgctcccccccccccccgcctcctcccccgcacctctccgctccggctctccccgcctctgtcgggaaggaaaggatccaagccctcgccctcctctgcctctgatccccgccggccgccgccgccctcgcaaccctcgcagcagcagcaggaggaggagggttcaggtggtggttgccgtcggccgatgtcgagcagcctagcctcccgccgctcgtcgtcgtcgcggcggcgaagcggcccgcggcgggggagggaggagggaaggcggccgcgggcgccgcggcggccaagaagcgcgtcgcgctcggcaacatcagcaacgttgccgcggccgccaacaatgcgaaatttaattcagctacctgggctgcacctgtgaagaagggatctttggccagtggccgcaatgtgggcatgaatcgggtctcggcggtgaaatcagcttccgccaagccggctccagccatatcccgccatgagagcgccccacagaaggagtcagtccttcctcctaaagtgcctagcattgtgccgactgctgcacttgcacctgtcactgtaccctgcagcagcttcgtctcccctatgcattcaggagattcagtttcggttgacgagacgatgtcgacgtgtgactcaatgaaaagcccagaatttgagtacattgataatggggattcctcctcagttctaggttccttgcagcgaagagcaaacgaaaacctgcgtatctcagaggatagagatgtcgaagaaactaagtggaagaaggatgctccttccccaatggaaatcgaccaaatttgtgatgttgacaataactacgaggatccgcagttgtgtgctactcttgcttctgatatctacatgcacttgcgcgaggctgagaccaggaaacgtccatcaactgattttatggaaacaatccaaaaggatgtaaacccaagcatgagagcgatcctgatagactggcttgtggaagtcgctgaagaatatcgtcttgttcctgatacattatacctgacagttaactacattgatcgttatctttctggcaatgagatcaatcgtcaaagactgcaattacttggagttgcttgtatgcttattgctgcaaaatacgaggagatatgtgcacctcaagtagaagaattctgctatataactgacaacacatacttcagagatgaggttttggaaatggaagcttctgtcctgaattacctgaagtttgaagtgactgcacctacagcaaaatgctttttgaggagatttgtccgtgttgcacaagtatcggatgaggatccagcattgcatcttgagttcctagccaattatgttgctgagctatcactgctggagtacaatctactttcttaccctccttcactagtagcggcatcggctattttcttggccaaattcatactgcagccaacaaagcacccttggaattccacccttgctcactacacacaatacaagtcgtcagagttaagcgactgtgtaaaggcattgcaccgcctttttagcgttggtcccgggagtaaccttcctgcaatcagggagaagtatacccaacataagtacaaatttgtggcgaagaagccctgcccaccctcaataccgaccgaattctttcgcgacgcaacatgctgaactagaaaaataaaccaaggattagttacagttgctgactgaattcttcctccagaggcacctatgccaggttgtgccgtagaccgttcagataaccttgatgcaaggcatgctgcttgccccccccccccccccccctggttctttcaggcggtttggctgagtgtagatagatcgatgcttctgctgtgtgtggtaacttttatggtactgatgtgctttcttctatcttcttttccctgtacctagatgatccatggttttcagtactttgtacatcggagtcctgcagcaaagctttaaacatcttgtttgatattagctgccaacctgggcgtctcctaggttgatgtatgatagagtctctgttcgtgttgcttttgtgaaattctcaataagagcaccacattttcaacagtgctcattctgaataaaaaaaaaaaaaaaaaaaaaaaaaaaagggcaaacaatataaaaaaatccaagataaaaaactcga

SEQ ID NO: 3415 - DNA, 891 bp, Oryza sativa
  Clone ID: PAT_MRT4530_77697C.1
atgccggtggtggcagcgtccggccacggcctcaggaggacgatgtactccttgtactccaagggatccttcctcctgctgctggggcgccgatgcattggtggtggtggagcgccgccgggggaaggaatgggcatgcggtgcagtggagacgacgaggatcatctgatacctcgcaagtatcatctgatacgtggccgcgcgcagtgcacgcttcgcggaccaaacgtttccgtggtggccgtgcaccagcagaacacgccgcgcgtacgcgagagcgcagcagccgcgacgagcaacagagacgtgtaccgatccgtcacgacgtgcgcgcgcgcgagcgagaggatgagcgcggcggaggagagaggagatcggcaggagcgggacgatggggaaggtggagaggaggagcggcgggagcgaggcggggtgggcgggctggtggacagggccaaggggttcgtggcggagaagatcgcgaaaatccccaagcccgacgcgacgctggaccgcgtctccttcaagggcgtcagccgcgagtgcatcacgctccacagccacctcgacgtcaacaacccctactcgcaccgcatccccatctgcgagctcacctacaccttcaagagcggcgacaaggtgatagcgtccggcacgatgcctgacccagggtggatcgcggcgagcgggacgacaaatctggagctgccggtgaaggtgccgtacgacttcatcgtgtcgctgatcaaggacgtgagcggggactgggacatcgactacgtgctggaggtcgggatcaccatcgacctccccgtcgtcggcagcttcaccatcccgctcgccaccgagggtgagatgaagctccccaccttccgggacctcctcttctga

SEQ ID NO: 3416 - DNA, 492 bp, Oryza sativa
  Clone ID: PAT_MRT4530_77850C.1
gtggatccccgggctgcaggctcgatccgctctctctctctgcttcgattcgattcgattcgatcttctccacctcgtcgccgccgccgccgccgacaaggactggctcaggggctccatcttcctcatcatcgccaccctcgcctgggcctccctcttcatcctccaggccgcgacgctgaagaggtacgacgcgccactgtccctgaccacgctcatctgcttcgtgggcaccctgcaagccatcgtcgtcaccttcgccatggagcacagcatgtccgtgtggaagatcggcttcgacatgaacctcctcgccgccgcctacgccggtatcgtgacatcgagcattgcctactacgtgcaagggctggtgatgcagagcagggggcccgtgttcgcctcggcgtcagcccgctcatgatgatcatcgtcgccatcatggggtcgttcatcctcgctgagaacatctacctcggagggatcattgggtcg

SEQ ID NO: 3417 - DNA, 1371 bp, Oryza sativa
  Clone ID: PAT_MRT4530_77859C.1
atggggccctccgcagccgcgctgagggccgccgccgtggtggggctggttgtggcggtcgggctcgcgctcccgccgctggccgcggcgctgcggccgctcagggagcgcgtcgcgtccgcaggggccgcctcctcctccggatcgtggggcgatgagcatgcattcttcaagagggatgagaatgagataagtccgtactcatggaatatcacagggacatataaaggaagttggaactttgctggttccacaaatggttcttctaggtttcttgagtttacaaaattgaagggcgatgcggttttggaactattaagtacaccgacaaagataagcggggtgcactatgttcagggatctgttacattccatgatgttctagacaatgctcatgatcgtggagttgctcagataagtggtgcagatggcgagccacttcaagaagaggattacttcttatcaaatccatatcatttgaatatgtcagtacaatttggacctcttgcttttcataacctcaaagattccagttttgaggtagtttatatcattttgcagggagctgccaaggtttcaattctaatgatagggcaacaagctatcatggatgcatatctttgtctactgcatctgactgctgggatattggttgagtctctctttaacgcattcgcaacggctgctttcttcaagtttgtcgtattttctatatttgagatgcgatatctccttgccatatggaaagccagtagaccattgaacagtggagaaggctgggaagtaatgaggagagaattgtctgttctttacagccgcttttatggcattcttttgggagggatccttctcatgtatgagttgcacaattttctgcgcccacttcttttcctgatgtactccttttgggttcctcaaattgtcacaaatgtcatccgggatacaagaaaacccctgcaccctcagtatattttaggcatgacgatcactcgccttgctattccactgtatatatttggttgccctagcaatttcatgcgcattgagcctgacaagacatggtgcatagctgtgacaatattcatgggtatccaagcggcagtgctcctgctccagcactattttggttcacgctgctttattcctcaccagattctccctgagaaatactgctaccacaggaaggtagaggataacacaaatcagcccattgattgtgttatttgcatgactacaatcgaccttacccaaagaacaagtgaatacatggtggcaccttgtgagcatatattccactcaggctgtttgcaacgttggatggatatcaagatggagtgcccaacttgcaggcgctccttgccgccagcttag

SEQ ID NO: 3418 - DNA, 1882 bp, Oryza sativa
  Clone ID: PAT_MRT4530_77861C.1
ggagcgcgtcgcgtccgcaggggccgcctcctcctccggatcgtggggcgatgagcatgcattcttcaagagggatgagaatgagataagtccgtactcatggaatatcacagggacatataaaggaagttggaactttgctggttccacaaatggttcttctaggtttcttgagtttacaaaattgaagggcgatgcggttttggaactattaagtacaccgacaaagataagcggggtgcactatgttcagggatctgttacattccatgatgttctagacaatgctcatgatcgtggagttgctcagataaggttagaaggcgtgtacatatggccttttcggcaacttcggatggttgcaaacagtggtgcagatggcgagccacttcaagaagaggattacttcttatcaaatccatatcatttgctgcggattttctcctctcaagtgttccaagaaacctctgaagagaagaaccggaggaagaattctcttacttacgacatggagaagcattgtagcgtcgaaatagctgctaaggtggtccgtgtgtcctctaacctaaatgagggagagcatgagaaataccgtttggagggattgatggagagtacagcagtggatgatgatggagagtgtttctcaccgatcttattaaatgcaacatcattgaatgttgaagtttattacaacaaagcagtcaattatacactgatggtcacttttatctccttcctccaagttttgttactgattagacaaatggaacatagcaacacccaatctggagctgccaaggtttcaattctaatgatagggcaacaagctatcatggatgcatatctttgtctactgcatctgactgctgggatattggttgagtctctctttaacgcattcgcaacggctgctttcttcaagtttgtcgtattttctatatttgagatgcgatatctccttgccatatggaaagccagtagaccattgaacagtggagaaggctgggaagtaatgaggagagaattgtctgttctttacagccgcttttatggcattcttttgggagggatccttctcatgtatgagttgcacaattttctgcgcccacttcttttcctgatgtactccttttgggttcctcaaattgtcacaaatgtcatccgggatacaagaaaacccctgcaccctcagtatattttaggcatgacgatcactcgccttgctattccactgtatatatttggttgccctagcaatttcatgcgcattgagcctgacaagacatggtgcatagctgtgacaatattcatgggtatccaagcggcagtgctcctgctccagcactattttggttcacgctgctttattcctcaccagattctccctgagaaatactgctaccacaggaaggtagaggataacacaaatcagcccattgattgtgttatttgcatgactacaatcgaccttacccaaagaacaagtgaatacatgtggcaccttgtgagcatatattccactcaggctgtttgcaacgttggatggatatcaagatggagtgcccaacttgcaggcgctccttgccgccagcttagatgagcactactttgtaccatatagttaacaagtaggtagctcagcatattcaaggtgggaattgaggtgcaataagacgagttgcaaccatgggtggtttctcgaagatagctgtagaaaatctgttacgcttttaatctcaagtgatctctgtgttgtacacaaatcattgtaccaattctcccacggaggaaaaaaaaattttacttaaaaaaaaaaaaaaaaaaaaaaaaaaataaaaaaaaaaaaaaaaataaaaaaaaaaaaaaaaaataaatataa

SEQ ID NO: 3419 - DNA, 1485 bp, Oryza sativa
  Clone ID: PAT_MRT4530_77880C.1
gatggtgagccaagtggtcgccgaggagaagccgcagctgctgtccaagaaggccgggtgcaacagccacggccaggactcgtcctacttcctggggtggcaggagtacgagaaaaacccgttcgaccccgtctccaacccttccggcatcatccagatgggcctcgccgagaaccagctgtcgttcgacctgcttgaggagtggctggagaagaacccccacgcgctcggcctccggcgagagggcggcggcgcctccgtcttccgcgagctcgcgctgttccaggactaccacggcctcccggctttcaaaaatgcattggcgcggttcatgtcggagcagagagggtacaaggtggtgttcgaccccagcaacatcgtgctcaacgccggcgccacctcggctaacgaggcgctcatgttctgcctcgccgaccacggcgacgccttcttcatccccaccccatactacccagggttcgaccgcgacctcaagtggcgcaccggcgcggagatcgtacccgtgcactgcgcgagcgcgaacgggttccgggtgacgcgcgccgcgctggacgacgcgtaccgccgcgcgcagaagcgccggctgcgcgtcaagggggtgctgatcaccaacccgtccaacccgctcggcaccgcgtcgccgcgcgccgacctcgagacgatcgtcgacttcgtcgccgccaagggcatccacctcatcagcgacgagatctacgccggcacggcgttcgccgagccgcccgcgggcttcgtcagcgcgctcgaggtcgtggccgggcgcgacggcggcggcgctggcgtgtccgaccgcgtgcacgtcgtgtacagcctgtccaaggacctcggcctcccggggttccgcgtcggcgccatctactccgccaacgccgccgtcgtgtccgcggcgaccaagatgtccagcttcggcctcgtgtcgtcccagacgcagtacctcctcgcggcgctgctcggcgacagggacttcacccggagctacgtcgcggagaacaagcggcggatcaaggagcggcacgaccagctcgtggacgggctcagggagatcggcattgggtgcctgcccagcaacgccggcctcttctgctgggtggacatgagccacctgatgcggagccggtcgttcgccggcgagatggagctctggaagaaggtggtgttcgaggtcggcctcaacatctcccccgggtcgtcgtgccactgccgcgagcccggctggttccgcgtctgcttcgccaacatgtcggccaagaccctcgacgtcgccatgcagcgcctcaggtcgttcgtcgactccgccaccggcggcggcgacaacgccgccctccgccgcgccgccgtccccgtcaggagcgtcagctgcccgctcgccatcaagtgggcgctccgcctcaccccgtccatcgccgaccggaaggccgagagataatcgccaagaacaaaaccaca

SEQ ID NO: 3420 - DNA, 823 bp, Oryza sativa
  Clone ID: PAT_MRT4530_77902C.1
aagcacaatattgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactggctgcattgaactctgctgcttatttgcaacaacaattaccattcagccagctagttgctgcctacccccagcaatttcttccattcaaccaactagcagcattgaactctgctgcttatttacagcagcaacaactactaccattcagccagctagctgatgtgagccctgctgccttcttgacacaacaacagttgttgccgttctacctgcacgctatgcctaacgctggcaccctcttacaactgcaacaattgctgccattcaaccaacttgctttgaccaactcaacagtgttctaccaacaacccatcattggtggtgccctcttttagattgcttatgagttatagttcaataatgaagttttttggatgatgtttgtggcgtcccagaaataagaaagtacatttctagattcttaaaacaccaaaa

SEQ ID NO: 3421 - DNA, 379 bp, Oryza sativa
  Clone ID: PAT_MRT4530_77952C.1
atgtttctatttatggtcactaacatctcattctcctaatggtcatcactagctaatagctagcttaattacatcaatacgccatggcggccgagaagcaccaccaccacctgttacaccacaagaaggacgtcgtgccggccacctgtgtcgactccgaccgcgagggcgtatacacgtcggagacggtgaccaccgaggtggtcgccagccgacagcactagtgcgaaaggtacaagaaggaggagaaggcagcacaagcacaagcagcaccatcgctaggcctgtgccctcggcgcagcgccttcggccttgttgagaagcactaagcgaaaaacgacccggagaacgcgcacaggcacaagatcaccgaggagat

SEQ ID NO: 3422 - DNA, 2066 bp, Oryza sativa
  Clone ID: PAT_MRT4530_78529C.1
gtctcgccttgccgttgcgtctcgtataaaccctaagtctctctcttatccattcgtctctcttctctcatcagaagcggagcccgcggcgagagagcacagaggtatagtggtgggagggggaaggccatggcgccggcgctgagcaggagcctgggggcgtcgtccgttgcggcgctgaggccgaccccgtcgcggggccggggtcccacgctgcggagcgcggtcgcggtgcaggggaggggagcggcggcggtggccgcgagaggggtgaggtgggaggccgggaggaggaaggggaaggggaggatggtcggggtcaggtgcgaggccgccgtcaccgagaagcccgccggggaggaggaggcggccggcgagcagttcgagtaccaggctgaggtcagccgattgctggatttgattgtccacagcctgtatagccacaaggaggtttttctccgtgaactcgtaagtaatgcaagtgacgcgctggataagctgagatttctcagtgtaactgattcctctgtattgtccgatggcggtgagttggaaattaggatcaaacccgacccagaggctggcacaattactatcactgatactggcattgggatgaccaaagatgaactcaaagattgccttggaaccatcgcccaaagtggcacctccaaatttttgaaggctcttaaggagaacaaagatcttggtgcagataatggacttattggtcaatttggtgtgggattttattcggcttttcttgttgcagagaaggttgtggtttccactaagagtccaaaggcagacaaacagtatgtatgggaagctatggctgacagcagctcatatgttattaaggcggaaacgtgggctgagaaaatgttgacacgcggaacacagattactctgtttttaagagatgatgataagtacgagtttgctgaccctggacgtattcaaggtttagttaagaactattcccagtttgtttcattccccatatatacatggcaggagaaatcaagaacagttgaggttgaagaagaagaaccgaaagaaggtgaagaggcaacagagggtgaaaagaagaagaaaaagaaaacaatcactgagaagtactgggattgggaattggctaatgaaacaaagcccatatggatgagaaatccaaaggaagttgagaaaactgagtacaatgaattctacaagaaggcattcaatgagtttttggatcctcttgcttacacccactttacaacagagggtgaggtggaattcaggagcgtcctctacattccaggaatggcacctcttagcaatgaggagataatgaaccctaagaccaagaatatccggctgtatgttaagagagtcttcatatcagatgacttcgatggcgagttgttccctagatacttaagctttgtaaagggtgtagtggactcaaatgatcttcctctcaatgtttcccgtgagattcttcaagaaagtcgtattgtcaggatcatgcgcaaaagacttgtcaggaagacatttgatatgattcaggagattgctgagagagacgacgaggaggactacaaaaaattttgggagagttttggcaaatttgttaaacttggctgcattgaggacacaggaaatcacaaacgcctttctcctctgttgcggttttactcttccaaaaatgagacagatttgataagtcttgaccagtatgtagagaacatgccagaaaaccaaaaggcaatctactacattgctacagacagtcttcagagtgcaaagactgctcctttcttggaaaagttggttcaaaaagacattgaagttctctaccttatcgagccgattgatgaggttgccattcagaatttacagacatacaaagagaaaaaatttgttgatatcagcaaagaagacctggaattgggtgatgaagatgaggacaaggaaaatgagagcaagcaggaatacactcttctatgtgactggataaagcaacagcttggtgacaaagttgccaaggttcagatatcaaaacggcttagctcttcgccatg

SEQ ID NO: 3423 - DNA, 1317 bp, Oryza sativa
  Clone ID: PAT_MRT4530_78867C.1
gcccgcgcctcccaccgcacggcgcacgctcgcgatcgcgaacccccccagcgagggcaaggaagggagaggagacgaggaatctgagcgcgcgcgagcgagcgagcgcaagggtgggtggttccggccgcggcgggggggttgccccgggtgttggatgagaaggagggcgtcggcgtcggcgtcggcggcggcggtggaggcggtggcggtggtggcgggggtggaggatgcggaaggcgtacaaggactcgctcaaggtgctcgaagctgacatccagcacgccaacaccctggcctccgaatttccccgggagtacgatggcgcgtgcctgcagatgcggctctcgtatagccccgcggcgcatatattcctcttcctggtgcagtggactgactgcagcctcgccggggctctcggcttgctgaggatcctcgtctacaaggtttatgtcgacgggacgacgacaatgtctacccatgagaggaaagccagcatcaaagaattctacgctgtgatatttccttctctgctgcaactgcaaagggggattactgatacggaggacaaaaagcagaaggccgtgtgcatggagaggtacagaaggagagatgaggatgaaagaaacatcttatccgaaattgatgccgagagagaagaggagtgcgggatttgcatggagatgaacagcaaagtggtgttgcccaactgcacccataatatgtgcctcagatgctaccaggactggaattcaagatcacagtcttgtccattctgccgtgacaacttgaagaagactgaccctggtgacttatggatctatgttgaggaccaagatgtggttgacttggagacagtgtcaagagagaacctcagaaggctgttcatgtacataaacaagctgcctctgattgttccggatgtcatcttcagtatttatgattcccacataaaatgactcgcaacgctgcttcgtcgacagccttcagccaatgctctgttctgattaagctatgcccccaagttctccatttccatgcttagactcaagctcttggaaatgcctgaaccgttgtggagacacaaacctcctggttgtgttgtagaacttatttagtggttacatgcgtcctatcttcaagcatatcaaagccagcttgtatatatctgacatggctctgtcaatagagaacttgtgcatgccccaaatggaggcagtgctgtttgttactgttattctgagctctgttgtagcttgctcttgctgtttacaacatgatggctctgccaacatttgcatcaaaaaaaaaaaaaaa

SEQ ID NO: 3424 - DNA, 1450 bp, Oryza sativa
  Clone ID: PAT_MRT4530_79066C.1
tccccgggctgcaggaattcggcacgaggcgcaaatcgcatcgacttcgattcgcttcgtttcgttctcgctgttgatttgttcgtgagatttgaattctagcaatggctcctctcggtgacggagcggcggcggcggcggcggcggagcccaacctggtggtgtcgttcggggagatgctgatcgacttcgtccccgacgtcgccggcgtctcgctggccgagtccggcggcttcgtcaaggctcccggcggcgcccccgccaacgtcgcctgcgccatctccaagctcggtggctcctccgccttcgtcggcaagtttggtgatgatgagttcgggcacatgctggtggacatcctgaagaagaacggggtgaacgcggaggggtgcctgttcgacgagcacgcgcgcacggcgctggcgttcgtgaccttgaaaagcaacggcgagcgcgagttcatgttctaccggaacccgagcgccgacatgctcctgacggaggcggagctcaacctggacctgatccggcgcgccaagatcttccactacggctccatctccctcatcaccgagccgtgccgctccgcccacgtcgccgcgatgcgcgccgccaagtcggccggcatcctctgctcctacgaccccaacgtccgcctcccgctctggccgtccgaggacgccgcccgcgccggcatcctctccatctggaaggaggccgacttcatcaaggtgagcgacgacgaggtcgccttcctcacccagggcgacgccaacgacgagaagaacgtgctctcgctctggttcgacggcctcaagctcctcatcgtcaccgacggcgagaagggatgcaggtacttcaccaaggacttcaagggctccgtccccggcttctccgtcaacaccgtcgacaccaccggcgccggcgacgccttcgtcggctccctcctcgtcaacgtcgccaaggacgactccatcttccacaacgaggagaagctgagggaggcgctcaagttctcgaacgcgtgcggagccatctgcaccaccaagaagggtgccatcccggcgctgcccaccgtcgccgtcgcgcaggagctcatcagcaaggcagccaactagagctcctcggtttcgtcgtcgatcgccgccattgggggcctcggaattttaggtcgatttaatttagttgctgcttcgttttagacaaggaagaggaggggcttgggtgtgttcatgtctgtcttttgtgtgctaagttagttgcttccgtgtgagaacttttggcgtttatttttactattattattaataagaagctcttggatttgcggtggatattttggtctgaatttgtgtaatgaggcagctacttggcgaaatttattgtgtcatgtctttgttcagaggaaaagaaaatcttttcgtgtgctaaaaaaaaaaaaaaaaaagcggcc

SEQ ID NO: 3425 - DNA, 516 bp, Oryza sativa
  Clone ID: PAT_MRT4530_79068C.1
ccggccgggaagcaaaatccccaaatcctccagatcgtcttcgtcttccacctcgagctcttacgcatcgtcagccatgtcgggccgcggcaagggaggcaagggtcttggcaagggcggcgcgaagcggcacaggaaggtgctgcgcgacaacatccagggcatcaccaagccggcgatccggcggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagttcccggccccctgtgctcgatccagatctgatgccgttagcgttgcttagggtttcgttgcggaaattgtactacttcgttgtttctgcttgtgcaaagtgaatggatggttggattaaatgaatcattttctctcctaaaaaaaaaaaaaaaaaagcggcc

SEQ ID NO: 3426 - DNA, 1317 bp, Oryza sativa
  UNSURE (1)..(1317): unsure at all n locations
  Clone ID: PAT_MRT4530_79070C.1
  unsure (1)..(1317): unsure at all n locations
ggaggagagggtggaggggtggatgagggagtcatcgcagagatcgtgcggcacatcggggaggcgccgttcctggtgcacctgttcaacgacgacgacggcggcagcgggcggggaggcgcggggcgcgtgacggtgcggcgggagacggcgtcggcggagagctggcccgacgtgcggcggcggtggggcccgggcgggatgcggcgtcccgacggaatcatactggtcgagcagatcgccgcggcggtcgaggagggcggcgcgtccgccggcgccggcgccgccgaggcggcgcggcaggtgtggggcctggtggtgcangcccgcgggatggagtgcgcgtcgtgctacgtgctcgacacctgccgcgtccgctccccggcggggctctgcacccacttctgcctcgccagggcgcagtgcttcggcgacccccggcagggctagctccgcaacgcctggctcaaccgcctttcccctctctggtagtcaccgccgccgccgccgccgcggcgtactaatgtactaaagctaccggccttgatgcgtccgattcttgctgtgaagaagagcaaacgaagcgtgcagattgcaacggaagaacatattcagattctttctttgttttctttcgttccggtttctcccaaatgcggatttgtacagattattggttgcgaatttgcaatttgctacctcgattattccaacgaggagcgattcatcctgtcatcgaggcattgccccatgtactatgacaacatatgacaacaattttatgagaaatttttttagtatactttcttgatcggcaggacagatcaaccaaaaatcgccaccaaaaatccccaattccatcgtcgtcgatgtcggggcgcggcaagggagggaagggtctcggcaagggcggggcgaagcggcaccggaaggtgctccgcgacaacatccaggggatcacgaagccggcgatccggaggctggcgaggaggggcggggtgaagcgcatctcggggctcatctacgaggagacccgcggggtgctcaagatcttcctcgagaacgtcatccgcgacgccgtcacctacaccgagcacgcccgccgcaagaccgtcaccgccatggacgtcgtctacgccctcaagcgccagggccgcaccctctacggcttcggcggctaggagccttttgcattgtgtttgtcttgttaggaatctgcttgtttcggatgtagccctgtatcctgtaatgaagaaaatgctagcagtaaaacttgtttgaattcacctgaaaaaaaaaaaaaaaaaacccgcggcc

SEQ ID NO: 3427 - DNA, 1045 bp, Oryza sativa
  Clone ID: PAT_MRT4530_79072C.1
accgtatccttccccaaaatccccaatccccgagctgtttcacctccagcgagcgagcgcggcggccatgtcggggcgcggcaagggcggcaaggggctcggcaagggcggcgcgaagaggcatcgcaaggggctgcgcgacaacatccagggcatcaccaagccggccatccagaggctggcgaggaggggcggcgtgaagcgcatctccgggctgatctacgaggagacccgcggcgtgcttaagatcttggtcgcatcgcacccccgcgaatccccccccacaggccaacagcaaagcagaggcgaagggaagaagaagaagaagaagcggcggcggcggcggccatggcgtggcgtgcgaaccccgcccggcgcgactccaatcaccaccacctcttctccaattccactcgcttttctctctctctcgtgcgtcgagccaccggaatcgtcgtcgtcggcggccatgtcggggcgcggcaagggaggcaaggggctcggcaagggcggcgccaagcgtcaccggaaggtgctccgcgacaacatccaggggatcaccaagccggcgatccggaggctggcaaggaggggcggcgtgaagcgcatctccgggctgatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgatcgatcttgcctccctccgccatctctcccatgtcgtctggccgtgcccacaagtcttgcggtcaagaaaaaaagtttgatggaaagccgtggaatccaccttgttcagttcgctgtttagtttttctagtgtttacctgaatcatgaaattgtgaagcaaatgatgtttgcaactgggatttgaattgaaacatgtttcagagccaaaaaaaaaaaaaaaaaagccggccgatgtgtgaaaaaaaaaaaaaaaacccgcggcc

SEQ ID NO: 3428 - DNA, 1015 bp, Oryza sativa
  Clone ID: PAT_MRT4530_79077C.1
atgaggggactaggaaaccgtgcgcgcctaccggaaccacgaaattttcaatctctccccacaccgcaaaacgcgaaattttccacggcccccgcgcgcgggctccactccaccgaaaacccagccaaacgcgccagatccgcgcctcctccactcacacgcggatcgctccccgatccaacggcaggcgctgcccccccgcaccactcacgcggatcgctccccgatccgacggctgcccactcccctcccaactctatatatatccacccctcccaaaccaaccggcctccacatccaaatctcgccaccaaaaaaatccccaattccgccgtcgtcttcgtcgccgtcgccgcgaggatgtctgggcgcgggaagggagggaagggcctgggcaagggaggcgcgaagcgccaccggaaggtgctccgcgacaacatccaggggatcacgaagccggcgatccggaggctggcgaggaggggcggggtgaagcgcatctcggggctcatctacgaggagacccgcggggtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggctccccccaaatatttctctctcttcgtgtcgaggcgtcgcgtgttggttgccctgtgtagattgctgatttcaatgtagtacttagattctggcagtgaagaactgcaagtaaacttgtttgaaattcaccttgttgctattaatctaatgcaagtttttgcaattttttttggcggtcaattaaaaaaaaatcaattccaagtttgtcgatcatcttaggatgtcctcctagagaaaaagaagagaagaaaattgggagataaaaaaaaaaaaaaaaaaaaaaaaaaaaaaaaaaaaaaaaaaaaaaaaaaaaaagaaaaaaaaaaaaaaaaaagcggcc

SEQ ID NO: 3429 - DNA, 859 bp, Oryza sativa
  Clone ID: PAT_MRT4530_79079C.1
gactcctatagggcgattgggcattcacgagccggccgggaaaaaaaaacccgccaccaagagccacagcgatttcagatctccccaagtagtagacttctctcttcttccatctcggattcgtctcggtctcgtctcggtctccggcgatgtctgggcgcggcaagggaggcaaggggctgggcaagggcggggcgaagcgccaccgcaaggtgctccgcgacaacatccaggggatcaccaagccggcgatccggaggctggcgaggagggggggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagccctccggtcctccctcgccctcgcgctggccgcctctgccgccgccgcctcctggactggctgttgctggtgttttagctcttgttgtgtccttttgctttgctggtgtagagagacccggatgtgccacgggtgggtttttagtagtaggattagtagtatcccaactcctggttgtgatttgctcatttccatagatgtaatgacattacgatttcaatcgtagcaaaattatttgtttcctgctaaaaaaataaaaagttggttgacctgtgtagattgctgatttcaatgtagtacttagattctggcagtgaagaatgcaagtaaacttgtttgacattcaccttgttggtatcactctaacgcaagtttttgcaattttttttggcggtc

SEQ ID NO: 3430 - DNA, 867 bp, Oryza sativa
  UNSURE (1)..(867): unsure at all n locations
  Clone ID: PAT_MRT4530_79080C.1
  unsure (1)..(867): unsure at all n locations
nnttcgagcgccgggccgggaattccacacaaggcttcttccacatctccacccaaattccaaatctctcggtgatcggagcggttagctgcggcgatgtcggggcgcggcaagggaggcaaggggctgggcaagggcggcgcgaagcgccaccgcaaggtgctccgcgacaacatccaggggatcaccaagccggcgatccggaggctggcgaggaggggcggcgtcaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggaggctagacgagtacagattcgatggtgttgggcgtagcagcgctagcattattatgtcgtgtgctccgtgtgtgtcgttgtgtctgtgactccttgtgttctagtcgtcggtgtgtttcatcaagtttcgacttctggtcgactggatgtaataccttgttctgttcaatgaaaccttgtttatgaccgaaaaaaaaaaaaaaaaaagcgggccgatgcgatgctttttcacgcgattggatagggattcgattagtgccatgttcttcagttcgtcgtagtagcctagcctcttctcctgtagctgttgtttcatctcgtctcctgttccttcattaattagggatgtatgaactactggttcgttcgttcgaatggaataggaaatctgcagtgatttaccctctaaattcagttgcaatctcttgccgtgctatgtgaacgttttgcaacctgcattgttct

SEQ ID NO: 3431 - DNA, 1063 bp, Oryza sativa
  UNSURE (1)..(1063): unsure at all n locations
  Clone ID: PAT_MRT4530_79083C.1
  unsure (1)..(1063): unsure at all n locations
ggtccggnaatcnnncccgggccggccgggatctaaaccaaaaaaatccccaaatctcaaatcctcctccgtctccaagctctcgtcgtcgtcgtcagacatgtcgggccgtggcaagggaggcaaggggctgggcaagggaggcgcgaagaggcacaggaaggtgctgcgcgacaacatccaggggatcacgaagcccgcgatccggaggctggcgaggaggggcggcgtgaagcgcatctccgggctgatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgattccttccttccttccttcctggtggcgtgcgggtggtggtggtggtgtaggagctagggtttcgatgggattcggggggaatttctgctttgtgttggcttctgtgtagcgactcttctgtttaaatgaattcgatgaatctgaactgaaaaaaaaaaaacaaaaagaggccctaataaaatatatatgtcttccctgatgccaatttagccgaaagtcgtgaaactgcctttctgatgaatcgaatttttgtttttttcaaaacatgctttggagccccgtcgagtgcctctttctgatctcgacggtgtattcggtgtttgctctcagcgcgttcacagttcccacacccggtccgggaagcacaggctttgcctaccccggcggcgtcgtcgacggggcgggcgtcagcttgttggccggcgcaggtcacattccggacttccccggctcctccttcaccgtgcgcggaacgcagacggcgcccgccggcggcggcgccacggcggtgaaaacgacggcggcgaggaggacgcaggcgacaagcggcggcgacgacgccatggcgacgagatggaggttgcaaaattgcagtggttgtgattaacgtgttactaataataatttgatggattttttcggacgcgtgg

SEQ ID NO: 3432 - DNA, 1050 bp, Oryza sativa
  Clone ID: PAT_MRT4530_79084C.1
ccggccggactcactgctcacaaccaccgaatccttccccaaaatccccaatcccccatctctttcacctccagcgagcgagcgcggcggccatgtcggggcgcggcaagggcggcaaggggctcggcaagggcggcgcgaagaggcatcgcaaggtgctccgcgacaacatccagggcatcaccaagccggcgatccggaggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgaggtccgccgctgcatccgcctggccgtggggacaagtcttggctcgcggtcaagaaatccgggaggatatctccaattgatctgggtctcagttagtagtagtagcagtagtttgtgttggcatcgttcttgtgcctggggcaagtttgctttcgtgttctgaacttgtgctgtgtaaatccgtatggtgttttagctattaacaaagttgggtcattcgctgcgaaaaaaaaaaaaaacatcgtcccttcttacttttttcctgcatgctttggagcttggtcgagtgccactttctgatctcggacgtttatttgttggctgttctttgccatgttcacagtccacagagccattgatttcagcacaggcgttcggagccgcggtggcaggggcgacgggctgctgcggcggcggcggcggctgtagcgccgcctgcggaggagcgggcgtcgtccagtagaagcctccggcgggggcggcgtcgaagccggcggcggcggcgaggtcgtccatcagaggacagtcgaagacccacgtggagccctccggggaggccatggctgcgggggggtggggccgctcaccgtggccggcgacggtggccggaggaggctagggtttcgaggtcgcgaggagatttgga

SEQ ID NO: 3433 - DNA, 2880 bp, Oryza sativa
  Clone ID: PAT_MRT4530_79184C.1
ggacccaaaactcacctaggatcccattgaaacgtaagaaaagaaaacaagaaacacattgcgtttgggcattacagtacgaaaatttgaagaacgcattgacaggcgaaggtatgccatctcaagctcttgaattgatttatgttttacaaagctgaccgtctcagattatgctcccggaggccggaattacatttataacatacacaataggggtagcaggtttataaagcattgcagtaggtagagtgaggacagaaataaatttttccactttgacgtcgaataagcgtagagcaatcaagtgttgaggttctggaacagctcaggcagatgggcgttcgtgagcttggtccggcgtgtgatctcacgctgcttcttcttaggcttagccttgggctgcaccccattgatctgtgctgcagcccgccgtttagctgtgttggtcatgggcttgatgccattcttctggagctccttctcgatatccaccatgtcccgcggtaactccatctcccggaagagctgcttcaggtcatcgtcgaccttgatctttgcctttgggtcgttaggatacacaatgtcctcctgggaatccatgttcgataacagccaaacttcacctgctgccttcagtgcctgcaaatcttccattacagttgggtacgcatccttgacttccaccacagcaagaccctccggatactttcttaccaaaacaagtagttgatcttttcccttcaaatcatgcttggacttgtaagagaaacgtctcccatcataatgtactttaggattgttcctcagactgtcaaagacagacttattcccatggatatcaacataagttgtttcatttatttgctccgcagtaaaagcttgtcttgtcggatcagctgcgctttccggttggtacgggtacggcggcgggcgggcggaggcgtcggaggaggaggggatgggggtagaggagaggagcgcggcgatcggatcggggattgtcaccggaggcttcgccccgccggcgagcacggggtgggtggaggcggcgggaggggggagagcgccgccgcggtcggcctcatcagcgtaggctggctcgaggatggcggcctcggcttcctgcacctccttctcagtcttccttcccttcttggacttgtagtagacgctcataaaggtaccgacggcaccatacttttggcggcaatgctcgtagtgagaagcatcaaacatcctccagaagtccttctcgttgagctcagatacagcgtactgtggctggtagctgtggttctcaatcagccactgctccagcctgtggacagctagagcgccattgaactcctcgcccctcaggacagcaccaggagcatagtacacaccaacatcggtgaacatctgggcatagctagtgtcaccttgcctgtggtggtgctcaaagccaggctctgggtacaccatggttttcacagggagcttgtagagccggtgcgggcacagccacagtggataaacctccatttccttgtgaacaaactcaagagcatctccaactttgtacaagggaaccagcatgtcttgaatcacatggttgtcatggtagtaattcctgatagattcaccctgtgtggccttgagcagagacacctttggtggcatcagccagcccaagaggaacctgaaccagaattggtcgccgaatggcaagatcagcttcccctcccagtacagacaccgggtgtgacggtggtagtactctcttgttggaatgtactccacaaactcacccttcttgagtgctgtctgagcatgttggtaaaaccaaggcttgaaccaccacccgacacagttgatcttattgcccttcttctttgcctcttctttggaagcataaacaccagtcatcatgacaccctcattttctgtgtacaccattccctcaacgaagtctgggacctttgcaggatcaccatctcgtggtgcaaacgaatcacaataaccttgtgctatctccttcagtgaccctttaactggagtatatgtgagcctcatgtattccttgatgggaatgagtttgatctcagcggaaacaagaaacccaagtgttccctgggaccagggaatgccatagaaaaggtcagagtactcattatccttagtggctctaacaactcgaccgtctgcaagaacaacttccacggcgacaacagtgtcagagaaaagaccatagaggtgagagctcccttcaataccatacccattgatcagtcccccaacagtaaggtcatcaagctcagcaacaactgcaagggcaaggttcattgggcatgtagctctggttatctggcccatgttgacaagaggctcaaccttggcaaccattctctctctgtcaatctcaagaatgttcctgaaggcggaaaggtcaacctcaaaatgcctagcacgcttgtagtctacattgcgcatgccaacagcaatccagggcttcctagctgtgcaaacaaggccatccttctttgggttcctctgcttgagccgcttcacaactttttgcacattgtcatcatgttccttctggcgacgtttctcagatttcatggcagaccagacatcgcccaaatagatattgaagtagatcagagcggaaatggggagcaccacaaagatcaccagaatccatcggaactttaccaagtagtccaccaaaaccttcttcctcttcggacgaacgaggggctcctgcagatctgccattcttcttaggcttagccttgggctgcaccccattgatctgtgctgaagcccgccgtttaatcttgtgttgttcatgggcttgatgccattttttaggagctcttttttgattttcacata

SEQ ID NO: 3434 - DNA, 2846 bp, Oryza sativa
  Clone ID: PAT_MRT4530_79187C.1
atggctagcatgcacgcacgcacgcacgcagcaaaacatgctcccacacggagacaccacagatctgttcaggcggggacctcagaaacctcacgggttcagctaaaccctccccaagaacccgaaccaaccaaacccccccaaatccctccctcgaaaaacaagccgctaccaacactaccactacgactacgactctacaccgcaagaacccggaagaaacgggactggatccgtcgatccgagcgggaagaaatcccctcaaggcaatctccggtggctcatgaagcggcggggaggagggagagaagacgagtggcatatatttttgctaaagttcacctcatctgatgctacagctcaaattaatagctgaggaaattaactagtccagtagccacaaaattattcagatcttgggttaaataccacttaagtcctgactaagttcagcaacttgatcaagggtgaaagaagtaccaagagcagacggacgacgatgacaggattacaaagtgctacaaacactgcacatcaagttctaagcaaaaggatagttcagatgaaaaatcccatttggaatggggagaaaacccggacgactaaaccatcaaaggtctcaacgaaattacgcctcatcagcgtaggctggctcgaggatggcggcctcggcttcctgcacctccttctcagtcttccttcccttcttggacttgtagtagacgctcataaaggtaccgacggcaccatacttttggcggcaatgctcgtagtgagaagcatcaaacatcctccagaagtccttctcgttgagctcagatacagcgtactgtggctggtagctgtggttctcaatcagccactgctccagcctgtggacagctagagcgccattgaactcctcgcccctcaggacagcaccaggagcatagtacacaccaacatcggtgaacatctgggcatagctagtgtcaccttgcctgtggtggtgctcaaagccaggctctgggtacaccatggttttcacagggagcttgtagagccggtgcgggcacagccacagtggataaacctccatttccttgtgaacaaactcaagagcatctccaactttgtacaagggaaccagcatgtcttgaatcacatggttgtcatggtagtaattcctgatagattcaccctgtgtggccttgagcagagacacctttggtggcatcagccagcccaagaggaacctgaaccagaattggtcgccgaatggcaagatcagcttcccctcccagtacagacaccgggtgtgacggtggtagtactctcttgttggaatgtactccacaaactcacccttcttgagtgctgtctgagcatgttggtaaaaccaaggcttgaaccaccacccgacacagttgatcttattgcccttcttctttgcctcttctttggaagcataaacaccagtcatcatgacaccctcattttctgtgtacaccattccctcaacgaagtctgggacctttgcaggatcaccatctcgtggtgcaaacgaatcacaataaccttgtgctatctccttcagtgaccctttaactggagtatatgtgagcctcatgtattccttgatgggaatgagtttgatctcagcggaaacaagaaacccaagtgttccctgggaccagggaatgccatagaaaaggtcagagtactcattatccttagtggctctaacaactcgaccgtctgcaagaacaacttccacggcgacaacagtgtcagagaaaagaccatagaggtgagagctcccttcaataccatacccattgatcagtcccccaacagtaaggtcatcaagctcagcaacaactgcaagggcaaggttcattgggcatgtagctctggttatctggcccatgttgacaagaggctcaaccttggcaaccattctctctctgtcaatctcaagaatgttcctgaaggcggaaaggtcaacctcaaaatgcctagcacgcttgtagtctacattgcgcatgccaacagcaatccagggcttcctagctgtgcaaacaaggccatccttctttgggttcctctgcttgagccgcttcacaactttttgcacattgtcatcatgttccttctggcgacgtttctcagatttcatggcagaccagacatcgcccaaatagatattgaagtagatcagagcggaaatggggagcaccacaaagatcaccagaatccatcggaactttaccaagtagtccaccaaaaccttcttcctcttcggacgaacgaggggctcctgcagatctgccatggctgcagtccggctcttgggcccgatccgaaccgggaaggaggaggaggaggaggccggcggcggctcggcggcagcgccgcgcgggcggagacggcgaggcgaggcgaggagctcggcctcactgcctctgctctggcgccgctggtcggggtggggagccggaggtggtggtggcggagtctggggacgggggactcaagggggatgggggactcaagtagtggagtggagcgcacagcgcaggggcggaaagggaaattccttttcggcgccacagcctccacgtgcctcctcaccgccgtggcctcccgctcattgtcgccccaatgatgctgccatagcacgggcgacgacctccctttcttcggcgtcagccacccctacctcgcactcaaggatcctccaccaccatccaccttcgcacggacatcatcgctgcggagagggagtgggccgggaggagctctgggatggccccagtgagagaagagggagagagggagaaagaggagaaagaggggggagaggg

SEQ ID NO: 3435 - DNA, 1540 bp, Oryza sativa
  Clone ID: PAT_MRT4530_79269C.1
gtcgctcgcctccgctgctggtgtcgagccgcttccgatccccccccctcccgacgcgaggccgaaaccctaccgccgatgacgtcatccggcgctcccccgccggcggcgatggccgtggacgacgcggaggacgaccagctcgcctccatgtccacggaggacatcgtccgtgcctcccgcctactcgacaacgagatccgcgtcctcaaggatgagctgcagcggaccaacttggagctggaatcgttcaaggagaagattaaggagaaccaggagaagattaagctcaacaagcagcttccctacctcgtcggcaacatcgttgagattctggaaatgaaccctgaggatgaagctgaggaggatggtgctaatattgatttagactcacaaaggaaaggaaaatgtgttgttctgaagacttccacaagacaaactatattccttcctgtggttgggctagttgaccctgataaactcaagcctggtgatttggttggagtaaacaaagacagctaccttatactggacacactgccatcagagtatgattcacgagtaaaggcaatggaggtggatgaaaaacccacagaggactacaatgatattggaggtcttgaaaagcagattcaagagcttgtggaggcaattgttttgccaatgacacacaaagatcggttccaaaagttgggcattcgcccccccaaaggagttcttttgtatggaccacctggaactgggaagacattgatggctcgtgcatgtgctgcacagacaaatgcgacgttcctgaaattagctggtccacaattagtccagatgtttatcggtgatggagcaaagctggttcgggatgcttttcagcttgctaaggagaaagctccctgcatcattttcattgatgagattgatgccattgggactaagaggtttgacagtgaggttagtggtgacagagaagttcagaggactatgttggaattgctgaaccaactcgatggatttagtagtgacgagcggataaaggtcatagcggcaacgaatcgtgctgacattcttgatcctgctttgatgcgatctggtcgtttggaccgaaagattgagtttcctcatccatctgaagaagcaagagctagaatcttgcaaattcactcaagaaaaatgaatgtaaacccagatgtgaattttgaagagctggctcgctcaacagatgacttcaatggagcgcaactgaaagctgtttgtgtcgaagctggtatgcttgcactgcggcgagatgctacagaggtgactcatgaggacttcaacgaaggcataatacaggtgcaggctaagaagaagtctagcctaaattattacgcttaacaagctatgctagaatcatcagggctctggagttgtttgtaaccatactgtttggataatcgaaaatatggcttcacgtttcatttgaggtataacttttttacactataaagtcatcacttgcttcttatgtgatggaaagttggaaaaaaaaaaaaaaaaaaaaaaaaaa

SEQ ID NO: 3436 - DNA, 1602 bp, Oryza sativa
  Clone ID: PAT_MRT4530_79285C.1
atggccggaggaggggcggcgccgccgccgaagcaggaggagttgcagcctcaccaggtgaaggaccagctgcccagcgtgtcctactgcatcaccagcccaccgccatggcctgaggccgtcatacttggattccagcactacattgtgatgctgggcacatcagtgattattcccagtgctcttgttccccagatgggaggtggaaatgaggagaaggctcgggtgattcagacgctgctgttcgttgccgggataaacaccctctgccaatcgttcttcgggactcgtcttccagctgtgatgggaggatcgtacaccattgttgcgccgacaatttccatcatattggctggccgctatagcaatgaagcagatcctcatgagaaattcttgcggacaatgcgaggaacacaaggtgctctcatcattgcatcgacaatccagatcatacttggtttcagtggtctctggcgcaatgtagttagacttcttagtccattgtctgctgttcctttgatctcacttgctggatttggcctctatgagcttggttttccaggggttgcaaagtgcgtggaaattgggctcccagaaatcattctactgcttgtattttctcagtatttaccccatgtcatacatgtggcaaagcccgtgttcgaccggtttgctgtgattttcaccattgctattgtgtggctgtatgcatacattctaactgctagtggcgcatacaagaatgcccggccgaagacacaagtgcactgtcgtgttgatcgctctggaattatcagtggagctccatggataagagttcctttcccttttcaatggggggctccaacatttgatgctggtgaatcttttgccatgatgatggcctcatttgttgctcttgtagagtcaactgggaccttcattgctgtgtcaagatatgcaagtgcgactatgatacctccatcagtgcttggtcgtggaattggttggcagggtattggtactttaataggtgcatttttcgggacagccaatggaactgctgtatcagtggaaaatgccggtttgctagctttgacacatgttggcagccggagagtagtgcaaatatctgctggcttcatgatcttcttttctatccttgggaaattcggagcaatctttgcgtcaattcccttaccaatattcgctgcactgtattgcatcttctttgcatatattggtgcctgtggtctgagcttccttcagttctgcaatctcaacagcttcaggaccaagttcattgtggggttctcgttcttcatgggcttatcggttcctcagtacttcaacgagtatacatcggttgccggttatggtccagtgcacaccggcgctcgatggttcaatgacatgataaatgtacccttcgcgtcaaagccgttcgtcgcagggctcattgcgtacttcctagacaacactatccagaggcgcgacaatggggtgaggagagacaggggataccactggtgggacaagttcaggagcttcaagacggacacccggagcgaggagttctactctctgccgttcaacttgaacaagttcttcccttccgtgtga

SEQ ID NO: 3437 - DNA, 2441 bp, Oryza sativa
  UNSURE (1)..(2441): unsure at all n locations
  Clone ID: PAT_MRT4530_79466C.1
  unsure (1)..(2441): unsure at all n locations
tcccgggngtacgacccatcgccgtccgcccattaccacctccacctcgcgcactcagtctgtactacctgtacgtacgtggccgccgctagctaagctaggaattgaaatggggatggagaggccgcaagagaaggtggccaccaccaccaccgccgccttcaacctcgccgagtccggctacgccgaccgccccgacctcgacgacgacggccgcgagaagcgcacagggacgctggtgacggcgagcgcgcacataataacggcggtgatcggctccggcgtgctgtcgctggcgtgggcgatagcgcagctggggtgggtgatcgggccggccgtgctggtggcgttctcggtcataacctggttctgctccagcctcctcgccgactgctaccgatctcccgaccccgtccatggcaagcgcaactacacctacggccaagccgtcagggccaacctaggtgtggccaagtacaggctctgctcggtggcacagtacgtcaatctcgtcggcgtcaccattggctacaccatcactacggccatcagcatgggtgcgatcaaacggtccaactggttccatcgcaacggccacgacgcagcctgcttggcatctgacacgaccaacatgatcatatttgctggcatccaaatcctcctctcgcagctgccgaattttcacaaaatttggtggctctccattgtcgctgctgtcatgtcactggcctactcaaccattggccttggcctctccattgcaaaaattgcaggtggggcccaccccgaggcaaccctcacaggggtgactgttggagtggatgtgtctgcaagtgagaaaatctggagaacttttcagtcacttggtgacattgcctttgcatactcctactccaatgtcctcatagaaattcaggacacgctgcggtcgagcccggcggagaacgaggtgatgaagaaggcgtcgttcatcggagtctcgacgacgacgacgttctacatgctgtgcggcgtgctcggctacgcggcgttcggcaaccgcgcgccggggaacttcctcaccggcttcggcttctacgagcccttctggctcgtcgacgtcggcaacgtctgcatcgtcgtccacctcgtcggcgcctaccaggtcttctgccagcccatctaccagttcgccgaggcctgggcgcgctcgcggtggccggacagcgccttcgtcaacggcgagcgcgtgctccggctgccgctcggcgccggcgacttccccgtcagcgcgctccgcctcgtctggcgcacggcctacgtcgtgctcaccgccgtcgccgccatggcgttccccttcttcaacgacttcctcggcctcatcggcgccgtctccttctggccgctcaccgtctacttccccgtccagatgtacatgtctcaggccaaggtccggcgattctcgccgacgtggacgtggatgaacgtgctcagcctcgcctgcctcgtcgtctccctcctcgccgccgccggctccatccagggcctcatcaaatccgtcgcacattacaagccattcagcgtctcctcatgatcaaattaataattatttgttaatactgatgatgatgatgatatgatccatcgatcgatgaagaacaaatatatatatatagcgagatcgatcgatcgatcaagatcgtgaatgatatatataatacatagttaatcaatcagatgttaattaagtcgtgttcgtgcgtgtctttcagagttcagatcgacaggttgatttgagatgagtgctcaagtgtttcgtcagatgtaattaactatgtaagtggtaaatttagcctgatgatgatgatgatcagtctgaatggatgtcatgtaagtggtaaatttgacatgaatgtaacaaagtagtagcttagttgcagaatttcagtacaccaaacgaattaaatcacagtctcaacttcaataaaaagttaacagctagatgtaagtaaaccgggggatgacgcagcggcggcgagggagcgggcccaccgcgccccccgccccctcgcccctcgccgcgtcccgctcccccgccccccccgacccccaccccccccgccgcccgccgccagacgcgcgcaggtacccccgcgcccgcgcccgcgcacccaaccgaggcgctgccccgtgccggcgctgccccgcgggacagcgcggcacgcgcgggggctcggccattcggtccggccgccctgctggcgtccgccctggtgccgccccacgctccaccccgctcgctcccgagctcccgaccccccccaccccgtccgctgccacgcccacggccctgccggcaggccccaccgcggcgtggcctgggccaggcccggcccgctcccgcggcacgtccgtctcgtcggcgtcaccattggctacaccatcactacggccatcagcat

SEQ ID NO: 3438 - DNA, 1509 bp, Oryza sativa
  Clone ID: PAT_MRT4530_79467C.1
atggggatggagaggccgcaagagaaggtggccaccaccaccaccgccgccttcaacctcgccgagtccggctacgccgaccgccccgacctcgacgacgacggccgcgagaagcgcacagggacgctggtgacggcgagcgcgcacataataacggcggtgatcggctccggcgtgctgtcgctggcgtgggcgatagcgcagctggggtgggtgatcgggccggccgtgctggtggcgttctcggtcataacctggttctgctccagcctcctcgccgactgctaccgatctcccgaccccgtccatggcaagcgcaactacacctacggccaagccgtcagggccaacctaggtgtggccaagtacaggctctgctcggtggcacagtacgtcaatctcgtcggcgtcaccattggctacaccatcactacggccatcagcatggggtacctactgtctactatgactaattactctagtaaatttgggcatgcgatcaaacggtccaactggttccatcgcaacggccacgacgcagcctgcttggcatctgacacgaccaacatgatcatatttgctggcatccaaatcctcctctcgcagctgccgaattttcacaaaatttggtggctctccattgtcgctgctgtcatgtcactggcctactcaaccattggccttggcctctccattgcaaaaattgcaggtggggcccaccccgaggcaaccctcacaggggtgactgttggagtggatgtgtctgcaagtgagaaaatctggagaacttttcagtcacttggtgacattgcctttgcatactcctactccaatgtcctcatagaaattcaggacacgctgcggtcgagcccggcggagaacgaggtgatgaagaaggcgtcgttcatcggagtctcgacgacgacgacgttctacatgctgtgcggcgtgctcggctacgcggcgttcggcaaccgcgcgccggggaacttcctcaccggcttcggcttctacgagcccttctggctcgtcgacgtcggcaacgtctgcatcgtcgtccacctcgtcggcgcctaccaggtcttctgccagcccatctaccagttcgccgaggcctgggcgcgctcgcggtggccggacagcgccttcgtcaacggcgagcgcgtgctccggctgccgctcggcgccggcgacttccccgtcagcgcgctccgcctcgtctggcgcacggcctacgtcgtgctcaccgccgtcgccgccatggcgttccccttcttcaacgacttcctcggcctcatcggcgccgtctccttctggccgctcaccgtctacttccccgtccagatgtacatgtctcaggccaaggtccggcgattctcgccgacgtggacgtggatgaacgtgctcagcctcgcctgcctcgtcgtctccctcctcgccgccgccggctccatccagggcctcatcaaatccgtcgcacattacaagccattcagcgtctcctcatga

SEQ ID NO: 3439 - DNA, 2436 bp, Oryza sativa
  Clone ID: PAT_MRT4530_79494C.1
ttccacatttcctctagaatgtctgtcgtctattaacagcagcccgccatggccacgctgcaaagcgctgtggtgtttgctgatgccgccgacaccgtcgccgccgaccggccgttgtccggcagccagaggctgctggtgtccagccgtggcaagttcgcgctcggtttcttccagccagagaactcaatacattggtacattggcatctggtacaaccaaatctccaagcacacgccggtctgggttgcaaacaggggctctccaatctcgaatccggatacctcacagctaaccatagcaaccgacggcaacatggtattactcgacaattcaagaactgcaatttggtccacgaacatctccaagatcgcctccaactcaactgtcggtgttatcctcgacaccggtaaccttgtcctagcagacgcatcgaacacctccatcatccactggcagagcttcgaccatttcggcaatacctggctccccggcggcaagctcggccggaacaagctcgccggcgtgagcactggtctggtcgcatggaaggcacgcaatgacccagcccccggcgtgttctccctcgagctggacccgaacggcacgagccaatacctgctcgaatggaacagtacacagcagtagtggacaagcggcaactggaccggccgcatcttcaccggcgtgccggagatgacgccgaccggcatctacccgaactcgctgtacaccttcgactacgtcaatggcgagaacgggagctacttcgtgtacgatctcaaggacgactcggtcctcacgaggttcgtcttgggcgagatggggcagatccagttcttgacatggatgaacggcgccaacgactggatgctgttctggtcgcagcccaaagcgcagtgcgacgtgtactcgttgtgtgggccgttcagtgtctgcaccgagaatgcaatggcaccttgtagctgcctccgtggcttcggtgagcaaaacgttggcgaatggttgcagggagatcacacttcagggtgcagaagaaacgtggagctgcagtgcagcagcaatggctcggtggtaggaaggagtactgatcggttctacacgatgggcaatgtaagattaccaagcgatgcagagagtgtggtggccacaagtactgatcagtgtgagcaagcatgcctaagaagttgttcttgcactgcttactcctacaacggcagctgctcactgtggcatggagacctcatcaacctgcaggatgtgtctgccatcggtagccaaggaagcaacgctgttttgattcgcttggctgcttcagaattgtctagccagaagcagaagcatgccaagaagttgatcactattgccattgttgctactattgttgcagcactcatggtagctgccttggttgtcatcttgagaagaagaatggtaaagggaacgacacaagtggaaggttccttgatatcattcacataccgtgacctgaaatctatgacaaaaaatttctctgaaaaactcgggggaggtgcattcggttcagtgttcaaagggtcgttgcctgatgcgaccatggtggccgtgaagaagctcgaaggttttcatcagggcgagaagcagtttcgcgcagaggtgagcacaatcggcaacatccaacacgtcaacctgattcgattgctcgggttttgttcggagaaatcgcgacgactactcgtctacgagtacatgccaaatggttcactggacaagcaactttttgacggcagaaaacatgtcctgagctgggacacgaggtaccagattgctcttggaatcgcaaggggattagactatctccacgagaaatgcagggattgcatcatacactgcgacatcaagccagagaacatactgctggatggctcgtttgctcccaaggtcgccgacttcggcctcgccaagctcatgggccgcgacatcagccgcgtgctgaccacggcgaggggcacggtggggtacatcgagccggagtggctcgccggcacggctgtgacggcgaaggcggacgtgttcagctacggcatgacgctgctcgagatcgtgtcggggaggaggaacgtggagcggagggaggacggcaccgcggacattctcccgttgctggcggcgagcaggctcgtcggcggcgtcggcgacggccgccgggaggagctggtcagcgccgtggtggacggccggctcggcggcgacgccgacatgggcgaggcggagagagcatgcagggtggcgttctggtgcatccaggacgacgagaacgcgaggccggccatggcgacggtggtgcaggtgctcgaagggctcgtggagatcggcgtcccgccgattccgagatcacttcaactccttgccgatgaatcgaattatttgcagttctccgatttattaccgtcgaag

SEQ ID NO: 3440 - DNA, 2152 bp, Oryza sativa
  Clone ID: PAT_MRT4530_80152C.1
atgtctctccagggagggtttgtcaagacccagaagacccatgcctacttcaagcgattccaagtcaagttcaagagacggaggcagggcaagactgactacagggccaggattaggctcaccaaccaagataagaacaagtacaacacaccgaagtaccgcttcgttacaaacaaagatatcacagctcaaattgtctatgctaccattgcgggtgatatcgtgatggctgctgcctactcccatgagctgcctcgttatggtcttgaagttggtctcaccaactatgcggcagcttactgcactggcttgcttctggctcgtcgtgtgctcacgctccgtggtttggaccaggagtacgagggcaatgttgaggccactggggaggactactatgttgaaccagctgatgaaaggaggcctttccgtgctctcttggatgttggcctcattaggacaaccactggaaaccgtgtctttggtgccctcaagggagctttggattgtggtcaacggtcacccgagggtcttcacctgaagcaacacacatccaccgagtgacctggatacccagtgccctactgcagaagactggcctctttggaggagccgctttcctggcccttgatgctgctctcttctggcttgtttgccagatgctagctctcaatgcaaggtctgactatctggatgaggatgacaagggcgattatggccaggtttttgcttctgatgttgatggcacaaaggtctgaggctttgactgggcagggtttcatatttagtgtcacttagctatattatcttatcgacaaagctggttcgattagctctctaaaatctgtagatatgtgctatgccagttccaaagtcgaatatataagggtatttgctcattgcacgtttaagcttacgttgtgaaacaataacagtattttcagtatggtccgtctgttagtaatctccgtggagctaaaggacataaaaataaaaaaacaaaaaaaaagcacgggaggatgcggcacaggggttgttgaccgtgcgtcgctgggagggtttgtcaagacccagaagaccaatgcctaccacaagcgtttccaagtcaagttcaagagacggaggcagggcaagactgactacagggccaggattaggctcaccaaccaagataagaacaagtacaacacaccgaagtaccgcttcgttgtgagatttacaaacaaagatatcacagctcaaattgtctatgctaccattgctggtgatatcgtgatggctgctgcctactcccatgagctgcctcgctatggtcttgaagttggtctcaccaactatgcggcagcttattgcactggcttgcttttggctcgccgtgtgctcaagctccgtggtttggaccaggagtacgagggcaatattgaggccactggggaggactactatgttgaaccagctgatgaaaggcggcctttccgtgctctcttggatgttggcctcattaggacaaccactggaaaccgtgtctttggtgccctcaagggagctttggatggtggtcttgacattcctcacagtgacaagaggtttgctgggttcaagaaggacgagaagcagcttgattctgatattcaccgcaagtacatctacggtgggcacgtggctgactacatgaggtctatggcggaggaggaacctgagaaattccaagcccacttcagtgagtacctcaagaagggaattgatgctgatggcatggaagcactgtacaagaaggtccatgctgccatccgtgctgatccctaccatggccaaatcaaccaagaaggaaccggcgacccacaagagatacaacctcaagaagctaacctacgaacagaggaaggccagtcttgtcgaaagattgaatgctctcaactcctctgctggtgctgatgatgatgacgaggaagaggatgatgagtgaaagagtttagccttatcacagtagttccatctttatgctgccaaacaaactccatatggttaagttcacctgtatagtcttgcaagttgcaacaggcatttttgtttatgttcggaactccgctcaaagaacctatttctttcggtttttggttctcaacctggagtgtgagaagctgccgtttggata

SEQ ID NO: 3441 - DNA, 2829 bp, Oryza sativa
  Clone ID: PAT_MRT4530_80157C.1
ggctttatttggagtgtcacttacctgttttatcttgtcgtcaaagctggtgcgattagctctctaaaatctgtagatatgggctatgccagtggcaaagtcgtatatataagggtattcgctcatcgcacgtttgagggtcagatgtgattccactcgcgtcttatgggtaggtgccttctgttcggtatttcagtgctgtattagtgccaactttcagtctttcatgtgtgccattcgtcgaaaaaaaaaaaaaaaaaaaaaccggccgggaaaccctaaccattccttctcccctaccaggcaaatcgaccaacaccttctcccttctcctcgctcctccccctccgccgccgccgcagcggagcagcaacagcaggcgagcgacatgggagggtttgtcaagacccagaagacccatgcctacttcaagcgtttccaagtcaagttcaagagacggaggcagggcaagactgactacagggccaggattaggctcaccaaccaagataagaacaagtacaacacaccgaagtaccgcttcgttgtgagatttacaaacaaagatatcacagctcaaattgtctatgctaccattgcgggtgatatcgtgatggctgctgcctactcccatgagctgcctcgttatggtcttgaagttggtctcaccaactatgcggcagcttactgcactggcttgcttctggctcgtcgtgtgctcacgctccgtggtttggaccaggagtacgagggcaatgttgaggccactggggaggactactatgttgaaccagctgatgaaaggaggcctttccgtgctctcttggatgttggcctcattaggacaaccactggaaaccgtgtctttggtgccctcaagggagctttggatggtggtcttgacattcctcacagtgacaagaggtttgctgggttcaagaaggacgagaagcagcttgattctgatattcaccgcaagtacatctacggtgggcacgtggctgactacatgaggtctatggctgaggaggaacctgagaaattccaagcccactttagtgagtacctcaagaagggaattgacgctgatggcatggaatcactgtacaagaaggtccatgctgccatccgcgccgatcctaccatggccaaatcgaccaagaaggaaccggctacccacaagagatacaacctcaagaagctgacctacgagcagaggaaggccagtctcgtcgaaagattgaatgctctcaactcctccgctggtgctgatgatgatgacgaggaagaggatgacgagtgagagagtagccttatcacagtagtttcatcttatgctgccaaacaaactccatatggcatttaagtttacctgtagtcttgcaatttgcaacaggcatttttgtttatgttctgcactctgctcaaagaacctatttctttcggtttttgattctcaaccttgagctatcagttatcttatttatgtgagaagctgccgtttggatattgatataattgtgttctgcctgcctcttcaaaaaaaaaaaaaaaacgcggcctgctccggttacttgtgttaaccaccatcttttggcatgccgctgtcttctatccatacaagagcaagtctgttcctcgcggagcattatttcgaagcgccagcttatctgcgttcttcgttattgctgagcttgtctcagctctggcgtttgcaatgttgctctgggcaacggtcaccgagggtcttcaccgaagcaacaacatccaccatgacctggatacccagtgccctactgcgaagactggcctctttggaggagccgctttcctggcccttgatgctgctctcttctggcttgtttgccagatgctagctctcaatgcaaggtctgactatctggatgaggatgacaagggcgattatggccaggtttttgcttctgatgttgatggcacaaaggtctgaggctttgactgggcagggtttcatatttagtgtcacttagctatattatcttatcgacaaagctggttcgattagctctctaaaatctgtagatatgtgctatgccagttgcaaagtcgtatatataagggtatttgctcattgcacgtttaagcttacgttgtgaaacaataacagtattctcagtatggtccgtctgttagtaatctccgtgaagctaagtgtcctactattaatttttctggtgttactctgtgtttttctgtgacgctgattcttgaagtataaatctaccattgtgggaggtatcaccgcaagtacatctacggtgggcacgtggctgactacatgaggtctatggctgaggaggaacctgagaaattccaagcccactttagtgagtacctcaagaagggaattgacgctgatggcatggaatccctgtacaagaaggtccatgctgccatccgcgctgatcctaccatggccaaatcgaccaagaaggaaccggctacccacaagagatacaacctcaagaagctaacctacgagcagaggaaggccagtctcgtcgaaagattgaatgctctcaactcctcagctggtgctgatgatgatgacgaggaagaggatgacgagtgagagagtagccttatcccagtagtttcatcttatgctgccaaacaaactccttatggcatttaagtttacctgtagtcttgcaatttgcaacaggcatttttgtttatgttctgcactctgctcaaagaacctatttctttcggtttttgattctcaaaaaaaaaaaaaaaaaaaaaaaaaaaaaaaaaaacaataaaaaaaaaaaaaaaaaagcggcc

SEQ ID NO: 3442 - DNA, 466 bp, Oryza sativa
  Clone ID: PAT_MRT4530_80270C.1
cacccagtaaatttttttttcccccatttttttttggggggaaaatttctttttacttgcgggggggcaactaggaaaaacccccccccaactaaagagggtaaaccggaccaaagggggtggtaaatctacaaattttacagggtagtcggaccacatcaccctgggtcactcactagggttcatccggacagaacaacccatttttcccgaacctttatcaaaaggtcctcctggtttttaggccttggggaggccccatctgatgttcggaaaaatataggccctatcaacacctaattagcagcagccaaactttacaaaccaaaagctggccttctctctttgggtgaacattttacaggtattctcctaatcaaccatcccattttcattttttggccctgttaatcttcctccatggttctgctcggtgggtgacccaggggaaaagggcacaaacccg

SEQ ID NO: 3443 - DNA, 1982 bp, Oryza sativa
  Clone ID: PAT_MRT4530_804C.1
tggctttgctccctgttttttttttttttttttttttttttttgaacacatgaacagattggaatggattcattttaattcgtctttgccgagacatcaaagacgaaacagcaaagcaccggagaagaagagagtgggcccccccatccatcgacaagcagagagcaggacaggctggcatttgtcctcgcctttcgtctctcccaaagcccacagagcctggcactgggccccacccccacatcacacactctcgcgcttaattaccatttaccaccactaatcactccttgatctggctaattaagttaagccatcgctgctaatgacttagcacttgttggtggtgaagccgacggtggacttggccgtgtcgaagctgacgcgggtcccctgctgctgcacgttcccgatgatggacaccgccgcgttcgtcggcgcgaacgccaggcagtacgtccccgcgccgtccaccgggatcaggtagttcttcgccggcagccggagctcgccgccgccggcgaaccgcagcgacaccgcggggacctccacgctcgtccggtccgacaggtcgtagcacgtgtcgaacagcgacacgccggaggtgcgcggcagcgactgggtgccccggacgaacgcgtcgcgcagcgccgcgtacgccgacgactgcagccgcgtcaccgccgtgccggagtccacgatgacgccgccggcgcccgtgctgtccatggcgaacgccgagggtgggatggagaggatctggccaccgacggagaggcccgagaggcccacgtagtagaacgtgctcgtccgcgggctgcggatcagcggcgccgtcacctccgcgtcggcggcgtcgccgaactggagggttgacgaggagggggagtcacggtcgacgaggcagtaggagaaggtggtggcggagatctgggacgggaaggagagtggcccgccgccgagggcaagcagccccgccgcgccgacgaacagcccctcgttgtcgtggccgcagcctatggcgacgctggagaccggggcggagtcgccgagcgtgagcgtctcggtggcgaagtcgccgacggtgtaggagccgtcgccgtacgcgacctcgtagaggcaggcgccggtggagttgcggcaggcggcggcgtcgaggtcgtggcagcgcgggttgtcgcaggcgacggaggcgtaggaggtggagagggaagggtcgaacaccgggtcggactgctggtagcagtcggcgcacggctggcattgcacccaggtgacgtcgctgccggtgtcgagcaccatgtacagctgccgcgcggggctgccgacgccgacgcgggagaagtactcgccgctgccgagcccaaccccggacaccacggggccctgtatctccgccgccgacgcctcgaacgccgtgacgttggccggcaccaggtcgaaccgactcaccccgtccgccgccatcgccgcgcgggccgacaccgcggcggcgcgggcggagtcgcggcggaggcgagccagcacgagtgacctgtagctggcgtgccgctgccgcccctgctcctccggcaagaagtcccgggagtggagccgcagggccaggcgcccctcctcgtgctcctccccgacgacctccgtggacacggcggcggcggcggactggtggagcggcacggcctccgcggataccgcggcccgcgcccgggacagcgacgcggcgacgtcgagcgtctcggtggcgagcggcggcgaggcgtggcggcgggagagaaccggccgtggcgaggcggcggcgaggaggaggaggaggaggagaagcgggaggaggatgggaggctgcattgctgctgatgctgccgtgcagctggatggagtgaggagagtgaaggggaatttaaggggagaggagacgaagttgcagtggtcagtcaaggtgaatgaaggaatggaatggatcacgtcattcttcttctttcttc

SEQ ID NO: 3444 - DNA, 3123 bp, Oryza sativa
  Clone ID: PAT_MRT4530_81538C.1
atggtgagcggcaacctcttccactgccggaggaactcgtggccggccgaggagtacgtcggccgaaccgccctgcagttgttggacttcgacggcgggtcgcctccggagcaggcatggcggcggcgtctgaacagccacgccaacttactcaaggaattcagcgtcaccttcatggaagcaatgaggatgatgagccttggcctgaggctatggtcgtatgtccgagaggaggcttctcatggaaggaaagctccaattgatccgtttaccaaagagaaatgtaagccgtctgcttcgcagggcgtaccgcttggtgggatggggagtggtagcatttcaagaggtttcaggggagagttcaagaattggcatatcattcctggtttatgtgagacttccccgatatttgtatctcgcgatggggggaacaaaaagtactcatcggtattgtctcccggacaccatgaaggtttaaagaaatgtaatgactctggaatttcttcatgggactggaacttgagcggtcaacattctacctatcatgctttatttcctagggcatggactgtttatgatggtgaaccggatccagaccttaaaatctcatgtcgtcagatatcaccattcattcctcatgattacaaagatagcagcctcccaacttctgtctttgtgtacactctagtgaacactgggaaagaccgtgcgaaagtgagcctgttaatgacatgggcgaattctatcggaggtttttctcatcactctggaggccattttaatgagcccttcataacagcaaaggataatcctccggttacttttgctattgctgcctgtgaaactcagaatgtgaatgtgacagtcttgcctgtatttggcctctctggagaaggccatgattcagccaagcaaatgtgggatagaatgaaacagaacggccactttgaccgtgaaaatttcgaagctggtaccagtatgccttcatcttcaggggagacactttgtgcagctgtctcagcatcaacctgggtagagccacatggtagatgtactgttgtatttggtttggcttggtcctctcctaaaataaagtttcagaagggctgcacatacaacaggaggtacactgaattttatggaacttctgaaagatcagctgttaatttggtacacgatgccttgacaaaatataggatttgggaagaggagattgagaagtggcaaaaccccatactcaagaatgaaaaacttccagaatggtacaagttcacactttttaatgagctttactttctggtagctgggggtactgtttggacagatggccaaccaccagttatcgatgaaaaaccaagtcctggttctaatcaacagaaatcttcaaaaaggggcactagagacactaaacaggaatcagttaaagataaccatgtcaaactgacagcagagcaagtcactaatggtggtgacctggctaatggcgaagagcaaagtgtgtcaaagtatgcagcagtacatggaccacaaatggctaaggcaaccaacggacttgggtcacaagagccaattccatacttgctttccaagaatggccctgaaaatgttggcaaatttttgtacctggaaggagtggaatacatcatgtggtgcacctatgatgtgcatttctatgcttcttttgctctgcttgatctgtttcccaaaatagagttgagtatccaacgtgattttgccaatgctgttctctatgaagacagacgaagaatgaaatttttggctgatggtacttctggaattcgcaaggtcaaaggtgccgttccgcatgacctaggaacacatgatccatggcatgaaatgaatgcgtacaacatacatgatacaagcaaatggaaagatctaaatccaaagtttgtgctccaggtatacagagacttcgctgctacaggtgatatgtcatttggtagagatgtttggcctgccgtctgtgcagtgatggactatatgaatcaatttgaccgtgacggtgatggtctcattgagaatgatgggtttcctgatcaaacctatgatgcttggactgtacacggaattagtgcttactgtggcggtctctggcttgctgcacttcaggctgcagctacaatggctcatcggcttggtgatcggccatttgctgaaaaatacaagctcaaattcatacaagcgaaagcagtatatgaggctaagttatggaatgggtcttacttcaattatgacagtggcacaagcagtaatagccgatctattcaggcggatcagctggcagggcagtggtatgctgcttcttcaggcttgcccccgcttttcgatgagaataaaataagaagtgctctgcagaaaatatttgaattcaatgtaatgaaggttaaaggaggacgattgggagctgtaaatggtatgactcctaatgggaaagtggatgagacatgcatgcaatctcgggaaatctggaccggtgttacatacggtgttgctgcaaacatgctgctccatggaatggagcatcaaggattcaccactgccgaaggaatttttattgctggttggtcagaagaaggatatgggtattggttccaaacaccggaaggctggaccatagacgggcactacaggtcgctcatctacatgcggcctctcgccatttgggcaatgcaatgggcacgttctccacccaaggcaatccttgatgcccccaaggtaaacctgatggacaggatacacctatccccacaaatgatccgggcaatgaacgagattaatgttagaaagatagcacccgacaatagatgtttccctagctctgcatttcgttgtgaatgctgaccacaaaaaaaaaagagaagcaaaatgcaacaactgagtagtaacatacatatatatactttccttttcggcttttccttggccccttacaagtttcagtggggttcatggggttttccttgaaatcagagggcatataaatctacggaaccactaagctcagtagctcacactctcacagctcgaaaagagctcttgttgtataattgtacagtaaactacaaaatcatatcgtcagcatcatctttgctctgcgtc

SEQ ID NO: 3445 - DNA, 1349 bp, Oryza sativa
  Clone ID: PAT_MRT4530_81540C.1
aatataggatttgggaagaggagattgagaagtggcaaaaccccatactcaagaatgaaaaacttccagaatggtacaagttcacactttttaatgagctttactttctggtagctgggggtactgtttggacagatggccaaccaccagttatcgatgaaaaaccaagtcctggttctaatcaacagaaatcttcaaaaaggggcactagagacactaaacaggaatcagttaaagataaccatgtcaaactgacagcagagcaagtcactaatggtggtgacctggctaatggcgaagagcaaagtgtgtcaaagtatgcagcagtacatggaccacaaatggctaaggcaaccaacggacttgggtcacaagagccaattccatacttgctttccaagaatggccctgaaaatgttggcaaatttttgtacctggaaggagtggaatacatcatgtggtgcacctatgatgtgcatttctatgcttcttttgctctgcttgatctgtttcccaaaatagagttgagtatccaacgtgattttgccaatgctgttctctatgaagacagacgaagaatgaaatttttggctgatggtacttctggaattcgcaaggctgcagctacaatggctcatcggcttggtgatcggccatttgctgaaaaatacaagctcaaattcatacaagcgaaagcagtatatgaggctaagttatggaatgggtcttacttcaattatgacagtggcacaagcagtaatagccgatctattcaggcggatcagctggcagggcagtggtatgctgcttcttcaggcttgcccccgcttttcgatgagaataaaataagaagtgctctgcagaaaatatttgaattcaatgtaatgaaggttaaaggaggacgattgggagctgtaaatggtatgactcctaatgggaaagtggatgagacatgcatgcaatctcgggaaatctggaccggtgttacatacggtgttgctgcaaacatgctgctccatggaatggagcatcaaggattcaccactgccgaaggaatttttattgctggttggtcagaagaaggatatgggtattggttccaaacaccggaaggctggaccatagacgggcactacaggtcgctcatctacatgcggcctctcgccatttgggcaatgcaatgggcacgttctccacccaaggcaatccttgatgcccccaaggtaaacctgatggacaggatacacctatccccacaaatgatccgggcaatgaacgagattaatgttagaaagatagcacccgacaatagatgtttccctagctctgcatttcgttgtgaatgctga

SEQ ID NO: 3446 - DNA, 297 bp, Oryza sativa
  Clone ID: PAT_MRT4530_81543C.1
atgagccttggcctgaggctatggtcgtatgtccgagaggaggcttctcatggaaggaaagctccaattgatccgtttaccaaagagaaatgtaagccgtctgcttcgcagggcgtaccgcttggtgggatggggagtggtagcatttcaagaggtttcaggggagagttcaagaattggcatatcattcctggtttatgtgagacttccccggtcatggagaaccagttttcagtaatgctttcttcttctttctgctgttgctggttaatcaacttggtttatggtgatgcataa

SEQ ID NO: 3447 - DNA, 1992 bp, Oryza sativa
  Clone ID: PAT_MRT4530_81921C.1
gcacgaggccaaacctgaaacgccatccacccccccgcgccaggctcccccttctccctcctctccgcctcctcccatccacatccgcggccgcgccgatcgcacagctttgtgcggtcggggtggtctcggtgccgatggcgaggaagcagcatatcgccatattcaccacggcgagcctgccatggatgactggaactgccgtcaaccccctcttccgagcggcctacctcgcgaaggccggggactgggaggttacgctggtggttccatggctttcgaagggggaccagctgctggtttatcctaacaagatgaaattcagtgtgcccggggagcaagaaggctatgtgcgacggtggctcgaggagcgaattgggctgctgccgaagtttgagataaaattctatcctggaaagttctcaacggagaaaagaagcattctacctgctggggacatcacccagactgtatctgatgataaagcagacattgcagttcttgaagagccagagcatcttacatggtaccatcatggacgaaggtggaaaaacaaattcagaaaagttataggtgttgttcataccaactatttggagtatgtcaagagagagagaaatggatatatccatgcatttctcttaaaacatatcaattcctgggtcactgacatctactgccataaggttataagattatcagcagcaactcaggaagtcccaaggtcaatagtttgcaatgtccatggagtaaatccaaaatttattgaaattggtaaactgaagcatcagcagatatctcaaagagaacaagcattcttcaagggtgcatattatattggaaagatggtctggagtaaaggttatacagaactactccagctgcttcagaagcaccagaaggaattatctggtcttaagatggagctgtatggcagtggagaagattctgatgaggttaaagcatcagccgagaaactaaatcttgatgttcgagtctatcctggtcgtgaccatggagattccatatttcatgactacaaggttttcataaacccaagcaccacagatgtggtatgcacgacaactgcagaagctttggcgatggggaaaattgtgatatgtgcaaaccatccttcgaatgaattcttcaaaaggtttcctaactgccacatgtacaatactgagaaagagtttgtgagattgactatgaaagcattggctgaagagccaatcccactgtcagaggaactgagacatgagctttcctgggaggcagcaacagagagatttgtcagggttgctgatattgcaccaatcatgtctatcaagcagcattctccctctccccagtatttcatgtatatatctccagatgaactgaagaagaacatggaggaggcgtcggcattttttcataatgcgatttctgggtttgaaacggcccgttgtgtttttggtgccataccgaatactctgcagcctgatgaacagcaatgcaaggaacttggctggaggctccaggaatgacagtcatttcttcccacgctgttgtcaatgacaatagaatgccaactaacagcccagggaacttggcttggggaactaactacgtaacgcaattatcttttgctccaaaactacgaaggactgaacagacaagggtgattcttgttttctgctatggtggtacactggtattgcaattctccttcacaattgtggagtgtccatcagacatcagttactgtaatgcatcatatcttggaattgtaaatgtgcggcagttgaagtgattaccaatgctgtcttttcatgtagcctgtgtaatgtaaagcttactgttgcttcccgagtttggcacaattttaaagatatcttgtctggtgtttcacaaccaaaaaaaaaaaaaaaaaaaaaaaaaaaaaaaaaaaaaacctgatcattgtatccgtgtgaagggggcgtaacacatacatgacaacatcataaa

SEQ ID NO: 3448 - DNA, 1464 bp, Oryza sativa
  Clone ID: PAT_MRT4530_82365C.1
tcacattgcatgatcctcgaggttcagtaaccaaccatatggccttgcttctggtttcatgattgaatcgtcaggatttttggagtttgtcaagatctcacctagaggtccaccttgaggcatctcccaagaacttgagatgctatcctcttgcatttgtgccatattaggtgcatggcagctgacgcgtgggtcctctggcgaggaatagaaagttgatggaactgtcatgacattggaatctttgcttttctgaaactccattttctcgtccttaggcaagctgaaattctgaaggactgactgaaggcatccacgatcatgcatcttggtgaaaggaatgcttttgttgttctgctggttgctgctctcccaaggcttcaacatggtatttgaagaaatcgattcactgtctcctgctgtattgaacttctccggtttgttctgttgcttcaactgagagaacagggacaatgttggctgttgattcgttaaatttagcagtgggccattgttttcttcagcagctttgtttcctttctctttgttcgccattgtcctgttcaaactatctgtccaatagctgatactgcgtggcttcatttcattaacttttgccttcttgaagctgccctgcccgacagaagatggcaatgagccagcacacggtgtctctttcacagtctttctactttggttttccacaggctttcttgaacggtggcggtttctgttgatgtgcctctcacaatacttgtggtcggccatggcctcctttgaacaccgccatttcttgccatctgttcgacggcatcttccaggttctgggtcagagtctgcatttgggaagccttgatagagaggcctccagctcattctgttagctgatgatctgaagcttttgctgattgaaatgagcaggctggaaggtataggggcctttgcattgagatacttgtaaatgagagcctggtgctccagctccatccactgtgagggagtgaaaggcctcttggtcctagacaacaagaacctctgctcattttccctcccaaaatccaaacctgatggcaatgtgtgagcagccttggcgaatctgagcatcttctgttcatcaagaaagggggaagggtatgatgcagcagcagcctgggtgaagctaccagcagcagctctcttgatgaggctcagatcaccctccttggtggatggcactgtgagtccttgcaagcccaacacctctccaagctccatggcagcagcagagaagtcagcaaacatcttggaaggacaggaggaggggagaggaggaagaagaagaagaagaggagggggtgagcattgctggggacagtcacagtgaggctgaggttgagagtgaggcagggtgtagtgtgtgctttctagtaggaggcaggaagtgtgtggtgatatattatgggatcctcgtgccgaattcctgca

SEQ ID NO: 3449 - DNA, 2259 bp, Oryza sativa
  Clone ID: PAT_MRT4530_82807C.1
tggatccccgggctgaggacgccccgcgggcctttctccacctcggtggtcataagctaagacagctatcgcgcgccgtcccaccaccagcttgctccactacgcggaccaccgcgcgcgagcagagcatctcctcactctctagcttgctccagtttcgcgtagctgcgtgacagttcaattgaactctctggattcgttggttacttcgtctgagctgctgcagcgttgaggaggaggaggagcaatggcgctcacgacgttctccatttcgagaggaggcttcgtcggcgcgctgccgcaggaggggcatttcgctccggcggcggcggagctcagtctccacaagctccagagcaggccacacaaggctaggcggaggtcgtcgtcgagcatctcggcgtcgctgtccacggagagggaggcggcggagtaccactcgcagcggccaccgacgccgctgctggacacggtcaactaccccatccacatgaagaacctgtccctcaaggagctccagcagctcgccgacgagctccgctccgacgtcatcttccacgtctccaagaccgggggacatctcgggtccagcctcggcgtcgtcgagctcaccgtcgcgctccactacgtgttcaacacgcctcaggacaagatcctctgggacgtcggccaccagtcgtaccctcacaagattctgaccgggcggcgcgacaagatgccgacgatgcgtcagaccaacggctttgtcgggattcaccaagcggtcggagagcgagtacgactccttcggcaccggccacagctccaccaccatctccgccgccctcgggatggcggtggggagggatctcaagggagggaagaacaacgtggtggcggtgatcggcgacggcgccatgacggccgggcaggcgtacgaggcgatgaataacgcggggtatctcgactccgatatgatcgtgattctcaacgacaacaagcaggtgtcgctgccgacggcgacgctcgacgggccggcgccgccggtgggcgcgctcagcagcgccctcagcaagctgcagtccagccgcccactcagggagctcagggaggtggcaaagggcgtgacgaagcaaatcggagggtcggtgcacgagctggcggcgaaggtggacgagtacgcccgcggcatgatcagcggctccggctcgacgctcttcgaggagctcggcctctactacatcggccccgtcgacggccacaacatcgacgacctcatcaccatcctccgcgaggtcaagagcaccaagaccacaggcccggtgctcatccacgtcgtcaccgagaaaggccgcggctacccctacgccgagcgcgccgccgacaagtaccacggcgtggcgaagttcgatccggcgacggggaagcagttcaagtcgccggcgaagacgctgtcgtacacgaactacttcgcggaggcgctcatcgccgaggcggagcaggacaacagggtcgtggccatccacgcggccatggggggaggcacggggctcaactacttcctccgccgcttcccgaaccggtgcttcgacgtcgggatcgccgagcagcacgccgtcacgttcgccgccggcctcgcctgcgagggcctcaagccgttctgcgccatctactcctccttcctgcagagaggctacgaccaggtggtgcacgacgtggacctccagaagctgccggtgaggttcgccatggacagggccgggctcgtgggcgccgacgggccgacgcactgcggcgcgttcgacgtcacctacatggcgtgcctgccgaacatggtcgtcatggccccgtccgacgaggcggagctctgccacatggtcgccaccgccgcggccatcgacgaccgcccctcctgcttccgctacccaagaggcaacggcatcggcgtcccgctaccacccaactacaaaggcgttcccctcgaggtaggcaaagggagggtactgctggagggcgagagggtggcgctgcttgggtacggttcggcggtgcagtactgcctcgccgcagcgtcgctggtggagcggcacggcctcaaggtgaccgtcgccgacgcgaggttctgcaagccgctggaccaaacgctcatcaggaggctggccagctcccacgaggtgctcctcaccgtcgaggaaggctccatcggcgggttcggctcccacgtcgcgcagttcatggccctcgacggcctcctcgacggcaaactcaagtggcggccgc

SEQ ID NO: 3450 - DNA, 2905 bp, Oryza sativa
  UNSURE (1)..(2905): unsure at all n locations
  Clone ID: PAT_MRT4530_83072C.1
  unsure (1)..(2905): unsure at all n locations
cacccaagggaagagccaagagccacatcttcattgcagcataggtaagccnacccgggacaaaggggaagacatgatcngcgggcctcccagcaggaataacaggggaggggacaaccacggcagcagccaacacattatctgagagcaacgcatagtgatagagcgggggatcggccaaccccgcgacaggggggaacccgcgaccgccggagcgggataangagcacgcagcggcaagccgcagcggaaggcaangaagcacccaggaaacgggggggggtttttttttttttttttcttttgaaagatgacgattataacatttaacattataaaaaaatttagagcacttcacacatacaaatacaatgcaagatattagactgccaaatttcaaaatccagaagcattgtttaatttattcattattgaattaaatataatattccagtttaaaagatagtaagaattgatcgcaactgattgtcgcaaaaaaggggataatatattcagttccaaatgactaaaactgatcccaaattatggttactacatagtcaaaagaaagaaggctgcggaagacggatcgatgatggccatgactgtacttgaaacaggacatataccaccataccggcctgaaaacacacgcagaaccttaaacgagtacctcattttcaaataagtcaggcaacctaaactgactttaagctctccaattacatccataaacagccggccgagaagtactttcatttgcaagaagatccaactattggcataacaatgtcctcaagcaacggtatcaaaaaccaaagaaaccaagctcagttgccctctctttctcgaatgtctcgaagtactggtagatgatagtaacagcaagcagaataccagttcctgaaccaatagcacccatgaaatcagctagaacagtcaatgcaccaatgcacactccaccaaatgcagcggcagtggggatgtatctgttcaattccttctgcaagtttgactcacgatggccaggcatcaccatttgctgttccttcagctgtttagcaacatcctttgcagatgagccagatacttcaatccatgtctttgagaagagagcacaagctgacagcatgaagaccacatagaacaacgcatggaacggatttgcaagaacatcagccaaacttgatggagcagttacatagtaagcgagaccaccaacaggaacagaatggccagagtactcagattccttccatttcccaagaaggttaaccagaaaatttccactgtacctcctgtagagaagctgtgatatgaagtagaggttggtaatcagtgcagaatgcagaatgatgggcatgtttgaagtgtagaacagcttaattgggtatgagccttgttgaccgctggcattcttggatctcactggtagcacaacacggaagccttggaagtagataactatgaggaagactaaaacagtagcaagcaagttggtcacattcggaagattctggcggtagaaagcttcgcgcaaggcacggactttgtcggttctagtaatcaacaaatggaacaatgcaatgacagctccttcaaattcagcaccacgcccactgttgatggttgtggggctaaacgccttccagatgatatatgccagcaaagaaaagctgaagtataatgaggatgagatattggtagcaatgaagagagaaatgccagaaccctaaccataacctttctggagaagttcatcaaggcagataacaatgatgccagcaaagaaaagctgtaggatgatgagaatggcatttccagttccaagttggcttacactaccatacattccagacagcacatatgccacagcttccccaatagcaatcaagatgcccagcagcttttgtgcgccattcagaagtgcacggtcctctctcacactgttgtcaacttcaataatctttgatcccactagaagttgcattaccattccagatgtcacaattggggtaatacccagctccataacagtaccacggtttgatgcaagaataacacgcatccagtagaaaggatctgctccagtagttgagtgaattccatagagtggtagctgactgcacaccaggaaaatgaagagagagataacggtatagatcactttttctctgaatggtattttcctatcagcactctgtacttctggcaggaaagccagaaagggcctgacaagatgcagtactcgaaaaccaccagccatctttctggccggcgccgccgccgaggcgagtggaagcttctcgccgccgccgccgggatcggagggcgcgaaaccctaggaagcgagagagagagatgaggggggcaagagcacgagacgggaggaggggggatcctggaggccatggcccatcaattgaactgttgttccttccttgctggacctcattatggcccatctcgaataacgtcgagagaggtagcgttgggcagcagcagtagcagaagtccacttgacatccctcgtatttacgtcgagtttaatgggcattcctgtcagataaggggtccggaccagggtgacagagcctgtctccacagaaatgtgcgagaacccatgatctactgcagctcgcaacgcatgcaaacaagcaacagcctcggcacttagagcatccatcgactccaaccttgcagagctgaagaaaccatagcgtccaacgttctcggtggcgacctcctcggagacggaagaggaccgctccagggttttaccgcactttccaagtccgctcctctctttcgtctcgcccggtggcggcggcacgccgtcgtcgtcaacgtcgtcggggatgaacctgtaccaccccgaggaaatctccgagtagaacgcctccat

SEQ ID NO: 3451 - DNA, 2091 bp, Oryza sativa
  Clone ID: PAT_MRT4530_83074C.1
gagacataacaccagattagtttccagtgatcagaaacattagtcacgaaggttgcagcaaaaaagagatcaggaatcaaatatactatccagtttaaaagataataaaaattgatcgcaacacatccagttactacgatggccattgctgtactcggggcaggagcaggacaaataactccatacactggcatgaacaaaacgcatactgctacaagattctcattgtaagtaagtcggcaacctaagctgattctgaggtctcccattacatgacagccggccaagcagcactgcgactcgcaagaagttccagctaggagttatacagctaaggtgatcaaaacccaaagaaacctagctcggtagccctttctttctcgaatgtctcaaaatactggtagatgattgtaacagcgagcagtatcccagttcctgaaccaattgcacccatgaaatcagctaggacagtcaatgcaccaatgcagactccaccaaatgcagcagctgtagggatgtatctgttcaattctttctgtaaattcgactcacgatggccaggcatcaccatttgttgttccttgagctgtttagcaacatcctttgctgatgagccagatacttcaatccatgtctttgagaagagagcacaagctgacagcatgaagaccacatagaacaacgcatggaacggatttgcaagaacatcagccaaacttgatggagcagttacatagtaagcgagaccaccaacaggaaccgaatggccagagtactcagattccttccatttcccaagaaggttaaccagaaaatttccactgtacctcctgtagagaagctgtgatatgaagtagaggttggtaatcagtgcagagtgcagaatgatgggcatgtttgaagtgtagaacaacttaattggatatgagccttgctgccccctagcattctttgatctcactggaagcacaacacggaagccttggaagtagatgactatgaggaagaccaatacagttgcaagtaaatttgtcacattcggaaggttctgacggtagaaagcttcacgcaaggcacggactttgtcagttctagtaatcaacaaatggaacaatgcaatgacagctccttcaaattcagcaccacgcccactgttgatggttgtggggctaaacgccttccagatgatattctcactgtgcaacagcaagttcaccaataataagcagatattggtagcaatgaacagagaaatgccagaacccaaaccatagcctttctggagaagttcatcaaggcagataacaatgatgccagcaaagaaaagttgtaggatgatgagaatggcattgccagttccaagttggctcacactaccatacattccagacagcacatatgccacagcttccccaatagcaatcaagatacccagcagcttttgtgcgccattcagaagtgcacggtcctctctcacactgttgtcaacttcaataatctttgatcccactagaagttgcattaccattccagatgtcacaattggggtaatacccagctccataacagtgccacggtttgatgcaagaataacacgcatccagtagaaaggatctgctccagtagttgaatgaattccatagagtgggagctgactgcacaccaggaaaatgaagagagagataacggtatagatcactttttctctgaatggtattttcctatcagcactctgtacttctggcaggaaagccagaaagggcctgacaagatgcagtactcgaaaaccaccagccatctctctggccggcgccgcctccgaggcgagtggaagcttctcgccgccgccgccgcgggatcggagagcgtgaaaccctaggcgaggagagagatggtggggcaagagcacgaaagggtttttttttttttttttttttttttttttttttttttttttccggccgccgcctccaccatcaacaacatcaccacccaccacgacgacgacgacgccattatcaacgaggagataactgccgacgcgaggaggagaagatatggagatgaagatggaatggaattggaggggga

SEQ ID NO: 3452 - DNA, 4285 bp, Oryza sativa
  Clone ID: PAT_MRT4530_83242C.1
gcatcaaatcagcttgtgtaaccttggataagcaatacccatgaattgaataccactgcaaaattgcactcttgcagtatatactgcatgagttaaggtacatcctatgttacaaatgtacagccgtgagttcaatacgtaatcaaaattcatcagagttaaaaaaaaaatgtttctgtagttctgttgccgatatatactattttgttgctataaactatggctgtgtttggagctgccgttcttgtagctttggcagtgacttgtggcctcatctggtcgaggtcaagaaggctatcaaaggagatgagagacatccccggaacaatgggctggcctgtcgtcggcgagaccttctccttcatctccggcttctcgagccctgctggcattctgagcttcatgcgtgacagacagaagaggttcggcaaggtgttcaagacgtatgttcttgggaggatgacggtgttcatgacggggagggaggcggccaagatcctgctgtccgggaaggacggcgtggtgagcctgaacctgttctacaccggcaagcaggtgctcgggccgaccagcctcctcaccaccaacggcgacgagcacaagaagctgcgccgcctcatcggcgagccgctctccattgacgcgctcaagaagcacttcgacttcatcaacgacctcgccgtccagacgctcgacacctggctcgacaggagagtgcttgtgctcgaggaggcctcatctgtaattattaagctcttcacgctcaaggtgatcgccaacatgctgataagcttggagccagagggagaggagcaggagaagtttcgcgccaatttcaagatcatatcgtcttcgttcgcgtcgctgcctctcaagatcccaggaactgcatttcaccgtggcctcaagaaggccaggaaccggatgtacgcgatgctggactcggtgatcgccaggaggagggacggcggcgaggtccgcaacgacttcctccagacgctgctgcggaagcacgccaaggacggcaccgccgccgacgaggacgacggcggcggcggcggcgatcgagacgcggacaagctgacggacgcgcagctcaaggacaacatcctgacgctgctcgtcgccggccacgacacgacgacggcggggctgacgtggctcatcaagttcctcggcgagaacccggaggccctgcagaaactcagagtgatgaacgagacactgaggagagcgaccatcctgccatggttctcacgaaaagccgctcaggacttcagcattgatgggtacgagatcaagaaggggacgtcggtgaacctggacgtggtgtccatccaccatgacccgtccgtcttcgccgacccctacaagttcgatccaaacagattcgatgggacgttgaagccgtacagcttcctgggattcggcagcgggccgcggatgtgccccgggatgagcctggcgcgcctcgagatctgcgtcttcatccaccacctcgtctgcagatacagtactccagcaggcagccaagaaataaagcagcaggagctactccgtggcaaagtgacgaggaacagctacttcagtggcaaatgtgacaaagaacagcaaccacgtagcatcgctcagatattcaggtcgcttaaacatgatcacagcagggcagtaacaaggaatggcacaatccaagaagcaacacaacagcagcaactccggaagggccagggtcaatggaacaataaccaggtagcaaagccaatcagagtaacaaagaaacactatgcaaggcagcagtggccttcccacgctaaaccgcacatgatagattgatgccaacgaacaagccggtcataagactagaacaaatcgctgttaagacagtagtaaccaatccagaacaagagaacaaagaactcaaacaaacctgccaaaacaaaacaaacatttgagaacacctggtttacaatgagttgattaagaagagttaaagattacatggcaatttcccgtaaggttcagtagaatgcttcctctcccaagagaacagaaacaaaacaatttaccggtccaatcccacatatcccgtttccaaaggtgctatgccgcatgagcacaaccaacgtaacagagcatcaacaagtaatgtgacaaaaaccacctctcaagtctcaaccaagaaaagaatcacccaacagcatatcatgcatatatgtaggaccaagcgccaagcactatgaacaagtcatatgcctggcaacaagcaggaaacaataataagaatgtcagtaatacagtcgataataaagtagatgctttctcatggtacaccatagttctcaaactacatgaacacaaagttccagacacaaggaaacacagctcacaatagtagatagacttccatacctggatggaacatacttcttagagatttgataggccatcaatagggaccagaccggtcacgactgtaacggtcacccccacctccaccgtagccaccaccatctcgactacgaccagaataacggtcaccaccacggtcagatccataacggccgccaccgccaccaccaccaccgtacctatcatctcggccaccatatctatcacctctaccaccaccatctccagatgggcactctctagcaaagtggccaggttttccacacttgtagcaatccccaccaccacctgagccacgtggtgcacgcccaccaccaccaaagtcacggccacggtcataacgagatccacggtcacgatcataatcacggtctccattacggtctctaccaggtccttgtggctgagctttatcgacagtgatcgcccgcccatccaaatccaatccattcattccttcaatagcatcttccatggctttcttctcatcaaaggtcacaaagccaaaaccacgagaacggccagaatacttgtcaaaaaccacctttgcttcagtgaggttgccaaatttgccaaaggcatccttgaggctttcatcagttgtggaccatgacagattcccaatgaagcaacggtactcctccacgtccgccatctctgcgaggaagacgaaggcggcggcgaatcggatgctcttgccctcggtttggttcggaggtctagtattttttttttttttttttttttttttttattaaaccagcaaatctaatctagtacaatttcctggatataattcaggaaaaagacacatatagtccatggtggtacaggaagttacatatagtgatgtgacacgaaatttagcataaaactaacagttgctttccaaaatattacatgtaattactctttgtctaaacatagattttttaaaaaaatcatttggtatcagccttctgatttcactgaatgtttgcctcttcactcctttgacaaattccaggtgccaaatgcatgggtaaaaagaatcatagactgacactgtaggagactttggtgaggcctttcttgactcttatgtttgtgacctttatgttgttgatgatagagatatcggcaacatgtgtaccaccacaagggccaccaggataatcaccaaatttcacaatgcgaggggtgctatcttttgaaatgtagctaggcagagcacctccacacaattgagctgcctcctcataaggtaaaatataagctaatacttttgctcctttagtaattaactcatttgcttctttttccaactcgtttttcttatcctgcaactgatctggtggaatgactcctttatactcaacgaaaggtccatcagggaaatgatgtcctttcccagggtcgaaatgtgataagccaatattgctcatgcagatgtctatcaaatgccctgcagaatgaagcctggaatttaagttgcggcgttccgcatcgacttccaagctaacgctctgcccttcactgaacccggaattgcatccatctccagcatcctcaaatctcccatagtggaaaaccactccatccttcatccgcacatcatcgacgatgaacctggtgccgccgccagcggagatgacgccggtgtcggccggctggccgccgccctgcgggtagaagacggtggagtccaccaacaccgctcgccggcccccctcctcctggaggagggagacgacggtggcggtggagctgagggcccacatgtcatcgaagtacgcgagcttggtggggcccatggccctcgccggagctgcggcctccgttcccatctccgcgggggtggagatcaccgcacggttgggcaagaattagaagcgcc

SEQ ID NO: 3453 - DNA, 1731 bp, Oryza sativa
  Clone ID: PAT_MRT4530_8325C.1
atggaggtacccattgctgccatgacttttgcccacccagccaatgttatgactctggcttcaaggcagccaaagagtaaaaggtcccatatctcccctgctaccacggctcaccgtaatctacagactcgcctggctcaccaccaccatgcaacaccagcttcattgcctatggcaatctgcaacacagtagacaaagtgatcaataggttcattgacctgccggagcagcgaccaacggtggatccgcggcgtgtgctctctggcaacttcgctcctgttgatgagctgcccccgacaagctgccatgtcatccgcggctccatcccaagctgcctcgccggtggggtctacatccgcaatggtcccaacccacagcaccggcttccccagcgaacacaccacctcttcgatggtgatggcatgctccactcccttctcattccctcggcctcgtcaacactgttgtcggagcctgtgctttgttcacgctatgtgcacacgtacaagtatctcttggagcgtgagaccggaggaccggttttaccaaacttcttcgctggcttccatggagtggccggcttggctcgtgcagtggtcatgatcgcaagagtgcttgctggtcaaattaacctgaacaagggcttcgggctggccaacactagcatcactctttttgcagattgcctatatgcgctatgcgaatctgaccttccctactccatgcacatcaacccagccaacggagaagtcaccacacttggtcgatgtgactttggtggtgatctttcttttaggatgacagcacaccccaagaaggacccggtcaccatggagttgtttgcttttcgctacaatgtcttccaaccattcataacatacttctggttcgatcgagcaggcagcaaggtcgcagatgtgcccatcttgtccttgcagaaaccatcggtgatgcatgactttgcaataacagagagatatgcaatctttccagagtcacaactcatcgttaatcccatggacatggtcatgcgggggagctcgttggtaggattggaccgtaccatggtgccacggattggcgtgcttccaaggtacgccaaggatgagtcagacatgagatggtttgaggtgcctagatttaatatgttgcacacgacgaatggttgggaagaggctgatggagaggagattgtgctcgtggcacccaatatcctatctatcgaacacatgctaggaaacatggagctcatgcgagctcgtgtcgacatggtacgtatcaacctctgcaccggtgacgtgtcgtgcactgcactctcaccggagagccttgagttcggtgtcatccaccaaggttatgttggtcgcaaaaatcgctatggctactttggtgtaagtggtccgttgcccaagatcaaggggataagaaagcttgactttgatctcgtcggctctggtgattgcacggttggacgtcgtgactttggtctagggtgctttgctggggaaccattttttgttccagacaacatcgacgggtatggaaacgaggatagtggttatgtggtgtgctacacccatgaagaggacaccggagagagttggtttgtggtgatggatgcaaagtctccagagctagacattgttgcagaagtgcaacttcctagtcgtatcccctatggctttcatggtatttttgtcaaacaggccgaacttctcgcacaacaataa

SEQ ID NO: 3454 - DNA, 948 bp, Oryza sativa
  Clone ID: PAT_MRT4530_83609C.1
tcctcgccgcgcggtggaattcgaaattcgcccaaaacccccgcgtcgcccgcgaaaatttccctccaaaacctccgcgcgctcctcccaaaccgacataaattctacagcgaggaagggggagagagagggagagagagcggacgcgaggcagccgaaccaccaacgcgagcgagagagggagagggagaggaggaggaggagcaatggcggggaagggagggaaggggctgctcgcggcgaagacgacggcggcgaaggccgccgccgacaaggacaaggaccgcaagaaggcgcccgtctcccgctcctcccgcgccgggatccagttcccggtggggcgtatccacaggcagctgaaggggagggtgtcggcgaacggccgcgtgggggcgacggcggcggtgtacacggcggcgatcctcgagtacctgacggcggaggtcctggagctcgccggcaacgccagcaaggacctcaaggtgaagcgcatcaccccgcgccacctgcagctcgccatccgcggggacgaggagctcgacaccctcatcaagggcaccatagccggcggcggcgtcatcccgcacatccacaagtccctcatcaacaagaccgccaaggagtaggagaggcagcggcggctatgtgttcttggaagttttctatgacctctctgctaggggattagtgagaaaaaaatcccagttatcttttcactagtagtcttaatcatttaggacttgttgttatggtgattacctgaattaggtgttcctgaatctgtgtaatggctggctaaacctttggtaatttggtggtagggctgaagacttgacttgcagcagcttggtgtagttgtgatgtgaaactgcttatatttttctctctgttgggtgactagctaatgcttggttgttacttgttgatgacaaaaaaaaaaaaaaaaaa

SEQ ID NO: 3455 - DNA, 1727 bp, Oryza sativa
  Clone ID: PAT_MRT4530_83782C.1
gctcgcggctcatctcaccctcgccgcgcgccgaggaagacgcgcatctcctctctccctctatataagcgcgcgcctcgccacctcacccgaaaaaattccccaccattccatctctctctctctcgaatcttgatctctctctttcatcgcctcttgtgttcgcgcgcgcgagcagggtggttgttgttggtgggggtgcaatggcggggaggagcgagctggtggtgagcttcggggagatgctgatagacttcgtgccgacggtggcgggggtgtcgctggcggaggcgccggcgttcgtcaaggcgccagggggggcgccggcgaacgtggccatcgcggtggcgcggctcggcggcggggccgcgttcgtcggcaagctgggggacgacgagttcgggcggatgctcgcggccatcctccgcgacaacggcgtcgacgacggcggggtcgtgttcgacgccggggcgcgcaccgcgctcgccttcgtcaccctccgcgccgacggggagcgcgagttcatgttctaccgcaaccccagcgccgacatgctcctcacccacgccgagctcaacgtcgagctcatcaagagggctgccgtcttccattatggatcaataagcttgatagctgagccctgccggtcagcacatttgcgtgccatggagattgcgaaagaagctggtgcgctgctatcttatgacccgaatctcagggaggcattgtggccctcccgtgaggaggctcgcaccaagatcttgagcatctgggaccaggcagacattgtcaaggtcagcgaggtcgagcttgagttcttgaccggcattgactcagtagaggatgatgttgtcatgaagctatggcgccctaccatgaagctcctccttgtgactcttggagatcaaggatgcaagtactatgccagggatttccgcggagctgtcccatcctacaaagtacagcaagttgatacaacaggtgcaggtgatgcgtttgttggtgctctgctgcgaagaattgtccaggatccatcatcgttgcaagatcagaagaagcttgaggaagcgattaaatttgccaatgcgtgcggagcaatcaccgccacaaagaaaggggcaatcccatcactgcccaccgaagttgaggtcttgaagttgatggagagtgcttagatcgatcagtagcattatggtcactagcttcagcttccgcaaattgtattgtatgctgatctggatcaggagcaggggggtactccaagatgcctgcctttttgttgccaacttcccttcctggcaggatttttgatttggaactctaatttgaataagcagagccgttcaatgtcagtttctactatatgattaaataatcggtccttaattgtaatgcatcattctttttttttttttaactgaatccttgttccatgctgtatgaactcctttgagttccatttgtatatggtgctcttgccattataagagtagtgtttggtccaaaattttgtcagacaaacagaattatagttacttcttatgtgatcatacacagtgctggaagcctggaagtattgtgatgcagtgatgctcctggtaagagatattcaatgttcactcatagctatttcaattgtcttggtagctgagatatgaaattcactggtaccgtatatcagatatttctgaaaaaaaaaaaaaaaaaaaaaaaaaaaaaaaaaaaaa

SEQ ID NO: 3456 - DNA, 2712 bp, Oryza sativa
  Clone ID: PAT_MRT4530_84339C.1
aactaaaaccgcatttttttcttttttctggcacagggcaaatgaaacgagaacaaataatgtaagattcacttaatactactatttcatagagcaaataaatacccatttagcatccaggttaactcaggagtgccaaggacatacataaaagcatactgatgatatgcataataacggcatggttagcacctgcgcttaacagtgaccaagtgcctcacttatccagccgatatgccctgctaccgttttatctttgagattatcatcattctcctatccgatgacgcatgtacaaaatgagaccagaccagccagtgctgcagccagggaagaccgcggtacatcgtaacatagaaatgcccaaaaaaacaccgcatgaccacgaaatcgttgatgaagcatcatgacaccgctgcagcgaagctcgcgagtcagcaaagcttagctgtttcttgacttagcatcaaccaccaatcaagccaggtatctgtacacattagcgttgtccttctcgcgttccaggtaatcccttgtgatgaggtcctcgattcgcttcttgatggctttgaagtcaggcttgaacatgcggctgagctgctccacacattccgcaactagctgctgatggcccataactttgcgactcttcataatgcgcacaatcgatgcatcaattgcataccgcctgtccttgtcaacatcttcgacaacctttttcttttcatcaacaggaggtaggggtatcttaattcttctcatcctgtcagtgaattttgaattgaactcaaaaacatcgttgggagaaatagatctattagctggttccttgttaagaatcttgtattttgcacaggagagagaatggagcaaacgcactacatcatcatctgataagtttagctgtgttacaatctcagaataagtaagcctgtcagatccgttgaatagcagcagcaacgcagcctgatatgttgtgacaatgagctcaatagtttttgcctcaaactttgcattgatattgcaggttcccaaggaatatatccaggtaagctttctgtgttttgttcttgtttggtaaaactccttgaaaacctccacgcatttcaccatctcagcaggaaggttaatatcgaaagtcttgtaacttggccagaatcctgttgtcaaaacagtgacagccaagtctatcccaggattcaactcctgatgtgcagccacaaactcttcaaacttagtttgatggtcccttgcaacagtaagatcagtaaccattccctccattttagaagtaaattgtccaccacactgctgcttgagtttggtaagtatgcttctttcatgttcatcattggcactcttatcaaaaagcaatctccttgcaagttttttcctgtaaaactcagcaaagaggtctttatcgctgatgtatgcaagcaatcgcaccaccttctcaagagcatcttcgatggcttcatcactgagcttttcactgcaacctttcttcagaatattgtcacagaaggtggcaagcagttcagcacttgaactgccagagacacccttgttacagaagacctcgaatgcttctttaagggccttatgaaagagggtgtgaccctggaaacattctgtgacataagctacatacttgtcatggagctcaatgattttccagacaaaaacctgttcctgcataccaaccatgtcctttttctcgggcttcttattactagcagaatcttctgcttgcttgaccaaggctgtgccctcatttgtaacatgcgttttaaacatgttagcaataggttctagaccgcggttaattttggagaagagcctgtacatcctagaaaggtcttcctccttgtcatcacgaagcaatgcaaaacacccagaatgctccttctccaacaggggagttgcatattgtgcaagcaattcattttgcactttctccagtaacttctgttcactactaatatgcaagtagtgaccaactcgctccttctctttcttcaagcactcctcagcctttatcatgtaatcaggacaagagtcctcgagaatccagctttgagccttgagagagtagtaatctgtagtatccttaagcaagaaatcttcaaagtcattctcataacattccatactgcctagtccaatttcaacaaatatgcccaggacattcttcagcagggccctgtctatctgttcgccttcacgctctttgtcaatcagagctatcactgcacctttaacttgtcctttgatttcttggtatatcaaatctcggaagcaagtaagcccaacttgttcaagtggtataagcgacctccgtgagatgaagtatcgatcaagataaaagaagaaacgtgacagccaccgaaccatgattttatggtttgaccacctctttactagttccctcagcataaactcgtcatgtttatctcttaatgaaggtaagaccatggaggtgatgtactcctcgaatgactcccggtacttgtcgtagagctgctgcgagtagtcgtgcggcggcttctgcgtgcacatgttgtatatcgtcgtgtagagcatcatgtagtcctcggagctgaactgtggctcgggcttgccctcgaggatgttcttcagcttggtgatgcccttctgcatgaacgcccatccctcctccagatcgatcgtcctccgctcctgccccgccat

SEQ ID NO: 3457 - DNA, 838 bp, Oryza sativa
  Clone ID: PAT_MRT4530_85095C.1
gcacgaggacttgttcatttcccgcaccccccccgcccctcttcctccatctgcctctttaaaacagtaaaaataaccgtgcatccccctggggcaagaatctctcccatacatacactacagcggcgaacctttccttattctcgcaacgcctcggtaacgggcagcgcctgctccgcgccgcggttgcgagttcgggaaggcggccggagtcgcggggaggagagggaggattcgatcggccagaatggggagggggcgcagcgagataaagaggatagagaaccccacgcagcggcagtccaccttctacaagcgcagggacggcctgttcaagaaggccagggagctcgccgtcctctgcgacgccgacctcctcctcctcctcttctccgcctccggcaagctctaccacttcctctcccccaccgtcccctccgtgagggagtttgtcgagaggtacgaggccaccacgcacaccaaggtttgggcagatatcaggcaggagaggcgcgccgagctggagaaggtgggcagcatgtgcgacctcctggagaaacagctgaggttcatgacggtggacgacggcgaggagtacacggtgccgtcgctggaggcgctggagcacaatctggaggccgccatgcgcaaggtgcgctccgagaaggaccgcaagatcggaggcgagatctgctacctccagaacattattagggggcgacaagaggagcggtacgggctgtgcgacaagattgctcatgcacagactctgaaggatgtggaatgtggatccacctcactaagcaatggcttggaccttaaactggggttcaactag

SEQ ID NO: 3458 - DNA, 761 bp, Oryza sativa
  Clone ID: PAT_MRT4530_85350C.1
aacaaagaagaagaagaaagaagaagcagcagcaaaaaagttgaaaggttaatcagcaagtgtgttgttctttctattggtaagagagagagagagagagagggagagagagagagagagagagagagagagagagatctcagaatggtgaatccaggaagaacagctagggcactctgcctcctatgccttgctctcctcctgctaggtcaagatacccattccaggaagctcctgttgcaggagaagcacagccatggcgtcggcaacggcacaaccaccacccaggaaccaagcagagagaatggaggaagtacaggttccaataacaatgggcagctgcagtttgattcagccaaatgggaagaattccacacggattatatctacacccaagatgtcaaaaagccataatggctgttcatttatgatttgaactagtactagtagcttataccttctgcgcgtcttttgttcgtttggagaggggattttcttgggatttagcatatgaactaattaaattaaatcccaggcaaatcccactcagcccattttgtgcagaagttgtcagtgttgcactgtataattatttagtcatacacaactactcctggtaactactcctatcttcgatgaattttctggttttgccagacgtgacaatagtccagtagcatgcagtaccctctcagaatccctgtaatttttagcaaaaaaaaaaggaagaaaagaaaagaagcttccctactactttctcc

SEQ ID NO: 3459 - DNA, 2100 bp, Oryza sativa
  Clone ID: PAT_MRT4530_85425C.1
cccggttgcttccaggttcattgaaccaagccaccccgacacgaatcgctcaggcctcccccctgttgttcatccctcactcaacttttgggcagcttggctttattcaattccccttcctttttattgcgaatttgcgactgcgagcgagcttttcttcctcaaaggaagacgacgacggaggagcagccctgcagagcataaagagaggagaggagaggagagggggccggtcaaggaagaggagggaagatgagcagcacagctccactcctcacaccctacaagatgggaagatttgatctttcccacagggtagttctcgcaccactgacaaggcagcgatcctatggtaatgttcctcagcctcatgccattctgtactatcagcagagaacaaccaaaggaggccttttgattgctgaggccactggaatctcggacactgctcaagggtacaaagatactcctggtatttggacaaaggagcaagtggaagcgtggaagccaatcgtagacggcgttcatgccaaaggaggaatatttttctgtcagatttggcacgtaggaagagtctctaataacacttttcagcctaatgggcaggctccaatttcgagcaccaataagtcactaaaacctgcagtaagagccaacggcatagatgtggctactttctcaactcctaggcgattagagactgatgagatcccttttgtcgtgaatgattacagggttgctgctagaaatgcaattgaagcaggatttgatggtgttgaaatccatggagctcatggttatttgatcgatcagtttctaaaagaccaagtcaatgatcgttctgacaaatatggtgggagcttagagaatcgctgccggtttgcgctagaagtggtccaagccgtaactgatgaaattggagctgacaaggttgggataaggctgtcaccctttgccagctattcagaggcagcagactcaaacccagaagctctaggcctatacatggcaaatgcactaaacaagtttggtatcctctattgtcacatggtggagccacggatggtaaagcttggtgaaaagtttgaaaccccccatagtcttcgtccaatcagggatgctttcaagggaacgtttattgctgctggtggctacaataaggaggatggaaataaagcagtctccactggatatactgatttggttgcttatgggcgcttgtttttgtctaatcctgatttgcctgagaggtttgaaatagatgctcctctcaacaaatacaacagagagactttctacatctctgatccagttattggatacactgactacccatttcttccatcagatgtctaaatgtgcctttcagtactcgaattctcttccgcctctcatcaaagcagctcagcagccaccatttgtgttgttacttggtaggattgaagaaatatggccattgatctgaaagctgtttttcatgtgtgtgggcaaagcattgataaaataatgtgacattgtgatttcagcacggcacatgaatacaaagggagatgataggtagatcaagcagtgttgagaaattattttagtttgtatgcacaaatattgtgagcctgatataatatcagggagcttgcctgtcttactttgctctcaaatatgttctcagtcattcacatggttgtcagcgactgcaaatcttttacgtattcctgatatgtgtcactgactgagagatgggagtacagttggaataaaaagtggaagttgaatgtatgcagactgctattcctagcttatcatgtttgatgtttcaggataccttttgggtctgaagttctgagctgttcttctggcagttactgattacaggggcatactggacaagtaattaggatacagactgcacagaaagagcttacgaaggcaagaaggacctctccctgcccatctccgtatgtttttactaaacaaaaatttgtgtatcctgtatttgtgttgtgaaaatcatcctggcctaatttccagtcctttacaaatgattcatcatccactaaaaacttgagcttatcataaaagtaatagcttaaggatgctttt

SEQ ID NO: 3460 - DNA, 2445 bp, Oryza sativa
  Clone ID: PAT_MRT4530_85672C.1
atggctggattggtcatcggctgcctggccgtgcagctctcgctggcgtctctgctgctgtgctcgtccgcgtcgacggcgcagcacacgctcggcaccggctcctccctgtcggtggcggaccggtcgcggccgttcctggtgtcgccggacggcaccttctcctgcggcttcattcaggccggcgacgacggcgacaacgccttctccttctccgtatggttcaccgccgccagggacggcgccgtcgtctggacggccaaccccgacgcccccgtgaacggcaggggctcgacgatctcgttccgccacgacggcgagctggccctcgccgacaccaacgggaccacggtgtgggcgagccggacgggcggcggcgggcggggcctgaccgtctccctccgcgacaccgggaacctcgtcatcgaggacccgtcgaccggccgcgccgtgtggcagagcttcgactggccgacggacacgctgctcccgtcgcagcggttcaccaaggacaccaagctcgtcgccggctacttcagcctctactacgacaacgacaacgtgctgcgcatgctctacgatggcccggagatcgccagcatctactggccgttgccgggggtgagcattttcgacttcggccggacaaactacaacagctcgaggatcgccatcctcgacgacgccggcgtcttccgctcctccgacaggctgcaagcccaggcctccgacatgggcgtcggcgtcaagaggcggctcaccatcgagcaggacggcaacctgagaatatacagcctgaacgcgtccaccggaggttgggcggtgacatgggcggcgctcagccagccgtgccaagctcacgggctgtgcggcaagaacggcctctgcgtgtacctgccgagcctccggtgctcgtgcccgccagggtacgagatgatcgaccgccgggactggaggaaaggctgccagccgatgttctccgtcggcaactgcagccagccggcggcgcctgagcggttcaagtctgtggtggtgccccaaaccgatttctacggctacgacctgatgttcaacgggtcctcgataacattcgagctatgcaggaaccagtgcctgagcgattgccagtgcgtcgccttctcctacaggttcgacggcgtcggcagatgcttcacgaaaggcaggcttttcaacggctacacgtcggcgaatttcccggggaacatctacctcaaggtgtccatcgacttcgacgaatcgtcgccattggtcagcgcgcggagcgccgccggcctcacgtgcaatcccaacgtctccatcgtgacagtgcccgctgccgtgtacgggatggctccaagaaacagcgggaagtggacctacctgtttgtgttcgccggtgtgctcggtgtcctggacctcctcttcatcgcgacagggtggtggttcctgtccagcaagcagagcatccccagctcgctggaggcagggtacaggagggtgatgacgagccagttcaggcggttcacgtaccgggagctcaaggacgtgacggccaacttcaaggaggagctcggccgcggcggctccggcgtggtgtaccgcggcgtgctcgacggcggtaaggtggtggccgtgaagaggctggcggtcgacgtgacgatgcagggggacgaggagttctgggccgagatgacggtgctcgggcggatcaaccatatgaaccttgtgaggatttggggattctgctccgagcgcaagcacaagctgctggtgtacgagtacgtggagaaccagtcgctggaccggcacctgttcgacacggccgaaggcggcggcggcatgtcgacgacgacgctggcgtggaaagatcggtacaagatcgcgctgggcacggcgaggggcctcgcctacctccaccacgagtgcctcgagtgggtcatccactgcgacatgaagccggagaacatcctcctgacgagggacttcgacgccaagatcgccgacttcgggctggccaagctgtcgaagcgggaccgcggcgccggcgtggagctcacccacatgagggggacgtcggggtacatggcgccggagtgggcgctgaacgtgcccatcaacgccaaggtggacgtgtacagcttcggcattgtgctgctggagatcgtggtcgggagccgggtggcggaccagaggacggaagccggcgagcggctgcagctgccgcagatcgcgcaggcgctgaggcatgtgctggacagtggcgatgtgaggtctctagttgatgccaggctgcaggggcagttcaaccctcgtcaggccatggagatggtgaggatttctctggcgtgtatggaggacaggaacagcaggccgaccatggacgacatcgccaaggctctcacggcgttcgatgacgaggacgaacaccccgcttaccggtcatga

SEQ ID NO: 3461 - DNA, 1788 bp, Oryza sativa
  Clone ID: PAT_MRT4530_85748C.1
atgaccaagatcgtggggacgctgggtcccaagtcgcgcgccgtcgacaccatctcctcctgcctcaaggccggcatgtcggttgccaggttcgatttctcgtggggagacgctgagtaccaccaggaaaccctcgaaaacctcaagctcgccatcaagtccaccaagaagctctgtgctgtcatgctcgacactgtcggcccggagttgcaggtggtgaacaagagtgaggctgcaatctcccttgaagcgaatggcactgttgttctcacccctgaccaggggcaggaggcctcctccgaattgctgcccatcaacttctccgggcttgctaaggctctgaaaccaggtgctacaatttttgtggggcaatacttgttcactggcagtgagactacttcagtttggttagaggtttctgaagttaaaggagatgatgtggtttgtgtgataaaaaattcggctactctggctggttcactgttcaccctgcattgttctcagattcatatcgacttacctacactgtctgatgaggacaaggaggttatcagaagatggggagctccaaacaagattgacttcctctctctgtcttatacaagacacgcggaagatgtgcgacaggcacgtgagttcctctcaaagttaggcgaccttagccaaactcagatttttgccaaaattgagaatgttgagggtttgaatcattttgatgaaatcctgcaagaggcggatggtatcattctgtcaagaggaaaccttggaattgatcttccacctgaaaaggtgtttttgtttcaaaagtctgctctgcacaagtgcaacatggctggaaagcctgctgttgttactcgtgttgtggacagtatgactgacaacctcaggcctactcgtgcggaggctactgatgtggcaaatgctgtacttgacgggagtgatgccattctccttggtgctgagactctccgtggtctgtacccagttgagactatctcaattgtgggcaaaatttgcgctgaggcagagaaggtattcaaccaagatttatacttcaagcggactgtgaaatatgttggggagcccatgacccacttggagtctatcgcttcttctgcggtgcgagctgctatcaaagtgaaggcttctgtcattatttgcttcacatcatctggacgcgctgcaagactaattgccaagtacaggcccaccatgcctgttctatctgttgtcattcctcgtctgaaaacaaaccaactgaggtggagtttcactggcgcatttgaagcaagacaatcactcatagttagaggtctctttccgatgcttgctgatcctcgccatccagctgaatcgaccagcgctaccaatgagtcagttttgaaggttgctcttgaccatggcaaagcttccggtgtgatcaagtcgcatgatcgcgttgttgtctgccagaaagtgggtgattcctcggttgtgaagatcattgagctggacgattagacgaccagcttgtgcttgttgatgatactacggcaagtcatggtttgccagattttgactaggccaaaaacgatgcttcttggctatatgtataattcctatataggctttccaatgagcagtttttcctatggtgtaatcataggatttgccttactatttgaaacaactacgttttagttatgtaagttatcagatttcaatgcatcatatcacttcgatgggcaaatggaataatgaaatcggtactgtaccctttggtcttttgatgttcgttccacctttgtc

SEQ ID NO: 3462 - DNA, 370 bp, Oryza sativa
  UNSURE (1)..(370): unsure at all n locations
  Clone ID: PAT_MRT4530_85868C.1
  unsure (1)..(370): unsure at all n locations
gggagtggagaaacatcaacttcttcttcatcttcatctccccaaaaaataccacaagaatttaaaagaggctattggcaatgcanctactatgggccactctcactttttttactgaatggcaacctatctactcccctctcaatggcgtctctccacaaccgatacctgataccaagcttgtcatataatactggccacttccaaacatttgccccattgatcatcccttcttgctgccccagcaccagtcaaaaatcctcattcaaaaccttctcagcaaaatgtgaccatagtatattcatcaaagggacatgctttatccattgagccaagtccagagacatcctttagagcaacctggttttat

SEQ ID NO: 3463 - DNA, 1693 bp, Oryza sativa
  Clone ID: PAT_MRT4530_85925C.1
cccacgcgacggcacaaaacgaacgcgaactcgagcggcgaagaagaagagagagagagataaggcggcggcagcgagatggcggtgacgatccagtccgtgaaggcgaggcagatcttcgacagccgcgggaaccccacggtggaggtggacgtgggactcagcgatggcagcttcgcgaggggcgccgtgccgagcggtgcttccaccggaatatatgaggccttggagttaagagatggaggatccgactatcttggcaaaggtgtactcaaggctgtgagcaatgtaaacactattattgggccagcactcatcggaaaggatcccactgagcaagttgacattgataacttcatggttcaacagcttgatggaacctccaacaactggggctggtgcaaacaaaagcttggagcaaatgctattcttgctgtttcacttgctgtgtgcaaagcaggagccatggtgaagaagattcccctttaccagcacattgcaaatcttgctggaaacaagactctcgtgctgcctgtacccgctttcaatgtgatcaatggaggatcccatgctggaaacaaacttgccatgcaggagttcatgatcctccctactggtgcatcctctttcaaggaggccatgaagatgggagttgaggtgtaccaccacttgaagagtataatcaagaaaaagtatggccaagatgccacaaatgtgggggatgaaggtggctttgctcctaacattcaggaaaacaaagagggcctcgaactgttgaaggccgcaatagctaaggctggctacacaggcaaagtggtcataggaatggatgttgcagcttctgaattttacagtgaaaaggacaagacttacgatcttaacttcaaggaggataacaacgacggttcacacaaaatttcaggtgacagcctgaaagatgtgtacaagtcctttgtttctgagtaccctattgtgtcgatcgaagatccattcgatcaggatgactgggctacctatgccaagcttactgatgagattggacagcaagtgcagattgttggggatgaccttcttgttactaatcccacaagggttgccaaggcaattagtgaaaagacttgcaatgctcttctcttgaaggtgaatcaaataggctcagttactgagagcattgaggctgttagaatgtccaagcgtgctggatggggagtgatggcaagccataggagtggtgagacagaggataccttcattgctgacctctcagttggtctgtctacgggtcaaattaagacaggagctccctgtcggtcagagcgtctggctaaatacaaccagctgctcaggatagaagaagagctgggcgatgctgcagtttacgctggagaaaaattcagagcccctgtgaagccgtaataaaccttggcaccttgcggtgatcttgtgcctatggaccatggtgccatcaatctactactgcgtttttacacgagtctacaagggcaataaaattagtacttcttgacagtcccagaaattgcttagttaccctcgctttttcgttaatggccagattgtttgcttactactgtgttgacacacttgagcaccaatatgtaagatcaataaaagagcaaatcgcttgatttttcatcataaagtatttttttccccactcaacaaaaaaaaaaaa

SEQ ID NO: 3464 - DNA, 2424 bp, Oryza sativa
  Clone ID: PAT_MRT4530_86446C.1
tcacgtcaatgcaaggtgtttgttgctatcacgacgtatcctggcggcaaggatctggacgccggcatacttgacgtcccagctgaacttggtgatggcccagcaggtgccgccaaactcgtccgcgttgtcgacgatgtagtcgaggtaggcggcggcggcggcaaaggcatcgcgacgtgcgtgggcgcggcgggagccgtcgcgacgccttgaggacgacgagccgtagctccgcctcgagggcgcctcgtcgccgctccgtctcgaggcagcgcccgccctcccgctggctgtcgccgctacggccctcaaacacccaccgccgctctggccatagttgagggagttaaagtatactttttccaggaaaaaatgaatcgagtgtgtcaaaccgcgtgtcatccccactctacaaagcgcaaaatcatcaagggccttcgcctcggcgtggaggagagtgaggacggcccacgcggaccagcagagagtggcgggctcagtgtcgggctcgccggagtccgcccaatccggccggttcatgcttcattctctcggacattaacctggtttacttgtaagaaagtagagccatggactcctcataccagcatgacaagcctctgctggatgaagagaactcctcgcaagtgacccttgaatatacaggtgatggatctgtttgcatccgtgggcatcctgctttaaggaaacatacagggaactggaagggttcctcattagccatcgttttttcattctgctcttatctggcctttacttcaattgtaaaaaacctagtcagttatctcacaaaagttctacatgaaacaaacgtggccgctgcaagagatgttgcaacttggtcaggaacaagttatcttgcacctctggttggagccttcttagctgattcatatctggggaagtactgtacaattctgatcttctgcacgatcttcattatcggattgatgatgttgcttctgtcagcagcagttccattaatctctactggtcctcactcatggatcatatggacagatccagtctcttctcagaacatcatattctttgtcggtttgtacatggttgctttagggtatggtgcacagtgcccctgcatatcatcatttggtgctgatcaatttgatgacactgatgaaaatgagagaacaaaaaagagttcttttttcaattggacctatttcgtagccaatgcgggctcattgatctcggggactgttattgtgtgggtgcaagatcacaaaggttggatctggggttttaccatttctgcactatttgtgtatttaggttttggtacttttatctttggctcctctatgtatagatttcagaaacctggaggaagcccctcttgcgagaatatgccaggttgttgttgctgctattcacaaacgcgataaagatttgccatgtgattcctcagttctttatgagtttctggggcagagttcagcaatcgaaggcagccgaaaattggagcatacaactggacttaagttctttgatagagctgcaatggtgacaccatctgattttgaatctgatggcctactaaacacatggaagatttgcacagtcactcaagtggaggaactgaagattttgatcaggatgttccccgtttgggcaacgatgatattatttgctgcagttctggacaacatgttttcgacattcatagaacaggggatggtgatggagaaacacatcggctctttcgaaatacctgcggcgtccttccaatccattgatgtcattgctgtccttatactagttccagtctatgaaagagtccttgttccagtgttcagaaaattcactggcagagcaaatggcattactccactgcagcgaatggggatcggcctgttcttttccatgctctccatggtatcagcagcattggtggagagtaatcggttgcggattgcgcaggatgaaggtttggtgcacaggaaggtggctgttccaatgagcatcctgtggcagggaccccagtacttcctgataggcgtgggagaggtgttctcaaacattgggttaactgaatttttctaccaggaatcaccggacgccatgagaagcttatgtctcgcattctcacttgctaacgtttcggcaggaagttacctcagctcgtttatcgtttctcttgtgccagtgttcacagccagagaaggcagtcctggatggatacctgataacttgaacgaagggcatttggatcggttcttctggatgatggctggcttgtgtttcttgaatatgctggcctttgtgttctgtgccatgaggtacaaatgtaagaaggcttcctgaaccttgttaacattagcaatataatggtggtggaaaaggacaattgtgttgcaaaaaaaaaaaaaaaaaaaaaaa

SEQ ID NO: 3465 - DNA, 796 bp, Oryza sativa
  Clone ID: PAT_MRT4530_86520C.1
ccggccgggcgatccatttttcattctattttctcccccttttccttctcacactacacgaccgccatctccattccttctttcgcgcgcacggccgccgccggccgccgtcaatctcctgcagcgtgtggactccgacggctgtggcctcctctgctcatgctcatgctcattctcattctccattgatgggtttctttcatgtagggaaaggaaaggtgatttcagttgcctgactgctgccagaatctgcgaagcatctacaagcgacgccgtcgttcaggcagccggcacggcaatgccggttccccttgctccatacccaaccccgcctgtgccatttacacctcccaatggggctcaaagccagctcgtgtgctctgggtgccgtaatctgctcatgtatccagccggagcaacgtcggtttgctgcgcagtttgcagtaccgtgactgctgtgcctgctcctggaaccgagatggcgcagttagtttgcggaggatgccacactctcctgatgtatatacgcggtgcgacgagtgtgcaatgttcttgctgtcacactgtcaacctggctatggaagcaaatcaagttgcgcatgtaaactgcgggaactgccgtatgctgctcatgtaccagtatggcgcaaggtctgtcaaatgcgcagtctgcaattttgtgacatcagttggggaacactgggacccaggtgattggtacaatctctctgactgtcacccaaagctgatgtctgcttggcaacagcttgcagtgatggcatgtgatgcattttga

SEQ ID NO: 3466 - DNA, 2460 bp, Oryza sativa
  Clone ID: PAT_MRT4530_86643C.1
atggctggattggtcatcggctacctggccgtgcagctctcgctgatgtctctgctgctctgcccgtcctcgtcgacggcgcagcacacgctgggcagatcctccatgtcggtggaagaccacgcgcggccgttcctggtgtcgacggacggcagcttctcctgcggcttcctcgaggccggcgacaacgccttcaccttctccgtctggttcaccgccgacccgaacaggaccgccgtctggtcggccaaccgcgacgcccccgtgaacggcaggggctccagggtctcgttcagccgcgacggcgagctggccctcgccgacaccaacgggaccacggtgtggtcgagcaaaacgacggctggcaccgggaacagaaggggcctgaccgtctccctccgcgacaccgggaacctcgtcgtcggggacccgtcgaccggcctcgccgtgtggcagagcttcgagtggccgacggacacgctgctcccgtcgcagcggttcaccaagcagaccaagctcgtcgccggctacttcagcctctacttcgacaacgacaacgtgctgcgcatgctctacgacggcccggagatcgccagcatctactggccgctgccggggttgaccgtgttcgaaaacggccggacgaactacaacagcacgaggatcgccatcctcgacgacgccggcgtgttcctgtcctccgaccagacgaaagccgaggccaccgatctgggcctcggcatcaagaggcggataaccatcgaacaggacggcaacctgagaatgtacagcctgaacgcgtccaccggaggctgggcggtgacatggtcggcgctcaagcagccatgccaagctcacgggctgtgcggcaaaaacggcctctgcgagtacctgccgagtctccggtgctcgtgcctacctgggtacgagatggtcgaccgccgggactggaggagaggctgcaagccgacgttcccagtcggcaactgcagccagggatcggcgccgccgccgtcgccggcgacggcgccgccgcagttcaagttcatcgaggtggcccagactgattttttcggcttcgacctggggtacaccgagtccatcacgttcaagcagtgcagggaccagtgcatgaacaactgccagtgcaccgccttctcgtacaggctcgacggccggggaaaatgctacccgaaaggcacgctgttcaacggcttcacgtcggcgaatttccccgggagcatctacctcaaggtgcccctcgacttcaacgcctcgtcgccgcgggtctccgcgcagcgcgccgccggcctcgcctgcggtgccaacgtcaccgtcgtgaccgtgtccgctgacgtgtacgggatggcgccaggaagcaacgggcagtggacctacttcttcgtcttcgccggcgtgctcggagtcctggacatcctcttcatcgcgacgggctggtggttcctctccagcaagcagagcatccccagctcgctgcaggcagggtacaagatggtgatgacgagccagttcaggcggttcacgtaccgggagctcaagggcgcgacggccaacttcaaggaggagctcggccgcggcggctccggcgcggtgtaccgcggcgtgctcgacggcggtaaggtggtggcggtgaagaggctggcggtcgacgtgacgatgcagggggacgaggagttctggtcggagatgacggtgctcgggcggatcaaccacatcaatcttgtcaggatctggggattctgctccgagcgcaagcacaagctgctggtgtacgagtacgtggagaaccagtcgctggaccggcacctgttcgacgcgtccgacggcagcggcggcaaggcgacgacgctggcgtggagcgatcggtacaagatcgcgctgggcacggcgaggggcctcgcctacctccaccacgagtgcctcgagtgggtcatccactgcgacgtgaagccggagaacatcctcttgacgcgagagtttgaagccaagatcgccgacttcgggctggcgaagctgtccaagcgggacggcggcgccggcgtggagctcacccacatgagagggacgtcggggtacatggcgccggagtgggcgctgaacctgccgatcaatgctaaggtggacgtgtacagcttcggcattgtgctactggagatggtggtaggaagcagggtcgcggaccagaggacggaggccggcgagccgctgcagctgccgcagatcacgcaggcgctgaggcatgtggtggacagcggcgatgtgatgtccctagtggatgccaggctgcaggggcagttcaaccctcggcaggccatggaaatggtgaggatttctctggcgtgtatggaggagaggagctgcaggccgaccatggacgacattgccaagtctctcaccgcgttcgacgacgaggacgaacaccctgcctaccactcttga

SEQ ID NO: 3467 - DNA, 577 bp, Oryza sativa
  UNSURE (1)..(577): unsure at all n locations
  Clone ID: PAT_MRT4530_86677C.1
  unsure (1)..(577): unsure at all n locations
gccaataactgcagcggctgaagcgatttgggcgtgttcgattgaagaactagggctggagaatgaggccgagaaaccgagcaatgcgttgttaactagagcttggtctccaggatggagcaatgctgataagttactaaatgagttcatcgagaagcagttgatagattatgcaaagaacagcaagaaagttgttgggaattctacttcactactttctccgtatctccatttcggggaaataagcgtcagacacgttttccagtgtgcccggatgaaacaaattatatgggcaagagataagaacagtgaaggagaagaaagtgcagatctttttcttaggggaatcggtttaagagagtattctcggtatatatgtttcaacttcccgtttactcacgagcaatcgttgntgagtcatcttcggtttttcccttgggatgctgatgttgataagttcaaggcctggagacaggcaggaccggttatncgttggtggatgccgggatgagagagctttgggctccgggatggatgcataacagaataagagtgatttgtttcaagctttgctggg

SEQ ID NO: 3468 - DNA, 2022 bp, Oryza sativa
  Clone ID: PAT_MRT4530_86747C.1
atggccgggaacttgctagccaactatgttcaagtcaatgtcatgctccccctggatgtggtgactgtggacaacaagttcgagaaggtcgatgagacccgggcacagctgaagaagctgacggaggccggcgtcgatggcgtcatggtggacgtgtggtgggggctggtggaggggaagggccccgggtcctacgactgggaggcctacaagcagctgttcaggctggtgcaggaggccgggctgaagctgcaggccatcatgtcgttccaccagtgcggtggtaacgtcggcgacatcgtcaacatcccgatcccgcagtgggtgcgggatgtcggcgcgagcgaccccgacatcttctacaccaaccgtggtggggcgaggaacatcgagtacctcacccttggagtggatgaccagcctctcttccatggaagaactgccatccagatgtatgctgactacatgaagagcttcagggagaacatggcagagttcttggatactggtgtcattgtggacattgaggtggggcttggtccagctggtgagatgagatacccttcctacccccagagccagggatgggtgttcccaggcataggagaattcatatgctatgataaatacctggaggcagatttcaaagcagaagcagcaaaggctgggcatcctgaatgggaattgcccgacgatgctggagagtacaatgacactcccgagaagacccggttcttcgcggataatggaacatatgtcactgagaaggggaagttcttcctcacatggtactcaaacaagctgataaaacatggagacaagatcttggatgaagcaaacaaggtcttcttgggatgcagagtgcagctggcaatcaaaatctccggcattcattggtggtatagggttccaaaccatgcagctgagctcactgctggatactacaacttggacaacagagatggctacagaaccatcgcacgcatgctcacaaggcaccgtgcctgcgttaacttcacatgtgctgagatgagggattctgaacaaagctcagaggcaaagagtgcaccagaagaactagtccaacaggtcctgagtgctggatggagagagggcttacatgtggcatgcgaaaacgcactcggtcgatacgatgcaacagcttacaacacaatactaaggaattcaaggccgacaggcatcaacaagaatggacctcctgagcacaagctatttggattcacctacctccgattatcagacgagctgctggagggacagaactacagcacattcaaaactttcgtcaagaggatgcatgctaacctggagtcctccatctatatgagggatcctatcccaggcaactacccctcctcccttaccccctgccgggacgtcgtcgtcatcatcgcctccgccctcctctgccagcagcgatctcgaggaacgccaccgcgcaggggggctcgatccggtgggctccgcgctgcatgcagggcacgctcccgccgccgtacagggtggcggttctggaagccatcgctgcctccagcagcggccggcggagggtctcggcctctcgggagagggggtactggatcgagaactgaccggaggttttcggcggcgcagcgtggacaattcggcctccccgcgaatccggcagccaccggagcggcagccgagggtcgccgccccggcgaacttctccgcggctgcctgtcagtgtccgccgctgtcttctgcagcgccgccagcgtaagattagttgggccgactctatcgtgcaccatctcagtgcgacttcctgccttccagcgtgagagaaggaatgggaagagaaaaggtaaggatggctcatgcctggtctttggaagggaggtggccaagcaggtcggaactttctacaccgagctggtcctgctcaccgtcggagctcgtactcacactctcgtccactccggtgcggtgccactagctaggaataagttcactttaggtttcttgatttatcgttga

SEQ ID NO: 3469 - DNA, 2187 bp, Oryza sativa
  Clone ID: PAT_MRT4530_8698C.1
attcggcacgaggccgcctccgcctccgcctccgcctcacctcgcgccgtcgccgtcgccaagagccggcgagttccgtttccgcctctgcctcgtccaagtccaagccaactacctaaacctaaaccctattcttcttctttcgcctccgccgcgatgtcgtcggagcctccacccgatgccgccgccgccgccgcctcctccgcgggggatctcgcggccgatctctcctccgccaccatcagcaagaagcagctcaagaaggatgcgaggaaggcggagaaggccgagaaggcgtcgcagcgccagcagcagcagcagccgcaggccgacgccgacgaccccttcgcggccaactacggcgacgtccccgtcgaggagatccagtccaagaccatctccggccgcgtgtggaccgagatcggcggcctcgacgaggccgccgccggccgctccgtcctcatccgcggcgccgcgcaggcgatccggcccgtcagcaagaagatggccttcgttgtgctgcgcgagagcatgagcaccgtccagtgcgtgctcgtcgccagcgccgacgcaggggtcagcacccagatggtgcgcttcgccacctccctcagcaaggaatcaatcgtcgacgtcgagggcgtcgtctccctccccaaggagcccctcaaggccaccacgcagcaggtggagattcaggtgaggaagatctattgcatcaatagggcgatccccacccttccaatcaaccttgaggatgcctcacggagtgaggctgaaattgaaaaggctgaacaagctggagagaagctagttcgtgtgggccaagatactcgcttgaactatagagctattgatctccggacacctgcaaatcaagcaatattcagaattcaatgtcaagttgagaacaaattcagggaatattttctgtcgaaaaattttgttgggattcacagcccaaagctaattgctggatccagcgaaggtggtgcagctgtattcaagctacagtacaatggacagccagcatgtttagcacagtctcctcagttgtataagcagatggctatttgtggtgggtttgaacgtgtatttgaggttggacctgtttttagagctgagaattcaaacactcacaggcatctgtgtgagtttgttggccttgatgctgagatggagattaaggaacattattttgaggtttgcgacataatagatggtttgtttgtagcaatatttaaacacttgaatgaaaattgcaagaaagaactagagacaataaacaggcaatatccatttgaacctctgaagtatttagagaaaactttgaagctcacgtatgaagaaggaattcaaatgctgaaggaagctggaacagaaatcgaacccatgggtgacctcaacactgaagctgagaaaaaactaggccggcttgttaaggagaagtatggaacagaatttttcatcctctatcggtatcctttggctgtgcgtcccttctacaccatgccttgttatgacaacccagcttacagtaactcttttgatgtctttattcgaggagaggaaataatatctggagcacaaagaatacatttaccagagctattgacgaaacgtgcaacagagtgtggaattgatgcgagtactatttcatcatatatcgaatcgttcagctatggtgcacctcctcatggtggttttggtgtcggcctggagagggtggtaatgctgttctgcgccctaaacaacatcaggaagacatcacttttccctcgcgatccacaaaggctggtgccataatttgctttttttcccaagagcaaggtttggactcagtacggactgggcagttttcctcggctggtttttttacctggacattattttcgtatttattaatgtgctgtactgcaaaagctgctcctttccacaacatttggaatagttgccgatacatttggaatagggctcaacgttggcgttgtgatttcgttgatgattccgctattcgtaacaatggcgaatccagagcagaaatgaccctatgtcagaaacatatcacatactcgtatgcctatatttccaaaagataagggattatggaaggatgacatattcaagtcccaaaatacaaggtgtggtttgactcgtggtcttcaacatccaaaaaaaaaaaaaaaa

SEQ ID NO: 3470 - DNA, 2447 bp, Oryza sativa
  Clone ID: PAT_MRT4530_87187C.1
cccccaagtcgcgccccccccccctcgccaaaaccaaaaccctaatcctcgcctccctcccctcccctcccctccccgtccggccatggcggcgtcgctgcttctccgagccgcccgccggcgagacctcgcctcgcccctcggaacgttgaccgccaatgctcaatcggcatattctgcgaatatttgttcacaatggggtagttttgcaagagctttcagtgtaaaaccaactggaaacgaggttattggaattgatttgggaacaactaattcttgtgtttctgttatggagggaaagaaccccaaagtgatagagaattcagaaggcaccaggacaacaccatcagttgtggcctttaatcagaagggagagcgacttgttggaactccagccaagcgtcaagcagtgaccaacccacaaaacactttctttggcacaaaacgtctgattgggagacgctttgaggatccacaaacacagaaagagatgaaaatggtaccatacaaaattgtgaaggctccaaatggtgatgcttgggtggaaacaacagatggcaagcagtactcaccaagtcagattggtgcatttgttttgaccaagatgaaggagactgctgaatcttaccttggtaaaactgtttcaaaggccgtgattacagttccagcttattttaatgatgctcagcgtcaggcaaccaaggatgctggtcgcattgctggacttgatgtccagaggatcatcaatgaaccaactgctgctgctttgtcttatggaacaaacaacaaggagggtttgatagctgtgtttgacctgggaggaggtacctttgatgtctcaattcttgaaatctccaatggggtgttcgaggtcaaagcaacaaatggtgacacttttctgggaggagaagactttgataacactcttttggagttcttggtgagtgaattcaagaggagtgaagctattgatctggcaaaggacaggctggctctgcagaggttacgtgaagctgctgagaaggctaaaattgaactctcatcgactgcccagaccgagattaaccttccattcatcacagctgatgcttctggagctaaacatttgaacattacacttacaagatcaaagtttgaatctttggtgaatagcctcatcgagaggaccagagagccatgcaagaattgcttgaaggatgctggtataactaccaaggaggttgatgaggtccttcttgttggtggaatgacaagagttccaaaagtgcaggaaattgtttcagagatttttggcaagtccccaagcaaaggggtcaacccagatgaagctgtagccatgggtgcagccatacagggtggtattctccgtggagatgtaaaggagctgcttctccttgatgtgacccccctttcacttggtatcgagactcttggtggtatcttcaccagactgattaaccggaacactacaatccccacgaagaaaagtcaggtgttctccactgctgctgacaaccagacacaagtgggcattcgtgtcttgcaaggtgagcgtgagatggcgacagacaacaagcttcttggtgagtttgatcttgttggcattccaccagcgccaagaggtatgccacagatcgaggtcacatttgacatcgatgccaatggaattgtgacggtctctgcaaaagacaagtctaccgggaaggagcagcaaatcaccatccgatcctccggtggcctctcagaagctgagattcagaagatggtccaggaggctgagcttcactctcagaaggatcaggagcggaaagccctcattgacatcagaaacaacgctgacactaccatttacagcgttgagaaaagtctgggagagtacagggacaagattcctgcagaggttgccactgagattgagacagcaatcgccgatctccgctctgtgatgacctcagatgacatcgagaagatcaaggccaatatcgaagcggccaacaaggctgtttcaaagattgggcagcatatgtctggtggtggtggtggcgcaggcggttcagagacaggaggatctcagggcggaggcgagcaggctccagaggctgagtacgaggaggtcaagaagtgaaaccgcatgtgctaacagttgccctgcttttagagatagcagctagtagttttttggaagagaccgggatactaggaccttgcgcgttgtaataagttttgtcatacgaaaacacacctaagctcgtaggcctgtctagttgggttgtaatgcatgacttggttgcattggctccttttgcttgcgatacatcgcgcaaactggacgtgatattgtgatattttttttcaccctgttcactcatgagtacaatgaatcctgcatggaagaaaaaaaaaaaaaacaaaaaaaaaaaaaaaaaaaaaggaggggggcctcgtgc

SEQ ID NO: 3471 - DNA, 344 bp, Oryza sativa
  Clone ID: PAT_MRT4530_87581C.1
gggaccaaaattagacggcctttaattggaactagaggatcacaaactacgtccctcgacaaaagccccggataaggggcctatgcattttcgcagggaaaaagggacgcccctcgaaaccatcacatttttaaacaacctaacccaggagctagataaaaaaacaccaggggggggggaacacataactacagttggtccttataaaacaacaacggttccgcctcctccttgaggggggaggattcctttttttaaacctgggcctactagacctccttttccttttccacggccgtgtaggggctaaggtcaaggctcttctgaaccgacctgtaaatgct

SEQ ID NO: 3472 - DNA, 804 bp, Oryza sativa
  Clone ID: PAT_MRT4530_87677C.1
atgccaatctacgtcatgacagcgctcaagattccaaagcaaataatccaagaaattgataaagcaagaagaaaatttctttgggacggtggcgatgagttccacggtggcaagtgcaaggtgaattggcagcgagtttgcagaccgatcaagtatggtggcctgggggtctcgaacctcaccaagatgggacgggccctccatttacgatggctgtggtacgaatggaccttcccagacaaaccgtggattggtatgccaaccccatgtgacgaacaggacgccgagctctttgcagcatccacaacggtgaccatcggggacagcaggaaggcgctcttctgggaatccccttgggtatccagctccccactaaagacaatggcaccaaacctctaccgtcatgctagaaggaagaaaaggactgttgcaaatgccctacaggacaataagtggatcaatgacatcagacacaacttgacatcaatgctcgtcacggagttcttcaaggttttcgagatactttgggaatcaaacactaccctatcccaagatataagagatggtgtttctgttggggctttacggcggctgtggcagccggaggaggacggccgcgtcgtcgacgggtggcgtggagaggcggcggttggcagcggtggcgatggcgcggccggtgaggcaactgtaccggaagctgaggtcaaagtggaggagctcggcgtcgacgcagccggggaagaaagccggcggcgcggcgaggttcgggtacagcctggagagctactcccgcaacttcgatga

SEQ ID NO: 3473 - DNA, 3230 bp, Oryza sativa
  Clone ID: PAT_MRT4530_87860C.1
ctagagatcaaagttgagacttaatctggtgccatggagttctatcttcgctgcgaggttctcctggcagcgattggtcgctcctgtctggctattggcggtgagggtgaacgggttaactttgctagggttgtcagcaccaccaccgtgtactgcttcctccatcaaatcaagatctttcttaagtttaggcaaaccacgaacaagatccaaaccacttaacctagtgagatgatcaaaaccaacatgtccaagttttaagtcctcaactaaagctacgttcttcaattcaaatttctcatttacctttaccaaacctgtagcgagaacggcactagtagaagcatcaccaaagataatcgattcagtcttggatgcctttttgacggaggagaaccaatttttatcaccaatcatgtgccgcgaacaaccagaattcacgatccacacgttctccttccttgccaccaaaggatacacaccagcagaagtcgaagcctcagtattttcacgatcattagaaacattggtagactcagatggcttagcaacacaagcaacaaatgaaggttttacatgcacaacattggattttgaagatgatgcactcaaggtagagatgatgccagcagatttaaacacaatgttcttatcttcaggtttaaccaaaatttcaccacttctagcaccaacacctaacacaacaggaggatgtctagaattatgagcataaggatcaaaacctcatcttgattaacaatctcttccatgtgtataacacgcccaaaagcatctttcaacttcatctcattcaaaacacactttgaacaatcttgagaaatcaaaacaccattgttttgttttgctttattcacacatgaagcattgaccaaagaacttgcacaaaaagcaactttgtatttttttcaaaacgttctttgtcaaaatcaactcatcaacaacacgagcatgtaaagcaaatccaatcgcaaaagaagattccaacgttttagatttttcaatctaaaattccaattttttgcaattaacagaattggcatctcgcaaagcattaatttcagaaaataaaacttcacaagattaacaattatcatcatcagaaatcgaagattttaatctatcaatttcagcatttagaatctcaatagtgtgatccttctcatcaagcacaatagaacatgtttaaagtttttttagcaaatttgtaagcagcaagttctaattgatcataactatgcttttcttcattatcatcatcagattcatcaacatgagaactttcattacgagcaataaaaactaaatcaacaacttgcttacctttgctctcatcttcatcttccgattcatcaaaaacttttatgagtttttggattaaccacttgatacaatgcttcttcttctccttctccttcatgttcttcttcttgttcacgtcatcctctttgactctaccatcatcttccttcttgcctctcccaagcttaggacaatgcgagcgaagatgatcaagtgcaccacactcaaaacaatgatttggttctcctcttttcctgtttctaacatttttcatagctcgagaaaatttgttagatagcaaaaccaagtcctcctcctcgaactgttcgagttgatcatcggacatggcattaaataaagcaagaacagaagacttcgatgaagaagcaccaacatccaaagaagttgaagacgaaaccaaagcactagacttagaatcacctttacgagaaagaatattcatctcatgagttttcagttttgtgtaaagcgaatccaaagtcaaagtagacatgttcacggactcctgaatagaagtaactttcatctcccaaatagacatgtcaagaccattcaaaaagtgacgagaaatctcagattgtggataattagcatcataagaagaatcaacagatctaagatcactcaaaattttattaaacctagaaagatagtcatccaaagcttctccaggtttcatctcaaatttaatgtactcctttttgaaaagatcacgacgaaattctttaatgttatttgtaccttgatgaaaattattcaaagcaacccaaatctcatgagcagtttgaagatgagcaacacgatcataatccgaacaagaaatcccactcaaaagaatattgcgagctttgcaattcagttcaaaagcaattttttcagcagcagtattaataacttcaggaatcacataaggaagagaaacttttctccaaatatcataattctcagccataatgtaagattgcatcctacaccaagccgactcccggtccatcaccgcaaatactctccctaggcatcgagtcaccgctcgatcaccgctggtctgaccggcatacacagcctggtcagaccggtcacataaaataacagtgaatccgatcatcaccggctggtaggaggcgatgaacacgtcgtcgtagacgagcccggccaggccaccaccgatcagtgggccgacccagtacacccagttgccggcgaagttgccggccgcgacggccgggccgaaggagcgggcagggttcatggaactgccgctaaagggccccgccgccaggatgttggcaccgacgatgaagccgatggccatgggcgcgacggtgccgagggaacccttcttcgggtcggccgccgtggcgtacaccgtgtacaccagcgcgaacgtgatcacaatctccatcaccatgccctcgatctcgctaattccggcgatggcgtgcgtcgggatagccaacctgtccgtgggtggagaactgcagagcagacacgcgacggacgcgccgagcagctgagcgacccagtagaagatgccggtgaggatggtgatgtggccaccgacggcgaggccgaaggtgacaacggggttcaagtggccaccggagatgttggcggccatggaaactccgacgaacagcgcgaaggcatgggctatggcgatcgccaccagaccagctgggtctagcgcgccgccctttgtcagttgcccgtaggcaatggcggagccgacgccggcgaacacaaagaggagtgtggcaatgaactccgcgacataggccttgatggacgaggcactgaaagagtcgccgcagcttccaaatgcaagcttcaccatctttctttatgcgagtagaagagcttttaggctaggacttcaaaggagatggttg

SEQ ID NO: 3474 - DNA, 743 bp, Oryza sativa
  Clone ID: PAT_MRT4530_88073C.1
agacggctccgcctagggccatgatgctgcccagctcttggcctgcctaagtgacctgaatggactaggaatccttgatttggaactaatgaataaatcactacttggtaaatggctttggaaacttgagactgaagaagggtcatggtaggatttgtttaaagcaaaatatttatatcacacaacattgagacacaaaaaaaaaaaactcagcaatggtgattctatcttttggcagggtttaatgcaagtgagagatgatttcttaaaatcctgttcaaaagaaattggtaatggagaaaacactctctttcgggagtacagatggaacgggaaggaaccttttgctgttaaatatgctaacctgtataatgtggctatgactaagaatgtcacagtagcaaaagtttcgagagaacgttggatgtgctgagttttagaagaaagatggagggaaaaaaataaatttcctagcaaaatttgaaaaagaatttcatgaacatcactttgaataatcagaaagatagtttggtctgggaactggataggaagaaaaggcttttttgtgaaatctttctatagagcgctgcagattcaacaaataaagtgccctaataggaaaaaatctgagcttggcgtaatcatggtcatagctgtttcctgtgtgaaattgttatccgctcacaattccacacaacatacgagccggaagcataaagtgtaaagcctggggtgcctaatga

SEQ ID NO: 3475 - DNA, 1430 bp, Oryza sativa
  Clone ID: PAT_MRT4530_88123C.1
ccggccggggccgcaccccccggccgggctccctcctcctcacctccacccatcgtgcgctaaactctagccagatctcgctcgctcgccgctcgccgccgccgccgcgttccaccgagcggagagtagagggaatggcgtccgagggcgtgctcctggggatgggcaaccccctcctcgacatctccgccgtcgtcgacgacgccttcctcaccaagtatgacgtcaagctgaacaatgcaattctcgctgaggaaaagcacttgcctatgtatgatgagttggccagcaagggcaatgttgaatatattgccggaggagccacccagaactctatcagggttgctcaatggatgcttcaaactcctggtgcaacaagttacatgggttgcattggaaaggataagtttggtgaggagatgaagaagaatgcccaagctgctggtgttactgctcattactacgaggatgaggctgctcccacgggcacatgtgctgtctgtgttgttggtggtgaaagatcactggttgcaaacttatcagcagcaaactgctacaaatctgagcatctgaagaaaccggagaactgggcactagtggagaaagcaaaatacatctacattgctggctttttccttacggtctccccagattctattcagcttgttgctgagcatgctgccgctaacaacaaggtgttcctgatgaacctctctgcaccctttatctgtgagtttttccgtgatgcccaggagaaggttcttccgtttgtggactacatcttcggtaacgaaacagaagcaagaatctttgctaaagtccgtggatgggagactgagaatgttgaggagatcgcgttgaagatttcccagcttccattggcctctggaaaacaaaagaggattgccgtgattactcaaggtgctgatccagtagttgtcgctgaggatggacaggtgaaaacattccctgtgatcctactgccaaaggagaagcttgttgacaccaatggcgctggtgatgcctttgttggaggcttcctctcacaattggttcaacaaaagagcattgaggactctgtgaaggctggttgctatgccgcaaatgttatcatccagcgttctggctgcacttaccctgagaagcctgatttcaactagggctaacccaaccacatattgaggaacaattattcgcacatccaacctactagtggtttggtgtgttctacctgtaccatctcgaggctttccatatgatccggccaatatttttttgccgtgatttttgtttcactgctgcaaaccttactttattctcggtataaggcacaattgccaatcggtgtgttgttttggtcaaaaaaaaaaaaataaaaaaaaaaaaaaaaaatatttactgttcggccatttctcttttgctcttttcgt

SEQ ID NO: 3476 - DNA, 1523 bp, Oryza sativa
  Clone ID: PAT_MRT4530_88136C.1
atggcgaggacgcgctttctcgctccgcgggcggcggcttcggcggcctccgccgtctccgcgaagccggcggcggtggcgccgctgtacgcggaccgcacggtcgtccgtatcgggctccccagcaagggccgcatgtccgagcaaaccctaagcctccttaagagttgccaattgtcagtcaggcacctcaacccgcggcagtacaccgcagatatcccgcaggtcccaaacttggaggtttggtttcagaggcccaaagatattgtccgcaaactacaatctggggatcttgaccttggcattgttggttttgacatagtcagtgaatatgggcagggtattgatgatttagtagttgttcatgatgctctcgagtttggacattgtcgtttgtcccttgcggttcctaaggaaggcattttcgagaatataaatactctggaggatttggcaaatatgcctgaatggacacaagagagaccattgcgtgttgttacaggatttggatatctatgagaaaagtttatgagagaaaatggtttcaatcatgtttcgtttttagctggagatggagctcttgaatcatatcccgctatgggtatggctgatgttatcgtggatcttgtgagtagtggaacaaccttacgtgagaataatttgaaggaaattgatggtggagtagttttggaaagccaggccacgcttgtcgcatgtaggagatcgctacacaaacgtaatggtgtcttggagattacgcatgagatgcttgaaagattagaggctcacctcacagcaactggggagataatggtcacagcaaacatgagggggaacagtgcggaagaagtggcggaaagagttctcagccaaacatcgttatgtggattacagggcccaaccataagtccagtctaccgctcacgtgatgggaaggttgctgtggaatattatgcgattaatgtagtagttccacagaagtctctttacaagtccattcaacagctgagatctattggtggcagtggagtcttggtgacaaagctgacctacatatttgatgaggaaactcctagatggcgcaaactactttcggagctggggttgtgacttggtgtgaagtctgccatacttctctgtcaatgacccttttagcatcggtttacttatgctcgctgaagtatactacaaccataatcagaaatgagctctcgtttgaagtgtctgcggtgcttatttgagaggaaattttggtctgtgccatcgtacattgtgctcgtctagttatacctttgacaagcatatgggttgaaataccctttatgtacctgttgatataattgtgagaccttattgccttgttggataggtgtgcgtatgaattgtaccttttcttgcgtgacgctgaataaattgggctttctgcaataaagatggatggtgtaattccaccccgtagcaaaaaaaaaaaaaaaaaactcgagactagttctctccctcgtgccgaattcctgcagcccggg

SEQ ID NO: 3477 - DNA, 1322 bp, Oryza sativa
  Clone ID: PAT_MRT4530_88198C.1
cccccgccgtccgccgccctgcacgggtagaagtagcgccgtgttgtagtgttgtgtagcagtagtccaccgctgagaagctagcaaagccagccatccattcagcgcagtactctcgggagagctagaagcgatctattctagccacaaggaggagagataaacgtatcgaaatggagcacatcgcgaggttcttctttggagtttccggcaatgtcatcgctctcttcctgttcctttcgccagttgtcaccttctggaggatcatcaagaagagatcaacggaggacttctccggcgtgccttacaacatgacacttctcaactgcctgctatctgcttggtacgggctgccgttcgtgtcaccgaacaacatcctggtgacgacgatcaacgggacggggtcggtgatcgaggccatctacgtggtgatcttcctcatcttcgcggagaggaaggccaggctgaagatgatgggtctcctgggcctcgtcacctccatcttcaccatggtggtgctcgtctccctcctggccctgcacggccagggccgcaagctcttctgcggcctcgccgccaccatcttctccatctgcatgtacgcctcgcctctctccatcatgaggctggtgatcaagacgaagagcgtggagttcatgccgttcctgctctccctgtccgtgttcctgtgcggcacctcctggttcatctacggcctgctcggccgcgaccctttcatcgcgatccccaatggatgcgggagctttctgggcttgatgcagctgatcctctacgcgatctaccggaaccacaagggggccacgccggcggcggcggccgggaagggggacgccgccgacgaggtggaggacgcgaagaaggcggccgccgcggtggagatggccgacgccaagaccaacaaggtcgtcgccgacgacgccgacgccgacgccgatggcaagtcggcggacgacaaggtcgccagccaggtgtgacgcgttcggggccccgcacggcgcccggccgacacgcacggaagaatgcagcttaaagcattgttgctgctgctggattgattagtggttaagcagattattgctgtcgcctttcttgatttttctttttactgatctctgtctctcgtgcccgatcgagagagtatgatactgtatttcccgttctgttcttgcaagcgtgaagccatttcccattttttttctaccgtacgatactgtatgccccccaggcccccataatgaagaagaatccgagcagaaatgcataaaaagaagaaaaaaaatctagtttaaaaaaaaaaaaaa

SEQ ID NO: 3478 - DNA, 4242 bp, Oryza sativa
  Clone ID: PAT_MRT4530_88374C.1
atggctcccatgctctcgatcgcctcccgctcgccctcgccggcgttgattgcacctcacgcctccgcccgcgccaccggtcttcgtgctccgttcgccggcaaccgcattgtggggtgggggtggggggatcaaaccaaatcaggtacggatcgtaatcgcgcatcgatctgtgtcgtcctgttcctgcgcgtccgctccggcgagcccacgcaggcgccgcgggatccccctgctgcggtaggcggcggcggctgctacgtccggctgccggcgccgccgcgagaccgggacgcggttttgtatcacgtttgcttgttcactctacttctctgcttcatccctatcactgctttggcggaatccgatatcaagaatttatttgctctgaggaaagcaatcgctgttggaaaaggcttcctccacaactggtttgagctagaaactcctccatgcaactggtcaggtatatcatgcgtggggcttactgttgtggccatagacctgtcatctacgccactctacgtcgattttccatcacagatcattgcattccagtcactcgttcggctcaatgtaagcgggtgcgggttttccggtgagcttccagaagccatggtgaatctgcagcatctccagcacctagatttgagtgataatcagcttggtggccctctacctgcctcattatttgacttgaagatgctgaaagttatggtgcttgacaacaacatgttctctggacaactaagccctgccattgctcaccttcagcagctcaccgtgctatccatatccacgaattccttctctggaggcctccctccagagctaggcagtctgaagaacctggagtacctcgacattcacacaaatgcatttagtggatcaataccggcatctttcagtaatctatctcggctcttgtaccttgatgcaaacaataacaatctcaccggatcaatattcccgggaataagagcgttagtcaaccttgtcaagctcgatttatcgtcaaatggtttggtgggggcaatccccaaggagctttgtcaactgaaaaatctgcaaagtttaatcctatcagacaatgagttaactggaagcatcccagaagagattggtaatctgaagcagcttgaagtactcaatctcctcaaatgcaatctcatggacaccgtccctttgtcgatcggcaatctcgaaatcttggaagggctttatatatcattcaacagcttcagtggtgagcttccagcatctgttggtgagctacgcaatctgaggcagctgatggcgaagagtgcagggttcactgggagcataccgaaagaactcggcaattgcaagaagcttactactctagttctgtccggcaataacttcactggcactatacctgaagaacttgcagatttagttgccgttgtcttgtttgatgtggaaggaaacagactctcaggccacattcctgattggattcagaactggagtaatgtttcatctatatcgcttgcgcagaacatgttcgacggacctctaccgggtcttccattacatctggttagtttctctgcagaatccaaccggctgtcaggatctatccctgccaagatatgtcaaggcacctttctgcagatacttagattgaatgataacaatctgaccgggagtatcgatgagacatttaagggatgcaagaaccttactgagctaagcttgctagataaccatctccacggagagataccagaatacttagctttgctaccactggtgtcacttgatttgtcacataacaatttcacagggatgatccctgacaggttatgggaatcatcaaccatcttggacatctctctcagtgataaccagctaactggcatgatcacagagagcattggtaagctcttgagcttgcaatcgttgagcatcgacagaaactacttgcaaggacctctccctcgatcgatcggcgctctaaggaatctgacagcactgtctctcagtggcaacatgctatctgaggacattccaatacagctcttcaactgcagaaaccttgtcacattggacttgagctgtaacaatctgacagggcacatccccaaggccatatctcacttgacaaagctcaacaccttggtcctgtcccggaatcggctgtcaggcgctatcccttctgagctatgcgtggctttctcgcgcgagtcccattctgaattggagtacgtgcaacacattggattgattgatctgtcgcggaacagattgactggtcacatcccgagagcaatcaacaattgttctatactggtagagctacacctgcaagacaacttgttaagtggcactatacctgtggaacttgctgagctgagaaacataacaaccattgatctatcttccaatgcattggttggacctgtccttccatggcctgtaccattggcaagcctccaaggccttcttctgtctaacaacagactcagtggctccattccttctggcattggcaacattcttccccagatcacaatgctggacttatcgggtaacgcgcttaccggcactcttccattggatctactctgcaaagagagcctaaaccacctggatgtcagtgacaacaacatctctggacaaatcccattttcctgtcatgaggacaaagaatccccaatcccactgatcttcttcaatgcaagcagcaaccatttctcagggagcctggatgaatcgatctccaacttcacaaagctgacctatcttgatctccacaacaacagcctcactggaagattgccatcagcaatagcaagggtcacttctttgtactatcttgacctatcaagcaatgatttcagtggcaccatcccttgtggtatctgcggtatgtttggcctgaccttcgcaaacttctccggtaaccgcgacggtggcactttcaccttggcagattgtgctgctgaagaaggcggggtttgcgccgctaaccgtgtcgatcgaaagatgccggatcatccgttccatgtactggaagcaaccatttgttgcattgcaacggccattgtcattgtgctggtggtgatcctggtggtttatctgagacgacggaggaagatgttgagaaggaggcagtttgtccttgtccctgccggtgacaacgccatggctgaccatgagacaaccttgagtaacaatcttttggggaggaggaggatgaagaagagggagccaccgagcatcaacctcgcgacgttcgagcacgcgcctgtgagggtcaccgtggacgagatcatgagagccaccgggaatttcgacgggatgcacgtcgtcggcgacggcggcttcggcaccgtgtacagggcggagctccccggcggccggagggtcgccgtcaagaggctccacggcgtcggccgccggttccagggcggcgaacgcgagttccgcgccgagatggagaccgtcggcaaggtgaggcaccccaacctcgtccccctcctcggctactgcgccgccggcgacgagcggttcctcgtctacgagtacatggagcacggcagcctggaggaccggctgcgcggcggcggcggcgcggcgctcgggtggccggagcggctcacgatctgcggcggcgccgcccgcgggctcgcgttcctgcaccacggcttcgtgccgcacgtcatccaccgcgacgtcaagtccagcaacgtcctcctaggcgagggcctccagccgcgggtgtccgacttcggcctcgcgcggatcatcagcgcgtgcgagacccacgtcagcaccgtcctcgccggcacgctcggctacatcccgccggagtacgcgctggcgatgcggtgcaccgccaagggcgacgtgtacagcttcggcgtcgtcatgctggagctgctcacggggcggccgccgacgtggtcgtcggcggaggtgacggcggagggtgacgacgagcgcggcggcggcgggagcctcgtcgggtgggtgcggtggatggcggcgcgcgggcgtggcggcgaggtgttcgacgcttgcctgccggtgtccggcgcggagcgggagcagatggcgcgggtgctcgacgtcgcccgcgactgcaccgccgacgagccgtggaggaggccgaccatggcggaggtggccaggagggtgggggcgatcgaggcgatggagtacgggcctctggtggtggcagtgtccagtggcgagccgccggcgatgccatga

SEQ ID NO: 3479 - DNA, 1143 bp, Oryza sativa
  Clone ID: PAT_MRT4530_88443C.1
gagacgcatctcgacgtgtccactgccgcagctgagagaatctggcgcaagaacgtcttctttcttccgctggatctatcaagcatgggccatggtgtaactgtcaacgtcattgatcgatgtgagctgcatgagatccccctgcaaaacaggaagttcacttggagtaatgagcgtcgaaaggcaacccttgtcaagcttgaccgttgcttttgcaatgaggaatgggatcttgctttcccccaccatgttctccatgcctttcctacagggccatccgaccattgccctcttgtactgtccaacccgcaaggcccacatcgtccgaggaccttcaagtttgaaaacttttggacacgggtcccggggttcaaggacaaagtcaaggacatctggagccaaccttcttcgcacactgagcctatgcaccacctgaatcaaaagctgcaacgtacggcggtcggccttagagattggacaaaaggcatctgctcagaggctaaattgcaattccatatggcactcaatgtcatccaaagactcgacgtggcacaagagcacagagaactctcccccccggaaacgcgactgagggcggctctcaagcggaaagtcctaggactcgcttctatagaaagggcaaggaaaaagcaagcctccagggtaactcacatccgtgaaggagatgcgaacacgaagttcttccacctcagggttaatgcgcgaaggagaaggaatacaatccaaagattgaaaaaggacagtggttgggcggtgacgcacggtgaaaaggaattgacgatccatgatcacttcgcaagcttcatggggaggccggggccgaggccaaacgagctaaactgggagacgttggacatcacaccgattgatctagccacgctgggggaacccttcactgaggaggaggtgcatagggcaattaaggaaatgccagccgacaaagcaccgggaccagacggcttcactggggccttcttcaaagtttgctgggaaatcatcaaggatgacattctgctagtcttcagctccatctataacctgagatcgcaagggcttcccgacaagatggatagactggctaggggctttactgtcgtcttcgacatcccaagtcctccttaa

SEQ ID NO: 3480 - DNA, 3172 bp, Oryza sativa
  Clone ID: PAT_MRT4530_88449C.1
tcgccgtcacctattctcgccttggccatgggaggatcgcgattcacgagctggagctggagctcgagcagtcaacagaagaagggaggaaaggaatcctccctcaccccacccgagcaggtattgggctcggaatctgaaggggaattggaagcggaagcggaagcggagccgattctgatgatctgatctgatcgaggccaggggactaatatcttgttgtaaggaacctagtggagtagtatttgatttgcctgctgcatcgacaccaatcaatctccccactactatggctctaggagtcgtcttctttcccttgccgtagggatttcttcctatttttggagatctcatagaccaacggcattaggtcttttggtctttggccgttaatccatgcggagtcccagaagcgcgttgtattcccatcgcccacagttatctttgttgaggcggcgaagaggtccctatccacaccatcacaaggcgtttccaaacccacccaaggcttgcttggatctctccattcgttccacaaccatcgcaatctcagagctcttgtgaacttgtccaagcttaggacaccaaggcccccctggctggtcggcaagcatgtctttgcccagttgaccttgcatttccccccggtgatatcccccgtaccagcccaaaggaagcgatgtctctgcttgtcaagctgctccagggattccttcgtcaccttcaaggcagtgaggagataaattggctgcgctgaaagcacagactttacaagcgtggttctcccggctactgccatgtttttccccctccaacttgcaactctccctgatattttgtcaaagaccggttgcaagtccgtttttcgcagccttcccagaacaagcgggaggcccaagtattttagtgggaaatttgcccgcttcgccggaacgccttggaggacctcttccaggtctatattgccgcatcttatagccgcaacctgggatttctgaaggttggtgacgagtcctgtggctgtgccaaaacgatgtaggatgttcgcgaaagtcgcaacatcgttccgggtgggattaatgaagatcacagcatcatccgcatacattgagatctgcagccgagttgttcttcctcgtaattttgaaattgcacccagctctgttgccttggaaaggatacgctgtagaggatcaatcgccaagatgaagagaagcggcgagagggggtccccttgccgtagtcctcttccatgtttgatccgttgccctggcgagccattaaggaggacttgggatgtcgaagacgacagtaaagcccctagccagtctatccatcttgtcgagaagcccttgcgctgcagcaaggctaggaggtaatcccatcgcacagagtcgaaggcttttgttatatccaacttgaagagcaacattgcccgtcttaggcggtggtatcttctggtcatgtttcttacgaagaggtagttgtcatgaatacttctcccctttatgaaagcgctttgattgaccgagatcaactcatgcatgtggggccttaaccacagcgctagcatcttagcgaagatcttggcgatgctatgaattagactaattggcctatagtccgaaacgctttcagccccatccttttttgggattaggacgatgtttgctgagttgagcaaattcaggtgcgcacatctcaggttatagatggagctgaagactagcagaatgtcatccttgatgatttcccagcaaactttgaagaaggccccagtgaagccgtctggtcccggtgctttgtcggctggcatttccttaattgccctatgcacttcctcctcagtgaagggttcccccagcgtggctagatcaatcggtgtgatgtccaacgtctcccagtttagctcgtttggcctcggccctggcctccccatgaagcttgcgaagtgatcatgaatcgtcgattccttttcaccgtgcgtcaccgcccaaccactgtcctttttcaatctttggattgtattccttctccttcgcgcattaaccttgaggtggaagaacttcgtgttcgcatctccttcacggatgtgagttaccctggaggcttgctttttccttgccctttctatagaagcgagtcctaggactttccgcttgagagccgccctcagtcgcgtttccgggggggggagagttctctgtgctcttgtgccacgtcgagttgttgcatttccacatatcatccaagacaagtaaaaatcttttaggatccagtctttcttcaatggatttttggagctgatccaagttggatgttttatgtgcttcactacttccctcatttccattttgacatatgccacctcaagatttcctgggtgagcccaggccttgtttttagagaagtgcgccactgtttttttgtggttgtataggtgttgggcaaaggtagtctttccgattccaccagggccaactatgggaagaactgatagtgtttcactacgaatggtgcacatgtcatcaagagtctggttaaagatgtcttcccgcccatataattcattctgtgtaattgttgagctgctgggaggtcgcttcagtgatagaacccttcctactgtaggatggataattttgagcaaattggatacatggttacatgcggcatctatgccttctattattgatttgattttctttgacatatctactcgattgaatgtcaacttgccaacatggtcaccggcaccatctcgtgtagaagaagaagaaaagcatgaaaggcagttaccaacggtacggtgaagaacatggtggccatggagtgcctggccacgtatgctgctgtctaccaccggggtggcctcatgggtgccatgaatttggtcctggatgatgaagtactggagctcatccagcgtgtcctcagcctcgtcagccttcttgctgagaatctccaaaagcccaggcaggccagggttgctcacgtccctcctcatctgagcctcgtggagcagcccttgcgtgaacatgagatcgctcttgatctgctccatgttgaggccaagctcggtgctggccacgtaggcctccaccaagctatcggacagctgcgtcaccaccttgccgacgagccagctcgccgcaccaacggccacctccat

SEQ ID NO: 3481 - DNA, 5867 bp, Oryza sativa
  Clone ID: PAT_MRT4530_88450C.1
ccctctcaacgtcacgggcttgcagatctggcccgtgaaacggttattggcccagacaaagagaggtagtccagaagctgatagccttgacacttcttgcagttcgcctcccacaggcggactagctgatcgagaaggttgattgtgatagataaacccgcatcgagggtcaggtcatgcacccaggagtcgtcttctttcccttgccgtagggatttcttcctatttttggagatctcatagaccaacggcattaggtcttttggtcttcggccgttaatccatgcggagtcccagaagcgcgtcgtattcccatcgcccacagttatctttgttgaggcggcgaagaggttcctatccacaccatcacaaggcgtttccaaacccacccaaggcttgcttggatctctccattcgttccacaaccatcgcaatcttagagctcttgtgaatttgtccaagcttaggacaccaaggcccccctggctggtcggcaagcatgtctttgcccagttgaccttgcatttccccccggtgatatcccccgtaccagcccaaaggaagcgacgtctctgcttgtcaagctgctccagggattccttcatcaccttcaaggcagtgaggagataaattggctgtgctgaaagcacagactttacaagcgtggttctcccggctgctgccatgtttttccccctccaacttgcaactctccctgatattttgtcgaagaccggttgcaagtccgtttttcgcagccttcccagagcaagcgggaggcccaagtattttagtgggaaatttgcccgcttcgccggaacgccttggaggacctcttccaggtctatattgccgcatcttatggccgcaacctgggatttctgaaggttggtgacgagtcctatggctgtgccaaaacgatgtaggatgttcgcggaagtcgcaacatcgttctgggtgggattaatgaagatcacatcatcatccgcatacattgagatccgcagccgagttgttcttcctcgtaattttgaaattgcacccaactctgttgccttggaaaggatacgttgggatatcgaagacgacagtaaagcccctagccagtctatccatcttgtcgggaagcccttgcgctgcagcaaggccagtaggtaatcccatcgcacggagtcgaaggcttttgttatatccaacttgaagagcaacattgctcgtctttggcggtggtatcttctgatcgtgtttcttacgaagaggtagttgtcatgaatacttctcccctttatgaaagcgctttgattgaccgagatcaactcatgcatgtggggccttaaccgcagcgctagcatcttagcgaagatcttggcgatgctatgaattagactaattggcctatagtccgaaacgctttcagccccatccttttttgggattaggacgatgtttgctgagttgagcaaattcaggtgcgcacatctcaggttatagatggagctgaagactagcagaatgtcatccttgatgatttcccagcaaactttgaagaaggccccagtgaagccgtctggtcccggtgctttgtcggctggcatttccttaattgccttatgcacctcctcctcagtgaagggttcccccagcgtggctagatcaatcggtgtgatgtccaacgtctcccagtttagctcgtttggcctcggccccggcctccccatgaagcttgcgaagtgatcatggatcgtcaattccttatcaccgtgcgtcaccgcccaaccactgtcctttttcaatctttggattgtattccttctccttcgcgcattaaccttgaggtggaagaacttcgtgttcgcatctccttcacggatgtgagttaccctggaggcttgctttttccttgccctttctatagaagcgagtcctaggactttccgcttgagagccgccctcagtcgcgtttccaggggggtgagttctctgtgctcttgtgccacgtcgagtctttggatgacattgagtgccatatggaattgcaatttagcctctgagcagatgccttttgtccaatctctaaggccgaccgccgtatgttgcagcttttgattcaggcggtgcataggctcagtgtgcgaagaaggttggctccagatgtccttgactttgtccttgaaccccgggacccgtgtccaaaagttttcaaacttgaaggtcctcggacgatgtgggccttgcgggttggacagtacaagagggtaatggtcggatggccctgtaggaagggcatggagaacatggtgggggaaagcaagatcccattcctcattgcaaaagcaacggtcaagcttgacaagggttgcctttcgacgctcattactccaagtgaacttcctgttttgcagggggatctcatgcagctcacatcgatcaatgactgcgcgaaaacgtctcatgcgtgcgaggttgaggttgctattgtttttgtccctagcacggtagatcatgttgaagtctccaaggatgagccatccttccccagggctgggccttaatctcctaatgtgccggaggaacgaatctttgaggtggtgccttgttggcccgtagacaccagtgaggaggaacgtaactcctgagcgaatatctgttatttgcgcggagatcgagaagcggccgattcgaacctcctggacatcaaaatctccactactccaaaggagaaggattcctcctctcgtgcctctcgccggcttgaaggcaaatttatcaagcttgtagcctcctaagaaacgagcaaggccgtcatctatgctttggagtttggtctcttggaagcaggccaaggtgcactttgtgtcgagcatgagctcatggactacgttgcagcgcgcaggtgagtttaggcctctcacattccaggagatgagataacagtctgtcggagcgggtgcaaacacaacagcacgcaaatggaagaggaggaagacgaagttcttgccaacattggcttcgccaactagagatatcagcgccgcatccattgtctcctgctcttcgtcgtcgatgccgaagatggtggtgagggcggcgatgacgtgcgccggcagtgggccatcgaacatggcgacgtactcggcgatgacctgctcaattgaagcgccttcttcgccgttgaggacgcccagccttttgaagagaacgcgttggcagcgctccatcgtcggccgtgctggttgcttggcaatgcgctcactgcgtcgggtgggctggctgtgctgccttgtgcggatcttgaggcgtcgtcccatgtggagcggtcgcgcacacggcgatcttggtggcgacctcggcggtgaggcgatgatcggttgcggcggcgaggcgaacagagcatcgaggacgcccgtcgagatcggtgacgccgaggctgctgcttgggcaagctgggtggcaaccggggaaggtggcggcggcgccacaatgtcgtcaatctccatcgcgccggtggggactaccgggccttgggctaatgccggcgaggtgacccgcgggggcggcgagtcaatctgcgggaatggctctcccacaggggggtcggtcgccgcagccgccagctcaatccgcaggagcgcctcctctacttgttggcaagtagtcgtcgaggtaggcggcggcagcgccgacttgatgcgcgcgaaggcgtgttcgaccgggatcggctcccaggccgcgttctggaaccaggcttcaatcctcggtttggctgggcgacccgagagggctggcgtggcagccttgtctgcgatgatggagagccactgcagttggctcaccggcgacaacgtgttcgtctggggttcctgacacaagaagctggagttgtgcagcgcgtggagcaaacgaaattcacctacctctgcctggttcgcggatttgtgtagaaggggaatgttcatcagtttgctcgagtcgtagaccggatcagccgtgcgccgcgtgccgccgccgctacggttggcgcctcccctgtcccagcgacgcggggagcgcgtgcgctcacggcggtagttgttgtcgcttccccgcctatcatcccggccacggccgagatcccggcctcggtcatcacgatcatcatcgcggtcattgcggcgccagggtctcgggtggtcattgccagacccccgacgacgaccacgcccgccgcgcccgccctgatcgcgggcatggcggccatcgcgatcagcacagccgtcgcggtcgtcgcgctcgccatcccaatcatcctcgtcatcgtggtcgccttcatcatgaaggtgtcctccccgtactgcgcgtccacggcggggtctgtccgcgcggccatcgatggcgtcgcggtcagaccggcgttctggccggcgagcctcccggcgctcgtcatcccgatcacgccctccgaggcgctcgtggaccgatcgtggcggcggcgggtggtgcgggaagtcttcaaagactcgccctgggacctgttcaccgtcgagcactcccaggctccaaggcggtaggcggcgcttggccggctggaagctgccttgcccctccaaatcaatggtcgccgccgtgtagtcatgaatctcctccaagtggaagagcaccggatggcgcacccccctctgccagtgctccagtgggttctccaccgcaaataggggcgccaggttcgggtccttcgcccgctttgtgaagccaagccacatcctcttcgggatggtgctaggattcgccgtccacgcccataggtcgatggagcgcgtgttaccagactccactgggtggacgacgtccgtctcgatctgttccagggcgcaagtgcgaccaatgatgcgctcagcaatgtccgcggcccaggcatgcatggggacgccgtcaagacacaaccgaactcggaacatcagggcgacaccaagcgcgctcttgaggctgcgccacttgatgaagtggatctcaatgccgtgccgcttgacgtatcccttcgccagcgcttcctcacaatgtcgacggtgctggaacttgatgaggaaagcttgtgggtgatggagagacacggccacctcgccacggcggagcttgaactcgtcgaggaaggcctgctcgacgtcgcgcggctcggtggtcggcggagcgcgggccgcccaggagaccaatcttagccaggggcggtcgcggaggcggcgtcgggggccgggtgacgggatcctgcttggcgggtgacggcagtggagcaggggaggcgcggttgcgtggcgaatgcgctggcgagcgggcgcgacgaggggcgggggggtgcgtgtcaggaaggcggcgcgtgttggtacgacggcgaggtggagtgcgttggcgaggcggaggcggggagtgtgaggtagaacgaactcgacgtggtggaggggacgagagccgagcacggtcagcgcgagaagcgccgcagagtcgaggcgcgcggttcgcagcgtcgcggtggcgacagtcgcgcgcccgatggccggagcgacggcagaggaagcagcggactggatctctacactgggctgcacggtggccgcgggagaggcaaatgaaacatttcccactgatctgcgcccaaaagtcgcggtgggagaggcagcctcgcctagtccggacgacgtcgtttcgccttgaaggtggccggtgcgccctgcttgaatgctctccgcttgaatgctctgcacgtctccaccaatgcttccgctgaacccggatccagcccggttctccggggagagagccgcccatgtcctgctcggcgacgcgacgcggaggcaggctagcatcgtagggagcagctctccgcggcgaggtgtcat

SEQ ID NO: 3482 - DNA, 3788 bp, Oryza sativa
  Clone ID: PAT_MRT4530_88573C.1
cgcgatctaggcttgccgcgcgcgcgcggatctgcgagctgcgtagccgtttctcgctgtgagtggaggaggaggaggaagggaggaggatggcggcgaacgcggggatggtggcgggatcccgcaaccggaacgagttcgtcatgatccgccccgacggcgacgcgccaccgccggctaagccagggaagagtgtgaatggtcaggtctgccagatttgtggcgacactgttggcgtctcggccaccggcgacgtctttgttgcctgcaatgagtgcgccttcccggtctgccgcccttgctacgagtacgagcgcaaggaagggaaccagtgctgcccccagtgcaagactagatacaagaggcacaaaggtagccctagagttcagggcgatgaggaggaggaagatgttgatgacctggacaatgaattcaattataagcatggcaatggcaaaggtccagagtggcagatacagagacagggggaagatgttgacctgtcttcatcttctcgccacgaacaacatcggattccccgtctgacaagtgggcaacagatctcaggagagatccctgatgcttcccccgatcgccattctatccgcagcggaacatcaagctatgttgatccaagtgttccagttcctgtgaggattgtggacccctccaaggacttgaattcctatgggattaacagtgttgactggcaagaaagagttgccagctggaggaacaagcaggacaaaaatatgatgcaggtagctaataaatatccagaggcaagagggggagacatggaagggactggttcaaatggtgaagatatccaaatggttgatgatgcacgtctacctctgagccgcatagtgcctatcccttcaaaccagctcaacctttaccggattgttatcattctccgtcttatcatcctgatgttcttcttccaatatcgtgtcactcatccagtgcgggatgcttatggattgtggctagtatctgttatctgtgaaatttggtttgccttatcctggctcctagatcaattcccaaagtggtacccgataaaccgtgaaacataccttgacaggcttgcattgagatatgatagggagggagagccatcacagcttgctcccattgatgtctttgtcagtacggtggatccactaaaggaacctcctctgatcacagcaaacactgttttgtccattctggctgtggattaccctgttgacaaagtgtcatgctatgtttctgacgatggttcagctatgttaacttttgaggctctgtcagaaactgcagaatttgctaggaagtgggttccgttttgcaagaagcacaatattgaaccacgagctccagagttttactttgctcaaaaaatagattacctgaaggacaaaatccaaccttcctttgttaaagaaaggcgggcaatgaagagagagtatgaagaattcaaggtacggatcaatgctcttgttgcgaaggcacaaaaagtacctgaagaggggtggaccatggctgatggcactgcttggcctgggaataacccaagggatcaccctggcatgattcaggtgttcttggggcacagtggtgggcttgacactgatggtaacgagttgccacggcttgtctacgtctctcgtgaaaagaggccaggattccagcatcacaagaaggctggtgcaatgaatgcattgattcgtgtatctgctgtgctgacaaatggtgcctatcttctcaatgtggattgtgatcactacttcaacagtagcaaagctcttagagaagcaatgtgcttcatgatggatcccgcactaggaaggaaaacttgttatgttcagttcccacaaagatttgatggcattgacttgcacgatcgatacgctaatcgcaacatagtcttctttgatattaacatgaaaggtttagatggcattcagggtccagtttatgtgggaacaggttgctgcttcaataggcaggccttgtatggctatgatcctgtactaactgaggctgatttggaacctaacattgttgttaagagctgctgtggtggcagaaagaaaaagagcaagagctacatggatagcaaaaaccgtatgatgaagagaacagagtcttcagctcctatctttaacatggaagatatagaagagggcattgaaggttatgaagatgaaaggtcagtgctgatgtcccagaagagattagagaaacgttttggtcaatcgccaatttttattgcgtccaccttcatgactcaaggaggcataccaccctcaacgaacccagcatctctactgaaggaagccatccatgttatcagttgtggatatgaggacaaaactgaatggggaaaagagattggctggatctatggttcagttactgaggatattctgactggatttaaaatgcacgcaagaggttggatatcaatctattgcatgccaccacggccatgcttcaagggttctgcgccaatcaatctgtctgatcgtcttaaccaagtgctacgttgggctcttgggtctgttgagattctgcttagcagacattgtcctatctggtatggttacaatgggcgtttgaaacttctggagaggctggcttacattaacaccattgtttatccaattacatccattccacttatcgcctattgtgtgcttcctgctatctgtctcctcaccaacaaatttatcattcctgagattagcaattatgctgggatgttctttattctgcttttcgcctccattttcgcaactggtattctggagctccgatggagtggtgttggtatcgaggactggtggagaaatgaacagttctgggtcattggtggcacatctgcccatctcttcgctgtgttccagggtcttctgaaagtgttagcaggaattgataccaacttcactgttacctcaaaggcgtccgatgaggatggtgactttgctgagctatacgtgttcaagtggaccagtctcctcattcccccgaccaccgtgcttgtcatcaacctggtgggcatggtggcgggtatatcatatgccattaacagcggttaccaatcatggggtcctctctttggaaagctcttcttctccatctgggtgatcctccatctctaccccttcctcaagggtctcatgggcaggcagaaccgcactccgaccatcgtcatcgtctggtcgatcctcctcgcgtcgatcttctcccttctgtgggtcaagatcgatcctttcatttcgcctactcagaaagccgtcgccttggggcaatgcggtgtgaactgctgatcggcaccgttacgaagatgaacttcaatcaatcaaggtctacccccccttgtgtaaatacctgaggggggctagaatgggatcttctttttgtgtagatgaagaccttttttatctaagttatgccactgtttattagctacttcagtgctggcgctagctgctgatacgatggaactgtgaagccttattttgcctgcgaagaagccagcccagcagcgtaaattgtgaatttttttcttcttttgtgacacccgttattttagtcatttgtttgaggggtcgttgttacacatactatgggatgttatttatacggatatattccaattacattcttttgcggtgaacattttaattatattcgtagcatataatgtaaggcaactcagtatttcagctgttcacttgacaagttgcaacacatataaaaaaagagttgtttgttcaaaaaaaaaaaaaaaaaaa

SEQ ID NO: 3483 - DNA, 1739 bp, Oryza sativa
  Clone ID: PAT_MRT4530_88663C.1
cgtttcgccaccgcgaatcccaccaccacccgcagatctccgcctcggcgccattgcccaccctccacgcccccgccagattcgcccagatccacagccgggtgcatccggcggcgtggctggggcgccctcgatcgggaagctttgatcttcgtaccctttttgcggtgggcgggcggcgggcggcggaggaagaggaggagatgggtgtcggcggggagaagttccagctggggacggtgggggcgctgagcctctccgtggtgtcatccgtctccattgtcatctgcaacaaggcgctcatgagctccctcggcttcaactttgccactaccttgacgagttggcatcttcttgtcacattttgctccctccatgtagcattatggatgaagttcttcgagcacaagcctttcgactcgagaactgtcatgggatttggagtgctcaatggcatctccattggcctcctcaacttgagtcttggttttaattctgttggattttaccagatgacaaagctggctatcatcccatgcactgttattttggagactcttttcttcaggaagaagttcagccggagtatccaactgtccctttcagtgctcctctttggtgtcggtgttgcaacagtgactgatctgcaactcaatgctgtgggatccgtattgtccttgctggcaattattacaacctgcatcgcgcaaattatgacaaacactatccagaagaagttcaaggtttcttcaacccaattattataccaatcttgcccctatcaatcactgaccctcttccttattggtccattccttgatggatttttgactaaccaaaatgtatttgcattcgactacacatcccaagttgtgtttttcattgtattatcgtgcttgatatctgtctcagtgaacttcagcactttccttgtgatcggaaagacttctcctgtcacttaccaagtcctgggccatcttaaaacatgcctagtactgacctttggttatgttttgcttcatgacccatttagctggagaaacatactcggcatcctaattgcagtagttggaatggtcttatactcatacttctgcacattggagggccagcaaaaaaacgccgaagtctccccacaacaggcgaaagaaggcgattcggctcctttgatctcagactctctgagcaaagttgagaatggaggtggagtggttgatgatgagcctctcaaggtaccgatgtggagctcaaagtactcaagggcgtgaaaataccttccttttagaaggcggcattatacaggattcaatttggtaggcggatagtagggttggaagccaacccagattgtaatgaacattccagttacatttttgggtttatttaacattactatctagtatctactagcagtaaaagggttcttgggaggattttaccttcaagatagcagatctgccttgaaacttagacaacagatattgtatgattgtatctggatatgctccacatctttctcactgtaacttcctatgggaacatagatccacagatagacttcattcttttgtaccaaagatccagagaactagagatctgcaaggttcaagtttgtgactgtaagtttatgtttactttggacccagtgatggagcttttgtatatttaggaccaagtgcaaagaggggttcttttccaacaagttttcaatgcaataacatggaacaattgttctcttc

SEQ ID NO: 3484 - DNA, 927 bp, Oryza sativa
  Clone ID: PAT_MRT4530_88712C.1
atgtcgcagcctgctgagctttcccgtgaggagaatgtgtacatggctaagcttgcagagcaggccgagaggtatgaggagatggttgagttcatggagaaggttgctaagacagttgactctgaggagctcactgttgaggagcgcaaccttctatcagttgcttacaagaatgttattggtgctcgccgtgcgtcatggcgcatcatatcatccattgaacagaaggaagagagccgtggtaatgaggatcgttgcacgctcatcaaggaatacaggggaaagattgaaactgagctctccaagatctgtgatggcatcctcaagcttcttgactcccaccttgtgccttcatccactgctccagagtccaaggtcttctacctcaagatgaaaggcgactactacaggtacctcgcagagtttaagactggagctgagaggaaggatgctgctgagaacaccatggtggcatacaaagccgctcaggatattgccctggcagagttgcccccaactcatcctatcagacttgggctggccctcaacttctcggtgttttattacgagatcctcaactctcctgaccgtgcttgcaatcttgcaaagcaggctttcgatgaggctatctcagagctggacactctgagtgaggaatcctacaaggacagcactttgatcatgcagcttctgcgtgataacctgacgctgtggacttccgatatctcggaggcgctccccatttatgttgtgctaggaaaccttgcagctgactcgctgcttggctggtggattctcgagctgcactttctttggggggagcctcagggtggaaccttcatgtcacttattggatcgattgttttcggtatgtcagttgtgagccttatctccagagtccacagtcctgccaagtgccctgcttga

SEQ ID NO: 3485 - DNA, 1427 bp, Oryza sativa
  Clone ID: PAT_MRT4530_88714C.1
ggccggccgggcgagatctcgccgaatttgaactccacctgagcacaggagaagccgcagccactgagatttgaccttctgtttctaccagaaaaacacaaacagtgaagatgtcgcagcctgctgagctttcccgtgaggagaatgtgtacatggctaagcttgcagagcaggccgagaggtatgaggagatggttgagttcatggagaaggttgctaagacagttgactctgaggagctcactgttgaggagcgcaaccttctatcggttgcttacaagaatgttattggtgctcgccgtgcgtcatggcgcatcatatcatccattgaacagaaggaagagagccgtggtaatgaggatcgttgcacgctcatcaaggaatacaggggaaagattgaaactgagctctccaagatctgtgatggcatcctcaagcttcttgactcccaccttgtgccttcatccactgctccagagtccaaggtcttctacctcaagatgaaaggcgactactacaggtacctcgcagagtttaagactggagctgagaggaaggatgctgctgagaacaccatggtggcatacaaagccgctcaggatattgccctggcagagttgcccccaactcatcctatcagacttgggctggccctcaacttctcggtgttttattacgagatcctcaactctcctgaccgtgcttgcaatcttgcaaagcaggctttcgatgaggctatctcagagctggacactctgagtgaggaatcctacaaggacagcactttgatcatgcagcttctgcgtgataacctgacgctgtggacttccgatatctcggaggatgctgctgaggaaatcaaggaggcccccaagggcgaatcaggagatggacagtgaacatgatcgaatgcgtgcgcccacaaactagaatagtgacgctgcaaatgtgctgtgggttatcgtttcattttatagattgtaatgtctcgtgatttgtcggaaacaggaggcgctccccatttatgttgtgctaggaaaccttgcagctgactcgctgcttggctggtggattctcgagctgcactttctttggggggagcctcagggtggaaccttcatgtcacttattggatcgattgttttcggtatgtcagttgtgagccttatctccagagtccacagtcctgccaagtgccctgcttgagtgtttttggtttcttcgatgtaaatcccgttgtgtgcacgatggttcttgattcaccacacattgttgtctacattgccaaaacgtatgcttcaagtgcccaaaaggccgaagcggtccgagaaacattattctgtcaggtatgtgtgataagcggtttcatatgcaacaaaaaaaaaaaaaaaaaaaaaaaaaaaaaaaaaaaaaaaaaaaaagcggcc

SEQ ID NO: 3486 - DNA, 4410 bp, Oryza sativa
  Clone ID: PAT_MRT4530_88759C.1
atggcggtgacgtcggatacagtgcttgatccgctgggcgggaagtcgcggggcgactcggctagcattggcgcgattgcgaccgacgacgggccatcaagggagccggcctggacagttcaagaggtgctggtaactgaagatgggcttgcagctgaggatgggcctacggatggagatgggcctgcagacggagatgggctgtcagctatcgtgctcccggcaactgaagatgggctcctggccactccagcgcgactgaccaggcccgttggcctgacggagtttccgttagtttacagccgccgcaggtgtccagcccaagcggtggccgttgaccagggcgctctggcagctgtcggtcgtcgggcacgcgaagagcgtgcgactgatgagaacgaggcaccaccggaggttcaagccagaatctcggccttcatttcgtcgatctccaccacaccgcctccatccatcctaggggggccgccggcctctgtcccagtcactaggactcgacgccgtgcaactatcctagaaggattcacgccatggcgaagcccgcggttggctctgcaggggaatgggacacggcggcacacgatctccaaagcccagaaggtgactatgaagaagttgggaattattgaggaggaagaagaggcaaaccaggaagcggttcaggaattcgagaagctctttgatgaaccgctgcctccgcatcatgtccaggccattgcagaactgttgcaaatcgacatggccgcaccccttcaacctctgcctgaagttcttccgggggtggaggagtccaagttgtccgctgtcaaccagtcgctaatttatgaactttgtggtctggattttgatgggttcgtgtttttgcccgctgaggagactagagggggagtaataattgcctggaagagtgctctgttccgaggggatgtggttcatattggcacttggtctgttactgttaatttgtgctggttggctgctaacagatcatggtccttaacttcagtttatgggccacaaggtgatgaagaaaagcttttgtttctggaagaattgtcagtgatccgggagatttgtttgggggagtggttaattgcgggcaatttcaaccttatcgctgcagcagaagacaagaacaactcgaggattaatagacgactgttgaatgccttccgaagcaagattaatgatttagaattgaaggaaatgtacatgtttggcagacgctatacctggagcagcgaacaagccagaccaactttggtgaagctggacagaattcttgtgacaacctcctgggaagatctctttcctgaggcgcatctgcaggctttgagctcctcaaactctgaccattgccctcttttgctgacatgtggtgagttcaaacctatctctaggaggtttcggtttgagacgttttggacaaaattagatggattcatggaagtggtgaaagaatcttgggagcgcagtgtggatagcaccgaccccttttgcattctgtatgtcaagatggcgcggttgagtaagatcttgtctaagtggggtcagaagaaaatgagtaatttcaggctacaacttcagattgcgaatgaaatcattctccgttttgatgtggcacaggaaattagaattctatctgacttggagcggcagctgcgagctgcgctcaaagggcgctgtttggctcttgcatcacttgaaagaattaggattcggcagcgtgccagggtcagaaaccttcgagagggagacgccagcactgcttacttcttcatgaaaatgaaatcacaccaaaggaaattgaagatactctggctggagcatgatggcgtcattgccaccacgcaggaggatatggaacagatggcgaagacccatttcgaatatgtgatgggggcctcacagggtgatttaaaacaaatccttttccaagaaattcatttggctagggcaaacttatctgagctggatgatgccttcacggaggaagaggtctgggctacaatcaaggccatgcagaatgagaaatcccctggtcctgacggcttcactggcctcttctatcagagatgctgggatgtaataaaaaaagaagtcctagaagctcttcataaattttgcacaggcaactcacaaaatcttgaactcttgaatacggccatcattacccttctcccgaagaaagatgcaccgacacttttgaaggatttcagaccaataagtcttattcacagctttgctaagctcgcaacaaagattttggccctcaggcttgcccctcgcatggatgagctggtggctcactcccagtctgcctttatcagaggccgttccatccatgagaatttcatttttgtgaaggggttggccacacaattccatcgaaatcacaaggcgatgcttcttttcacacttgacatctcgaaggcctttgattcagtgtcttggagctttctgctgaatatgctgcgttttagggggtttgggccgaaatggagaagctgggtggctgcccttttcttgacagctgaaactagggttgatctgaatggcgccctgggtgaatccttcaagccgcagaaaggtttacggcaaggagaccctctctctcctctcctctttgttttgcaaactaccaccattggcctcatcgacaaagtaaacttgaggaaccgagctccaaacatatcgatctatgctgacgacgctattatctttcttaagccgctggttcatgaggtggaagcggtaaaagctctgctgaatctgtttgggactgctactgggcttcacatcaatttctccaagagtgccgttacccccataagatgtgctgagtctcagaagacattggcgcagaacactctagcctgcagattggaagatttcccaattacttacctcgggctacctctctcgatcaggaagcctaccaaagcggaggttcaacccactcttgacaagatggctaagaaggttgcaggttggaaacccaaattactctcacctgacggtagactatgcctgatcaaatcagtgttgatggccattccggtccatttcctctctgttctacagctgcctaggtgggcgatcaaagaaatggaaaggcgccgtcgcgtattcttgtggaaggggcaggaagagattaatggagggcactgtcttgttgcttggagggatctgtgccggccaatttcaaatggcggccttggaattaaagacatcgatctttttgggaaagcattaaggatgaaatgggatttcaaaagactggagcacaaagataggccatggacaatggctggttgggggacggacagagatcttcaagacatcatcagctcaactgcagtccatatgctaggcgatggatgtgacacgaacttttggaggggaaattggcttcctggcgacgggagcatcgctagcagatggcccatcctattttcttttgtgggcagagctaatctaacaataagtcaggggttatccaataatacttgggttaggagactgcagggctccttgtcaggaagggcgttgctcgattatctagccctatgggatgaactgcagctggttcagctgcagcaaggggtggaggattctatcctttggaagttctcaaccaatgggcaattctccgttgcatcggcctatgagtttttcttccttacggcagtacgctgcccttatggggagatgatttggaaggctagggcaccagctcggggtgcactatccaatgaagcaatgggcgaattttttcagttatgggatgaggtccacgatttctccctgctcccatcgcctgacgagatcagatggaagctgacgggcgacgggaaattctcggcggcgtcggcttatgatgttttcttcatagctgctgaggactgcccctatggcgagctactgtggagatccagggccccctcgcgtgtgcgtttcttcatgtggcttgcgttgaaggatcgatgtctcaccgccgacaatcttgcgaagcgaaattggccgcacgaccccctctgctcgctgtgtcagagagaagacgaggattgccaccacttgtttgtaacctgtccttttacggcggaggtatggcgaaagatcagaagatggtgcaatgcaaactttgcaatcccggcagacggtgacagcagacttgctgactggtggcttgcaacgcgacgccgttttcggacgagctacaaagtggacttcgacagtgccttcatgttaatttgctggcttatttggaaggaacgaaatgctagaatttttcagcatgtgtcgatgaccacggagcaagtagccgagaatataaaagaagaaatcgcggtgtggagggtagctgggatcttctcccaattcggcgagtaa

SEQ ID NO: 3487 - DNA, 1897 bp, Oryza sativa
  UNSURE (1)..(1897): unsure at all n locations
  Clone ID: PAT_MRT4530_88764C.1
  unsure (1)..(1897): unsure at all n locations
ntnncgaggccggccggggaaanaaaaaaaaaaaaaaaaaaaaaaaaaaaaaaaaaaacccctctcatcaggcatcagcagcagcagcagcaacaacatttggccgctctgaagattggtgacggagaatgcccggcggctccctcctcaatagcggcggcatggcggactacggcggcggtggcggcagcggcggcggcctcacgttcccggtcgtggttacctgcctcatggcggcctccggtggcctcatcttcggctacgacattggcatctcaggtggtgtgtcggagatggagtcattcctggagaagttcttcccgggcttgctgaaggggacggcgcacgcgagcaaggacgtgtactgcatctacaacagccaggcgctcacggcgttcacctcgtcgctgtacgcgttcggcatggtcgggacgctggtggcgagccgcgtcacccggcggaccggacggcaggccgtcatgctgatcgggggcagcatgttcctggtcggcgcgctcgtgaacgccgccgcggtcaacattgccatgctcatcatcgggaggatgctgcttggcctggggctcgggttctcgggccaggccacgccggtgtacctcgccgagatgtcgccgccgcggtggcgcggcgggttcatctccggcttcccgctgttcatcagcgtcgggtacctcatcgccaacctgatcaactacggcacgtcgcggatccccgtgtggggatggcgcctgtcgctcggcctcgcggcgttcccggccgccgtcatggtggccggcgcggcgttcatcccggacacgccgagcagcctggtcctgcgcgggaagcacgacctcgcccgcgccgcgctccagcgggtgcgcggcaagggcgtcgacgtcgacgccgagttcaacgacatcctcgccgccgtggagcacgaccgcaggaacgacgagggcgcgttccggcggatcctgcggcgcgagtaccggccgtacctggtcatggccatcgcgttcccggtgttcctcaacctcaccggcgtggccgtcacggccttcttctccccgatactgttccgcacagtcgggttcgagagcgatgccgcgctgatgggcgccgtcattctcggcctcatgaacatcttcggcatcgtcggctcgggcttcgccatggaccgctacggccggaggctgctcttcatgatcggcggcgcgctcatgttcacctgccaggtggcaatggcgagcatcgtggggtcgcagctggggcacgggagcaagatggcgaaggggtacgcggtgacggtgctggtgatgacgtgcgccttctcggcgagcttcagctggtcgtggggggcgctgtactgggccatccccggcgagatctacccggtggaggtcaggtcggcggggcagggcgtggcggtggcgctcaacctgggcctcaacttcgtgcaggcgcagtgcttcctcgccatgctctgctgcttcaagtacggcaccttcctcttctacgcgtcgtggctcgtcgtcatgaccgccttcgccgtcgccttcgtgccggagaccaagggcgtgccgctcgagtccatgggccacgtcttcgcgcgccactggtactggggcaggttcgtcaaggaccacaagttcggcgacgtgtcgacctaaaatttgcaccgcatatgccgatgcggaatgtttggctttgatctcagaaatttagttagcgtgtgtgctctcgatcgtagtataaggctaagatggacgactttgggtaaattaatcaagaatgggcaatgtatgccactgaaatgttagatcaaactcaacggccacagccgtgcagctgcccatacatcacacggttcatcacaccaccaaaaaaaaaaaaaaaaaaa

SEQ ID NO: 3488 - DNA, 1726 bp, Oryza sativa
  Clone ID: PAT_MRT4530_88794C.1
gaaaaagaaaattcctatatcctctgttcgtcactgccttcctctccaagtccatccccttccccgatctaagatccatccgatccaggccatggcggcgaccatccagagcgtgaaggcccgccagatcttcgacagccgtggcaaccccaccgtcgaggttgatatttgctgctcggatggaacatttgcgagggctgctgtgcctagcggtgcatctactggtgtatatgaagctttggaattgagggatggtggctctgattacttgggaaagggtgtcctcaaggctgttgacaatgtgaactctattattggaccagcattgattggcaaggaccctacagaacagactgtcattgacaacttcatggttcagcaactggatggaaccaaaaacgagtggggctggtgcaagcaaaagcttggtgctaatgctatcctggctgtctcacttgctctatgcaaagccggagctattatcaagaaaattccgttgtatcaacacattgctaaccttgctggtaacaagcaacttgttttgcctgtgcctgctttcaatgtcatcaatggtggatcacatgctggaaacaagctagctatgcaggagttcatgatcctccctactggtgcctcatctttcaaggaggctatgaagatgggtgttgaagtataccataacctgaagtctgttatcaagaagaagtatggtcaggatgccaccaatgttggtgatgaaggtggttttgctcctaacattcaggaaaacaaggagggtcttgagctcttgaagactgcaattgaaaaggctggatacactggcaaggttgtcattggaatggatgttgctgcttcggaattctacaatgacaaggacaaaacctatgaccttaacttcaaggaggagaacaatgatggttcacaaaagatatctggtgatagcctgaagaatgtatacaagtcatttgtcagtgaataccccattgtctcgattgaggatccgtttgaccaggatgactgggaacactatgctaagatgaccgctgaaattggagagcaagtgcagattgtcggtgatgacctccttgtcaccaacccaacaagggtggcaaaggcaatccaggagaagtcatgcaatgctcttctgctgaaggttaaccaaattggatctgtcactgagagtattgaggccgtgaagatgtcaaagcgtgctggctggggtgtgatgaccagccacaggagtggtgagactgaggataccttcattgctgatttggctgttggtttggccacgcttcttaggattgaggaggagcttggtgcggctgctgtctacgctggtgccaagttccgcgcacccgtggagccctactaaccagatcaagactggagctccttgcagatctgagcgccttgccaagtacaaccagcttcttaggatcgaggaggagcttggtgctgctgccgtctatgccggagccaaattccgtgcaccagtggagccctactagatgggaatagaaccacttcgtttccgtaaattttgtgaagatggtgctttagatttgctcgtagggtttgagcaataattccccacggtcagatgtgggtggacatgctcccacaaaacgcttaattttgatgttgcgtggcgcaagcgtgatttgaaggaacgcaaatgattatattaaacgttataagcaaagttcaacaccatgtttggatc

SEQ ID NO: 3489 - DNA, 2770 bp, Oryza sativa
  Clone ID: PAT_MRT4530_89025C.1
gtcgactctagaggatccccatcttccatcccccaaaaaacctcgcaaaaccctcggccctcacccgccgccgccgccgtcgcctccaccggtaaacggcagcatgagtcggcaccctgaagtgaagtgggctcagaggattgacaaggtttacataactgtacaattagctgatgctaaggatgctaaggtcaatctggaaccagaaggtgtattctctttctctgctacagctggaactgatgggaacttatacgaatcaaagctagagttgaacgacaaagtaaatgttgaggagagcaaaataagtgtaggtgttaggtccatattctgtattgtagaaaaagctgaggccaaatggtggaagaagcttgttcgagatgatcaaaaggcaccacactttgtgaaagttgactgggacaaatgggttgatgaagatgatgatggtgctgatgtcaacgtggatggaatggacttttcgaattttggtggcatgggtggaatgggtggaatgggcggaatgggtgatatgatgggtggcatgggtggtatgggtggcatgggtggcatggctgagatgatgggtggcatgggtggtatgggcggtatgggtggcatgggtggcatggatgagttcgaggacgagagtgacgatgaaggaagcattatttttgcagtttggtatgatactaaccttaatcacatgcatcaaaagtttcttaaccattatacttacatactggttaggaaactttttgatgcatgtaaagttagtgtcactaggtgcagattaaggatgtcaggtgatatgcccattcgtctgtattatggcgatgctcctatacaaatatgtgatagcggggtggatttgactgtatatgccttccatgatactagtctgaatgcaccggagcatatgggtttgaacgacgtgttagggtggttgtataatatgtttggggtagatccagtgcacgataaatttgtcataaataccgtgtggccagtgaggggtcaacatgaatggcagtggagagtagtggaggttgcgtcaactgggagttggaggaagtttgttagtaaagtaagggagaaaggctatagcctggcaatagtggtgcagaagacaacatgtgttgatcgatcgggggagtcaagtcatgccgtggtggaagaaactccgttggaaggtggacaagctgaaaatgtttggcggactgagcaaggtcgaggggaagaagtagtagagggtaatacacaaggagaggtcattgttcgtggtactaatcgtgaggccaacgactcggacgatgaagaaccggattcgcctatgcgtgttgatgcagcggaggagaatgaggtggtagtggatcagatggaagtggaaaacgaggaataccttgcgcttgtagtggaaggagaagatacaacactgtgggacaacgaaactaacatacccgatgattggacgaccatatcaatgagtcgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtaggttcgagggttgagcaacatacgtgtttattggagaatacccgtctggtgcacagaaacctgacagcggcatttgtggcacaaatggtatattcaaaggtggttagaaaaacatctttgtcccctttcaccataatgcatgacgttgagaaagagtacggatatgagatatcgtacgacaaggcttggagggcaaaacagaaagcattggagatgaggtttggaactcatgaggattcttatcacaatcttcccccactattggaggtgatgcaggcaagaaacccgggcacacacatggctattctcgatgaggtgaatgaatatggggagaatattcttcgtcgggctttctggtcatttgggtgcatgatagaggcctttagaaattgcattcctttgctctgtgttgatggcactttcatgacaggcaagtacagaggaacaattctaaccgcgatcggagtcgacacggatagccatgtcgttcctgttgcttttgcatttgttgaaagcaagaacacatcaagctggctatggtttttgcggcacattaaaatgtgtgttgttgaaaacagactaaatgtgtgtgttctgcatgaccgacacgccggtttgctatcagcgatacagaagcttcaagaagatgtcacacagtccgtgccatggccagatttacatagcagatggtgcatgcgacattttggggctaatttttatagacaattcaggaacgatgagtacggttcggcgtcgacgcatcacggaatgcctgcttactcccctcgcacagcattcattgaggacttcttttccactgatcctccccagggggaagtagggatggattactggcacgcagcacctcaggtcacacagccgacgcaggagacggaggccggtcaggggccagacgtgacaccacagcaggcagctagagataggctcccccctgataatttgacatatcccactgagcagattaggcataggaagaagggaggacctagcaagcgtgcgaagggcactgatcgtccttga

SEQ ID NO: 3490 - DNA, 3980 bp, Oryza sativa
  UNSURE (1)..(3980): unsure at all n locations
  Clone ID: PAT_MRT4530_89052C.1
  unsure (1)..(3980): unsure at all n locations
atggattgcaacaaagatgaggctgttaaggcaaaagctttggctgaaaaaaaaatgcgggagaaggatttcgctggtgcaaaaaggatgattaacaaggcacaaaatctctccaaagatgttgacagcaacatttcacaaatgttaactgtttgtgatattcattgtgcttctgcaacgaaggttaatggagagattgattggtatggtatacttcaagtacctgtcacagctgatgacacactaataaagaaacaatatcgtaagcttgctcttttgctacatccagacaagaacaattttgcaggtgcagaggcagcatttaaattagtgggagaagcaaacatgacgcttacagaccgctcaaaacgttctgtctatgacatgaaaagaaatgcctcagtcagaattggttctgcaagagttccttatcagcaatcaaggagaactgcacctgttagacctaccactacacctgtgaatctccataatgtgcatcaatcacaacagcataagccctcaaatccttcagactcacaaacattttggaccatatgcccaacttgtggcatgcgatatcaatactacctttcaatattgaagaaagctctccgttgtcagaattgcttgaagccctttgttgcacttgatttaaacgagcaagctgttccttctggggcaaatcagaggtctgctggggtgtggaaaagttcaggagcaccacaaaactttccaggttcacaagcaaatgtaggacagcaagctcagaattctgccaatccagtccatgctaattttggttctcataatgcacatgtagaaacaaagaggggagctgatggaaacgaggctggtgggctaaagaacaaaagaaaatttgctaaggcaacagggaattcttcaaaagcttcttcagttgctggatcaaaaaagcgcagaaaagctatgtttgaatctagtgaatctagcgcttcagacaccagcactgatagcgaagaagagattattgaagatggtcctgctgcaagtaatgtagggccagatcaacatccccgcagatcaagcaggcagaagcaagaagttaagtataatgaagatagcgatggtgacgacactgactgtcacggcaatggtgatgatggttttgtgagttctcccagtttgaaaaggttaaggaaaggcggtctgtttcatggtggtgaaaacaatgaaactaagttgaatgctgacacaactgggcctgggcatgatggtccaactaatggtgttaataattacaataatacagaagacatagagagaggctctgcttgtgctgagcaaatcaagagggaaacaatgtctggtggaggaaatagtgctgagaaagaaaaattatcccattctgtcagcaacaatggtctagagtcaaactctgatgatgctccaaatgaggttatttgtgcggattcagaattttttgacttcaatcaacttcgacatataaatcagtttaaagccaaccagatatgggcttgctatgatagtcaaagctgtatgccaagatactatgctcgaattacaaaagtaaaacatgtcccgaagtttatgttaaatttcatttggctggagtttgatcccaaaaataaagcagaggctgcttggtcttctggggacctaccagtgtcttgtggacgttttaagcatggagtgtcagatacagcaaaagagagcagtatgttctctcatgccattttctatgaaaaaaacaagacaagaaactcttatgaaatatatcctaggaaaggcgaagtatgggctcttttcaagggttgggatattgattggagtgcagatgctgacaaacacaaaaactatgagtatgaagttgttcaagtcctctctgatctcactagtagcactagcatcattgtcatgccacttgtaaagataaaaggctttgttagcttgtttattcagtctaaagaggcatccccatatgtgatacctcaggatgacacactaaggttttcacattgtgtccctcgtcatacgatgattggaaccgaaaaagaagggattccagaaggggctattgaacttgatcctgcggcgcttcctctgaactttggagtggcttttgcttctgttgttccagaaagctgctgttcagtgaaagtgcagggttctggtgctgaacacataggttcatccagtggaaataactgtcacaagggatcggtggatgttggggagagccaacatgctacatgcgcaaatacagggttcgctacaaggacaacaaaggcagagatcaatgagcacaacgctcgatctgcagtagaaggtacagatgatgacgaggaacctgatgattttgcccaagcagaagtactatatcctgaatcagaattctttgaattttcagaaataagatcgatccacaaatttcaacctgggcagatctgggctctctatagtgatgtagataagttccccaattactatgcctgcataaaaactgttgatgtcaagaataatgaactgcaagtaagatggcttgatgcttgcccacagagtgaagaggagagaagattggtaagagaagatctaacagttgcgtgcggaacctttaagatttccagtttccatggtattcaaacttacaatggtacagagtacttgtctcatcctgtacaggccaaacctggtagaagaaatgaatatgaaatagttccttgccaaggtgatatttgggctgttttcaagaactggaggactggatggaccgcaaaagattataagaaatgtgactatgaattggtggagatatttggccacactgattcatccatacaagttcagcttttaagaaaggtggatggttatagggcagtatttatgccagacagaagagagggagctgtgaagacaataaggaaagatgagtacccaaagttctctcaccagattccttgcttccatctgacaaatgaaagaggaggcaagcttcgaggttttttggagctcgatcctttgtcagtgccagagatgtttcttttcaccgaatcaatctgagataagccttatcccaagttaatctgctagagcatttcttgtgatgctaccggaactaaaggttttccagaagttgggtagtccacaattcaatattttgcttagtgacagaagctgctggattttcagaatttgtatgtagcagtaatgttatgggccgcagcttttgcctattctccaatcctcactatgaaggcgttgtcaggcaatcgggaccgttttgcaagattagctgcagtctgaactgattaattttcctgcagctgctttacctagttaccgatagctgtatctagttctctagctggactatcaatcgtcctttctcttgtcgtactttgcattgttggaccatgtaaaattgaactgtgcgaggccagtctgattaattcggaaatctctgttggcctccctttcctggaacttaatgaattgagtccaacttctgtttaggttgcccttgatcatcataggggtaacgatgaactagattctgtgcaatgcttctgtgatgggaatggacagacaccctgctgcagctctcccaaggtatcattcgtccatttattgatttgtttctctgctgttttctttccagcaaggtaaaggtttgttggcatccatttgatttgatcttttagttttggatgttggtangctgtgtagctgttgctctatgaacagtttcaaatctttagaattgggatttggacctcgagcctgtgatttaggtcttgtttagaacaggtaggaatttgtgggaaatttagttcagttttagttgtatgaaccatacaaaggttagacttcatctctgcttatccgaagtctttgatgtaatggtgcatctctgaacacatggtctctaagatagattaaggtttaatctaagatctctgtgctgattccaaaaaaaaaaaaaa

SEQ ID NO: 3491 - DNA, 3557 bp, Oryza sativa
  Clone ID: PAT_MRT4530_89113C.1
ccggccggatccgacgccgccgaaaaaacctcgcaaaaccctcggccctcacccgccgccgccgccgtcgcctccaccggtaaacggcagcatgagtcggcaccctgaagtgaagtgggctcagaggattgacaaggtttacataactgtacaattagctgatgctaaggatgctaaggtcaatctggaaccagaaggtgtattctctttctctgctacagctggaactgatgggaacttatacgaatcaaagctagagttgaacgacaaagtaaatgttgaggagagcaaaataagtgtaggtgttaggtccatattctgtattgtagaaaaagctgaggccaaatggtggaagaagcttgttcgagatgatcaaaaggcaccacactttgtgaaagttgactgggacaaatgggttgatgaagatgatgatggtgctgatgtcaacgtggatggaatggacttttcgaattttggtggcatgggtggaatgggtggaatgggcggaatgggtgatatgatgggtggcatgggtggtatgggtggcatgggtggcatggctgagatgatgggtggcatgggtggtatgggcggtatgggtggcatgggtggcatggatgagttcgaggacgagagtgacgatgaagaagaagtgtctaaacctcaagacgcagagaaggatgggcgttcgacaggccggtttaaagccccgtctccccagcccgcgatgcttgttcgatttgtttgaggaccacatcgccagccgccgtcgagagtcgccacatcgtcgccgtgatatgcccattcgtctgtattatggcgatgctcctatacaaatatgtgatagcggggtggatttgactgtatatgccttccatgatactagtctgaatgcaccggagcatatgggtttgaacgacgtgttagggtggttgtataatatgtttggggtagatccagtgcacgataaatttgtcataaatgccgtgtggccagtgaggggtcaacatggatggcagtggagagtagtggaggttgcgtcaactgggagttggaggaagtttgttagtaaagtaagggagaaaggctatagcctggcaatagtggtgcagaagacaacatgtgttgatcgatcgggggagtcaagtcatgccgtggtggaagaaactccgttggaaggtggacaagctgaaaatgtttggcggactgagcaaggtcgaggggaagaagtagtagagggtaatacacaaggagaggtcattgttcgtggtactaatcgtgaggccaacgactcggacgatgaagaaccggattcgcctatgcgtgttgatgcagcggaggagaatgaggcggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtagcttcgagggttgagcaacatacgtgtttgttggagaatacccgtctggtgcacagaaacctgacagcggcatttgtggcacaaatagtatattcaaaggtggttagaaaaacatctttgccccctttcaccataatgcatgacgttgagaaagagtacggatatgagatatcgtacgacaaggcttggagggcaaaacagaaagcattggagatgaggtttggaacttatgaggattcttatcacaatcttcccccactattggaggtgatgcaggcaagaaacccgggcacacacatggctattctcgatgaggtgaatgaatatggggagaatgttcttcgtcgggctttctggtcatttgggtgcatgatagaggcctttaaaaattgcattcctttgctctgtgttgatggcactttcatgacaggcaagtacagaggaacaattctaaccgcgatcggagtcgacgcggatagccatgtcgttcctgttgcttttgcatttgttgaaagcgagaacacatcaagctggctatggtttttgcggcacattaaaatgtgtgttgttgaaaacagaccaaatgtgtgtgttctgtatgaccgacacgccggtttgctatcagcgatacagaagcttcaagaagatgtcacacagtccgtgccatggccagatttacatagcagatggtgcatgcgacattttggggctaatttttatagacaattcaggagtaagagattgatggacctgttcaagaagttatgcaagcagaatcaacaaagaaagtttgatgccatatgggagcaactggatcgtttgaccactacacacatggaagaggttaggaaaaaacccatagttgccagacaggaggagccggagggacttgaacccattcctaatgaagcaccaagtattactcggcgcaggaagcgtggaagggccacgaagtgcttcacggagtgggtagaatttgagccaagggagaaatggtcgttgttgtacgatacagatggatcaaggtatggtgtgatgacaacaaatcttgctgaagtgtataactgggttatgaagaatacacgacctctaccacttgttgctatcctggagggcatcacgaggggtacacagaagtatctctgtaaaaggtattccatggctagtctgaacctcagcaaacccagtgttaagtatagccccgctattacacagtacatggatgagaaaagtaagaagggaggaatccacagagtgtggcatgctgggaatagagagttgttatttgagatacgacttcgtgacaagagtggtgtcggcattgggactactgacatcacattggaatgcacgttgtggccagagtatcacgcttgcaaatgcaattgcaacaagccttacctgttacatcggccatgttcccacgttcttgctgcttccgcaaaagggggtgttgatggaaacatttttgtttctccctactttagaaaggaatcgtgggaggcaacttggcgtggtgaattgcgtggttggcgtgccgtgtgtgatttcactcgtcctcctccagggcaagccaattgggttcctgactcaaatttattagttgatactaagggtcatcgccagtcacgcaggatcaagaaccttatggatgaagctgaagtgaaagatcgttctcgtcgtatggctgatcaaaatgatgggcagctgatagacaaggagatcgataggaaccagagcagggccacacacagcacacatggggaagtagggatggattactggcacgcagcacctcaggtcacacagccgacgcaggagacggaggccggtcaggggccagacgtgacaccacaccaggcagctagagataggcacccccctgataatttgacatatcccactgagcagattaggcgtaggaagaagggaggacctagcaagcgtgcgaagggcactgatcgtccttga

SEQ ID NO: 3492 - DNA, 1569 bp, Oryza sativa
  Clone ID: PAT_MRT4530_89433C.1
gtggaatctaattaattcaattcacatcagatgaacagaagaagacaactttggaaagaaacagaacttattactatgtactattagataattgtacatacttgaatgatctctagacttaatttcctaataaggctgtacatatacagctcgatcttgatcgatcatttgcaatctctgacctgacaaacttctatgcaaaataaagacaaaaaacaaaaaaagaaagtcgaagatagaacagctctaaatcgaagatgaaacaacagacgatgaacaacaaaaaagatggaagagaagaagatttgatttgatctatatatgaatttgatttgatgctataacagcagggcacctagggcaggagtacgctgatgaaccacgcattgcctcttcagtaggaagacctcttgccccatctccaccgccctctcccgcttccggcaatcgccgccggcgatgtcgacgccgaagagcctcacgacgcgtggttcggcgccgcttgtggttggcctctcgtcgccggcgcaggtggtggtcgccgccgccgcgttgttcttcttgcagtcgatgaagagcagcttgtcggggccgtacgccgagcgggagaagactatggtgtcgccggcgcggaggcccttctccctcacgaatcggctccaccccttggtcagcacgtagctctggctgctgttccagtacgagtaccggaatcgccacaccttcccctcgccgtcctcgaagttgaggagcacgcccttgccggtggcggcggcggaggcggagtcggagctcgccgcgcggcggagcgggaagtgcttctcggcgtgctgcttgggcaccacgaggcggttgagcttgccgacgtcgctgggcgtcacggccttctcgaacagcggctcgcgcgcccacgacggcgtgggctgggcgcgggcgcccatgccgcggccgcggcggagcccctggcggagctcgtcggcgtaggtgtgcttccggagcatgtcgacgatctcggccttggagtgcgcggcgaggaacgcgagctcggcggccgacgccgcggccccggggaagttggtggccgcgtcgcgcccccggtaccggagcgccgccacgtcgtaggcccgcgccgccgcctcctcgtcggggaacgtcccgagccacacccgcgcgtgccgctcgtagatctgcgccccccacctcccgttcggctgcggcaccacccccttgtaccgcgacgactgctgcgccgccgccgccgccggcctcgacgtcaccacctcatccgccgagtcaactcccttcaccaccggtagctgttgagccgccgccgccaccgccaccaccggctccggcgacatccgcacggcgccgccggactcggtggtggccgtggacgcgccggaggaagtcgaggagaagctgaccacccccatcttggcaccaagaaagctctagctctagctaagctatggctgcagcgagagagagagagagagagagaggagaggagagagaagcaagtaattagggcagtgaagagggagaagccaaagaagatcctcgtgc

SEQ ID NO: 3493 - DNA, 2316 bp, Oryza sativa
  Clone ID: PAT_MRT4530_89498C.1
atgccacgcaaggttgtctctgggcctgactacgatgacgagtacgacgatgactatgatgagtatgatgaggactacgatgattacggtgagaccgggcacagtgacgacattcagcaccccgtgaaggaggagaaagagtcatcgaagaagtcctcaagtacggtgcctgtgctttggagatgctccatgtgcatgttcgataatcatgaaagcatggtgtattgtgagatgtgtggggtttttcgagaatcctttatgaaatctgccaaggatggttcaataaaagtccatgggataccaagtgattttgggacaccttcgatgccgaaatctgactgtaccaagatgccagtgaatactcgtactacagactttgatggtgaccctgagataaagaatgctagcatatctcatgagaaagttggttccacgcagtacacatctgctggtagctcatcaggcgctgggaaaaaggtgaaacacattgcacttcctgaagatgtgcctgtcgagaggacagctcaattgatttctgatcattttcagctgaaggaggaccagagtagtagggctagcagttctgcgcagaatgaggatgtggcccagaaactttcttctgacatacagaagctaggtttagaaaagaatgaagtagatactgcaaaaccttatttacctgaagaatataagcctgagaagtggatgttcgctaatgaggaatcaggagtgctgagccaactaaaccttgcaatagtaggtcatgttgattctggcaagtcaacactctctgggagactgctacatctgttaggaaggatatcgaaaaaagatatgcacaagaatgagaaggaggctaaagaaaaaggaaaaggatcatttgcttatgcgtgggctatggatgaaagcagtgaagaaagagaaagaggcgtgacaatgactgtggccgtggcttatttggagactaagaagtaccgtgtagttttgcttgactctccaggccataaagattttgtaccaaatatgatatctggcgcaacgcaagctgatgcagctattcttgttgttgatgcttgcactggttcatttgaagctggcatggacggtgaaggagggaaaagtgttggccagacaaaagaacatgctcagcttattagaagcttcggcgttgaacagcttattgttgcggtcaacaagatggatgccatcggctactcgaaagaaagatttgagttcatcaaggttcaacttggtagttttctgcggtcatgcaatttcaaagattcatctgttacctggattcctcttagtgctgttgaaaatcagaatttgatcaaaattccttctgatgtccgtttaacttcctggtatcaaggattttgtctcttggatgctatagattccttgcagcttccatctcgggatgtttcaaagcccctcattcttcctatctgtgatgttatcaagtctcagtcaacagggcagtttgcagcctttggaaaattagagactggagctattcgaattggttcaaaggttttaatttcaccttgtggggaagtggcggcagtgaaatccatcgagcgggattcaaattcatgtgacatagcaagagctgtgcctgtctctaacttcttggagctaagggttctagtgttagacgtcaccattcgtatccttattggctatcaggtcgaatttcacatacatcatgtgaaggaggctgcgagggttacgaaaatcgtggcattgcttgacaaggctggcaaaccaagcaaaactgcacctcgttttcttaagtcaaagcagaatgcagttgtgcaggttaccttagacgctccggtctgtgttcaagaattctccaaatgccgagctcttggcagggcattcttaaggtcttctggaagcacgatcgctgttggagtcgtaacgcggccgtgctttggggcccatattgtagctgactcaaaacgagacataaaggatccagagcacccatactcactcgaagagcttaatgttgtaactgaggattcagttgaaatcaatgatgaacttagtcatgtcagggttacttttaccccaacagtggagcgttgcagtatggcgaccgtcattggactttgcctgcgtgtgaaacttatgcggagtcttccccctcgatacaaggtggacataagggtggcgcctggatcacatgcaactgaaactgcagtgaacaagcaactgaacgacaaagaacgtgttgcagctgctctggaaaatccaaaccttctggacattgttgaggagtgcttgtcaccaacgtttgcttga

SEQ ID NO: 3494 - DNA, 3255 bp, Oryza sativa
  Clone ID: PAT_MRT4530_89500C.1
ctagctctcgtccctcctgtaccaatcgtcgtcggcggttgtggtggcatctccgacgagattccctggtgaggtcgtacgtgctccacttctccccgtcgacagcgaatggagtggctctctcccaggccgcgccatcaacgccgccgcgctcccccgctccggtcgccggactccaactccggtaaccctccagtacccgctgccgccgcgaatcggttcccctggctcccacgagcctgctcctgctaaccctagccatccgcctcctgctgctgcagcccccatggagatggccggtggaaaacacagcacaactggtggctgcaccctatccccattgaggctccccctggactccggttcaaggattctcctattggaactctagcttctccccttgcagttgatgtaccaactcagctcctcctcctggagctgaaacccctctcctcttgaagctcaggtacgccgctgtgtcagcaggatgccacgcaaggttgtctctgggcctgactacgatgacgagtacgacgatgactatgatgagtatgatgaggactacgatgattacggtgagaccgggcacagtgacgacattcagcaccccgtgaaggaggagaaagagtcatcgaagaagtcctcaagtacggtgcctgtgctttggagatgctccatgtgcatgttcgataatcatgaaagcatggtgtattgtgagatgtgtggggtttttcgagaatcctttatgaaatctgccaaggatggttcaataaaagtccatgggataccaagtgattttgggacaccttcgatgccgaaatctgactgtaccaagatgccagtgaatactcgtactacagactttgatggtgaccctgagataaagaatgctagcatatctcatgagaaagttggttccacgcagtacacatctgctggtagctcatcaggcgctgggaaaaaggtgaaacacattgcacttcctgaagatgtgcctgtcgagaggacagctcaattgatttctgatcattttcagctgaaggaggaccagagtagtagggctaccagttctgcacagaatgaggatgtggcccagaaactttcttctgacatacagaagctaggtttagaaaagaatgaagtagatactgcaaaaccttatttacctgaagaatataagcctgagaagtggatgtttgctaatgaggaatcaggagtgctgagccaactaaaccttgcaatagtaggtcatgttgattctggcaagtcaacactctctgggagactgctacatctgttaggaaggatatcgaaaaaagatatgcacaagaatgagaaggaggctaaagaaaaaggaaaaggatcatttgcttatgcgtgggctatggatgaaagcagtgaagaaagagaaagaggtgtgacaatgactgtggctgtggcttatttggagaccaataagtaccgtgtagttttgcttgactctccaggccataaagattttgtaccaaatatgatatctggcgcaacgcaagctgatgcagctattcttgttgttgatgcttgcactggttcatttgaagctggcatggacggtgaaggagggaaaagtgttggccagacaaaagaacatgctcagcttattagaagcttcggcgttgaacagcttattgttgcggtcaacaagatggatgccatcgggtactccaaagaaagattcgagttcatcaaggttcaacttggtagttttctgcgggcatgcaacttcaaagattcatctgttacctggattcctcttagtgctgttgaaaatcagaatttgatcaaaattccttctgatgtccgtttaacttcctggtatcaaggattttgtctcttggatgctatagattccttgcagcttccatctcgggatgtttcaaagcccctcattcttcctatctgtgatgttatcaagtctcagtcaacagggcagttggcagcatttggaaaattagagactggagctattcgaattggttcaaaggttttaatttcaccttgtggggaagtggcgacagtgaaatccatcgagcgggattcaaattcatgtgacatagcaagagctggtgataatgtagcggttagtttacagggcatcgatgggagtaagctaatagcaggtgggattctttgcaaccctggtttcccagtgcctgtctctaacttcttggagctaagggttctagtgttggacgtcaccattcctatccttattggctatcaggtcgagtttcacatacatcatgtgaaggaggctgcgagggttacgaaaatcgtggcattgcttgacaaggctggcaaaccaagcaaaactgcacctcgatttcttaagtcaaagcagaatgcagttgtgcaggttaccttagacgctccggtctgtgttgaagaattctccaaatgccgagctcttggcagggcattcttaaggtcttgtggaagcacaatcgctgttggagtcgtaacgcggccgtgctttggggcccatattgtagctgactcaaaacgagacataaaggatccagagcacccatactcactcgaagagcttaatgttgtaactgaggattcagttgaaatcaatgatgaacttagtcatgtcagggttacttttaccccaacagtggagcgttgcagtatggcgaccgtcattggactttgcctgcgtgtgaaacttatgcggagtcttccccctcgatacaaggtggacataagggtggcgcctggatcacatgcaactgaaactgcagtgaacaagcaactgaacgacaaagaacgtgttgcagctgctctggaaaatccaaaccttctggacattgttgaggagtgcttgtcaccaacgtttgcttgagacctgaatacaagtatacaactgggagcctgtgtgttgaaatgtttcaaaactacactgaattaccctacgacgtgtagcatgaccttgtcatttgagataccttatgtggtgcagggcgtgtgcatgaattttgatggtctgtacctttctataaggatactactgctctaccgtttcataccttttttctttttatggcctgtgacctgccagagcataattgaaacgatataaggaaatactcgtatatgaagtatattgcgctgtaggctttttacctctcgaatatgaagtactgtctggatgtcaatatccatgaaaagaaactgaaggatattccatgattttatgccatctctgtaatt

SEQ ID NO: 3495 - DNA, 4021 bp, Oryza sativa
  Clone ID: PAT_MRT4530_89648C.1
ttttgttttttttactagacagcgatattatattattatatatcactgggattgggggtacatatggtccatatggatgaagctacatatcacgaaactaattacagtcacacgcacgtaactgattcccaaaggctacaagaataaaacactggaacactagtcaaataagccgaacccgtaatattaagggcttgggatatcgcaactataagatcctccccagacggcccaagggaatggatccccgggccgccgctctcggctcgtgggtccccgggctccaggctctttttttttttttttttttttttggagtaaatatacacattcattgaatttggacttttgccacggcacagaaacactgaacaaaatgtgcctttgttcaatacaatcaagaaaaggaataataaaaaggaatgaaaatcctctatcctattaatctagctataataaggaactatacaggtatttacgggaacatgtcagattgcctacgtaaggtttttgctatgcctccatcgaaagtcgaaataggcgattcaagaaaatacgaggataaagttgatccccaaaccaccaccatctgcatgccttcatgcaaatactggggaaaccagcgaaactatgctgctattgccactactgtgccacttactatggtcaacaccagcttattgcatctctagcaacaaattgtattgtctaacaaaacttctacaagttcacatgaagctcatccagatatactaaggtctgtcatgcttctgtcagcaatatatgcctttatatccctgcatctgggagctgaacagtctgcattgtcacaaagcagtgagtgcgtgaacagcagtttccacatgaatacacacatatggcaacctcctccaccacgggcacgggtatgacatcgtacaccatggaagaacagtttctttaacgtcaaacaaagtttggaagtgcaacttcgatcaaaacatcttgatgcatgcaccaagccttcaaggtagtctctttcaaatgcatgcttttgttttgttgtagctgggtgcctgtccttcagaggggtattcagctcctcagcataacaacgttcacaaagaaagaagtttttgcagctggtgcaaacccaactactaccagatacaataggatggtggcaatgcttgcaaaattgcttatgcacaagtaaaatatcctcgaggtttcctttccggtcatcacgtttggcaacccgtagaagccttcctagttgagtttctttcttctgtgaggtgtcatcatctttcttttcaaggagcctctctgcttccccaggccagaaatcattatcacagtatggcaaccatgcagctgagatattggtcttgcattcattggtgggctgaaggaagaagtcatagagtgtattccgttccacaactaccccctccttaacagccttctttaccaaattctggtaccagctccgaagcttgtcagactttggcatcttctgtattgtaggatgacaatataaaacataatcgtcacgctttgtagatgggcaagtccatatggaacagcttacaaaccctcgtttcttgcagaaatccaagtagccaatcaaaatttcatgatacacaaaggtacggagagcttctccactggccgacttgatttccggtctgaagtacttgacagaatcaatatatgcaagataaacgtgcctttgatttggtgatgggcaggctgaaccatactcttgcacatacatggcgaacaggcatacatctacaccttcattcttttgaaacaagagaatggcctttgatttgtacggaaattccccaggatattgttcttttttaaaaaaatccttgaaacgtggttggacttgcagtgttctatcagctgaagataccactctaacagtaagaccttcaactcctggtacctcatcaacactttttccagaagcaattgccctctgttgccgctcctgcacaagccgctcagaaagcctttgctcaatatgatcacttagtctagttcttggtaactcgcgtgctcccagaatagtagatggctcaagtgaatcaacatcttcattatccttttccttcaagaaacattttgcacaagtatattcagcctctggatccacgattttggggttaaaaagtgcgcagatttgatgctgccaagctttgcacttatcgcactggacccaccattctgcctcagcatctgtctctgcatagctgaatctcttctgatatttggctttggcactactaagatggtggcatctgccacatattgaagatttgtcatttccattttccacttcaacataataggatcctgtagaattaattattttaaaacagagcgcgcaaaatcgtggagggggctcaaagaggagtctttccatcccacataaattgcatgtgttctgatcaggcaagccttcaactgatagcagctcttcagtcggcactttgctctgagaagtatcatggttcagagtacacaagtgatctttaagctcctcagaagttaatgcataaagtactgaggcccctcttctcttccttgccctcaggctgtcccctgacaatgtttggtccaataaatcaacctttgcatccttcatctcaatgtcactattttcacgacgaaattcttcttcagtttgtacagcactccccgacaatctgaccatatccattccatgtacattatcggtgcaagcaatgttgtcccccaaggaagtacaacatggtgattttgttggtgaattagtgacttcagattgtactgtttcagcagatgcataagtctcattggcagcaggttgttgttcctttgaagcctccatttcattgacatggacaagatggggaacatcaactttcaagcgttttgctggataatgcttgccagaagatccatctgaagcaggtgaagtcggctttgatacagtactatttgatgtctgttcagctctatccactgtcttgcttacagggctacaagcaccataattagtcatgaagccctgctgatgatgcataaagtggttgcttaaatttgagcttttctccctggagaaaccttcatgatcagaagtatgcccaagtttttctttcatttgaatgcatcgatcccgtttgtgctctccattgatgtacggatgaatttgagcatgatacaagtcacggtttccagtggtaatgtttgactgatctgattgctctagtgaccgactccacgtctcttgcttcatctcacattctatgtattgttgcaacaaaggtccctgaccggttgtgggatacaaacttttattgtttgtggaaaggttttgtccgttcactgttgagaaagaatccatcggaagtgttctcattgcactagaacatgttgtttgatcccacactgctgacaaagaactagaactcccagaggttgatggttgtgaactatcattttgatacgcatcacctgagaaatgttcttttatatggccaatatgcagtacatcaatactagggctacatttcggtagagttgatgcacatgaggtaaaaatggtgtttgctaatctttcaggcatctgcttgggtttatcagccaacgaatgagcaaagttagcagcacccatacagttttcatattggttatatctaccccgaaatgatgcagaattgacgatagcattcaacctggttcttaaagtttcaagatccatatacttaatctttgaatcagctttctcaaaaagatgtcggtcaatacattttccaatttccataagaaaggataggtcaaagttgcagaattccttccgctcatttaggtactctacaattttacggtgaataatattgcgaactacggatgtatcttgatccatattatccaactgaagaatttcagctgcagattgtgtccagccacttgtggggtattgctgggtaggaaatccacttgctgcatattgctgttgagtcccttgcagggtctttgccat

SEQ ID NO: 3496 - DNA, 2388 bp, Oryza sativa
  Clone ID: PAT_MRT4530_89679C.1
gagaagagagttttgtagcgagctcgcgcgaatgcgaagccaaccgagagaggtctcgataccaaatcccgatttctcaacctgaatcccccccccacgttcctcgtttcaatctgttcgtctgcgaatcgaattctttgtttttttttctctaattttaccgggaattgtcgaattaggcattcaccaacgagcaagaggggagtggattggttggttaaagctccgcatcttgcggcggaaatctcgctctcttctctgcggtgggtggccggagaagtcgccgccggtgaggcatggggatggaggtggcggcggcgcggctgggggctctgtacacgacctccgactacgcgtcggtggtgtccatcaacctgttcgtcgcgctgctctgcgcctgcatcgtcctcggccacctcctcgaggagaatcgctgggtcaatgagtccatcaccgcgctcatcatcgggctctgcaccggcgtggtgatcttgctgatgaccaaagggaagagctcgcacttattcgtcttcagtgaggatctcttcttcatctacctcctccctccgatcatcttcaatgcaggttttcaggtaaagaaaaagcaattcttccggaatttcatgacgatcacattatttggagccgtcgggacaatgatatcctttttcacaatatctattgctgccattgcaatattcagcagaatgaacattggaacgctggatgtaggagattttcttgcaattggagccatcttttctgcgacagattctgtctgcacattgcaggtcctcaatcaggatgagacaccctttttgtacagtctggtattcggtgaaggtgttgtgaacgatgctacatcaattgtgcttttcaacgcactacagaactttgatcttgtccacatagatgcggctgtcgttctgaaattcttggggaacttcttttatttatttttgtcgagcaccttccttggagtatttgctggattgctcagtgcatacataatcaagaagctatacattggaaggcattctactgaccgtgaggttgcccttatgatgctcatggcttacctttcatatatgctggctgagttgctagatttgagcggcattctcaccgtattcttctgtggtattgtaatgtcacattacacttggcataacgtcacagagagttcaagagttacaacaaagcacgcatttgcaactctgtccttcattgctgagacttttctcttcctgtatgttgggatggatgcattggatattgaaaaatgggagtttgccagtgacagacctggcaaatccattgggataagctcaattttgctaggattggttctgattggaagagctgcttttgtattcccgctgtcgttcttgtcgaacctaacaaagaaggcaccgaatgaaaaaataacctggagacagcaagttgtaatatggtgggctgggctgatgagaggagctgtgtcgattgctcttgcttacaataagtttacaagatctggccatactcagctgcacggcaatgcaataatgatcaccagcaccatcactgtcgttctttttagcactatggtatttgggatgatgacaaagccattgatcaggctgctgctaccggcctcaggccatcctgtcacctctgagccttcatcaccaaagtccctgcattctcctctcctgacaagcatgcaaggttctgacctcgagagtacaaccaacattgtgaggccttccagcctccggatgctcctcaccaagccgacccacactgtccactactactggcgcaagttcgacgacgcgctgatgcgaccgatgtttggcgggcgcgggttcgtgcccttctcccctggatcaccaaccgagcagagccatggaggaagatgaacagtgcaaagaaatgagaatggaatggttgatgaggagaatacatgtaaaatgtgacagcaaaagagagaaggcaagttttgggtttgtagagtttggctgctgctaatgagttgttgatagtgcctatattcttcagaacttcagatggtgcctcaccaaggcctaagagccaggaggaccttctgataatggttcgggatgattggtttgttctgtcaggatgaaccctagtgagtgacacagggtgatgtgctccgacaacctgtaaattttgtagattaacagccccatttgtacctgtctaccatctttagttggcgggtgttctttcctagttgccaccctgcatgtaaaatgaaattctccgccaaaatagatttgtgtgtataataattttgcttggttgatataaaaaaaaaaaatggtttgcaacaaaaaaaaaaaaaaaaacgagcgtgcgacggcgtgcatgagctcgtca

SEQ ID NO: 3497 - DNA, 141 bp, Oryza sativa
  Clone ID: PAT_MRT4530_89985C.1
gccggcggcgatagccggaagcgggagagggcggtggagatggggcaagaggccttcctactgaagaggcaatagcgtggttcatcagcgtaactcctgtcctaggtagccctgctagttataagcatcaaatcaaattca

SEQ ID NO: 3498 - DNA, 2289 bp, Oryza sativa
  Clone ID: PAT_MRT4530_90081C.1
atgaaccacaagcattctttctctgccctctgtgcagcaatgatactcaacgtgatcatattatttgtggatagctatgttgcagttgcatcagataccctttttcctggccaatctctctcaggctctgaaaccttagtatcagaaaatggtatttttgagttgggccttttcccctcagccccagctggtacaaagcactacctgggtattcgatacaagaacatgtcaagcaacaatccaataaccttttggctgggaaacagaattcccatcacctacttcattaatgcaacgctgtacatcgatgcaggtaaactttatattgaggagctcggctctattctatggacctcaaattcaacgagaaatgaatcaaacactgctgtggcagttattcttaacactggaaactttgtaataagagatcagctcaactcttctgtggtcacatggcagagctttgatcacccagctgataaactgctcccaggagcatatcttggactggacatggtcatgggaaccaacatcttgcttactctgttcaagcctccttataattgtaccctcatgattgaccaaagtaggaagaggggattcatcatgttcattgatgggcatgacaagtatcttggaacctttcctgaatggatggttacctacgaagaaaatggtagtctggtacgattaaacgatccaggaattccaaatgatactgaatacatgaaattgcaactggggcaactcagtttgttgaggtggttagataatgcaacaattagtggttggcaatctgtgtggagccacccttccagctgcaaagttagtgcttttcactgtggtgcatttggtatttgcacaagcacaggaacatgcaaatgtattgatggtttcagaccaacggagccaaatgaatgggagctgggacattttggtagtggctgctctagaattaccccctcaaattgtctaggtgttgtttccactgacttgtttgttttgttagacaacctgcaggggcttccttacaatcctcaggatgttatggcagcaactagtgaagaatgtcgagctatctgtctaagcgaatgctattgcgcagcgtactcctatcattctgcctgcaagatatggtacagcatgttgttcaatttgacttcagctgataaccctccgtacactgagatttatatgcgtataggttctccgagtaaacgcaggatgcacatactggttttcgtactaatttttgggtcaataggggttattctttttctgctgatgcttcttttgatgtacaagagatcctcatgtgttgcaagacagacaaaaatggaaggttttcttgcagtgtactcttatgcacaggtcaagaaagctacaagaaacttctctgacaaacttggggaaggaagctttggaagtgttttcaagggaacaattgcaggttcaacgattgttgctgtgaagaagctcaaaggcctagggcacacagagaagcagttccggacagaggtacagactgttgggatgatccaacataataatcttgttcgtcttttgggattctgtactagagggactagaaggttgctggtctatgagtatatgccaaatggttctttggattctcatcccttttcagaaacctcaagggtattaggttggaatcttcgccatcagattgtcgttggtattgctagaggtttggcctacctgcacgaggaatgcagggactccatcatacattgtgacattaagcctgaaaacatactactagatgcagagttctgccccaaaattgcagattttggtatggcaaagcttcttggacgggaattcagcgctgcactgaccactatccgaggaaccattggctatcttgcaccagagtggatatctggacaggctattacccacaaggcagatgtctatagctttggtgtcgtgctcttcgaaataatatcagggcggaggagtactgagaaaattcgacatgggaaccattggtatttccccctttacgctgccgctaaagtgaatgaaggagatgttttatgcttgcttgatgacaggatcgaaggaaatgcgagtttgaaggagttggatgttgcctgcagagttgcatgttggtgcatccaggatgatgagatccacaggccatccatgaggaaagttattcacatgttggaaggtgttgtcgacgttgaattgccgccaattcctgcttcctttcaaaacctgatggacgattatgatagtgatatatattccgtggaagtttga

SEQ ID NO: 3499 - DNA, 501 bp, Oryza sativa
  Clone ID: PAT_MRT4530_90460C.1
accaagagttcgcccacgcatccggttgagctcaatgaagtgaagctgatagacggctactacataatggacccagctaaagccagtggatatggtcagacgagaacaccatctgcatagtggcgatccctaggtcgacgctgaacggggagtatgaggacgtgaagctgctcaacgatctgctgaccaagaagaacgctgaaacaggctgggacacgccgatacacgtgaacgcagggagcggctggttcatcgcgccgatgctgtacccagagctgaagtgggacttccggctgactgctggcgaacagcatgatcataagcgggcacaaatacggactcgtctacgcaggaatcgggtggtgcatatggacgagcaaggaggatctgtctgaggagctcatgttccacatgaactacctcggggccgaccagcccaccttacacccttaacttatggaagggttgcagccatgtcattgcacacgattaccaactaat

SEQ ID NO: 3500 - DNA, 2304 bp, Oryza sativa
  Clone ID: PAT_MRT4530_90535C.1
ggcacgagctcgtgccgaattccggtcgaggaaaaatatggggagtatttgtgcgtttttatttttgtttttgggtcgcactgttcgatcgtagcatccatgaccactgtggcatcgctgtctttgctgccgcacttgctcatcaagccttccttcaggtgttgctccagaaagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtggtagaggttcttaatcctttagcaagggagttcaagtcaattggaaccttgaggaaagagcttgcagaattacaggaagaattggcaaaagctcacaatcaggttcatctgtcggaaactagagtatcatctgcccttgataagttggcacaaatggagacccttgtcaacgacagactgttgcaagatggaggctctagcgcatctacagccgagtgcacttcccttgctccaagcacgtcatcagcgtcccgtgttgtaaacaagaaacctcctcgccggagtctgaacgtgtctggtccagtgcagccatacaatcccagtctgaagaacttctggtacccagttgctttctccagtgacctaaaagacgatacaatggtgccaatagattgttttgaggagcagtgggtaattttccgaggaaaggatgggagacctggatgtgttatgaacacatgtgctcacagagcttgccctcttcatcttggctcagttaatgagggcagaatccaatgcccttaccatggttgggagtattcaactgatggaaaatgtgagaaaatgccatccacaaagatgctcaacgtgcgcatccggtcattaccatgctttgagcaagaaggaatggtttggatatggcctggcaatgacccaccgaagtcgactatcccttctctgctgcctccttcaggatttacaattcacgcagagatagtgatggagctaccagtggagcatggacttcttctggacaatctattagatcttgctcatgctccttttactcatacatccacctttgccaagggttggagtgttccaagcttggtgaagttcttgacaccttcatctgggcttcaaggatactgggatccatacccgatcgacatggaatttcgaccaccatgcatggtgttgtcaaccattggcatctcaaagcctggaaaactagaggggaagagcaccaagcaatgttcgacgcatctccaccagctccatatctgtttgccctcctctaggaataaaaccaggctgctctaccggatgtctctcgacttcgctccatggatcaagcatgtccctttcatgcatatactatggtcacattttgctgagaaggtcttgaatgaggatcttcgactcgtgctcgggcagcaagaacggatgatcaatggcgcaaatgtctggaactggccagtatcatatgacaagcttggtatccggtatcggttgtggagagacgccattgagaggggagtagacaggttgccattcagtaaccaaagtgagagtggatcatagtagctgcattgccaatagcctcttttcaattcttgtcgtatttcttggcgagatgaagatgaagatgaagatgatgatggccagaactagtcagtggatgtatatgcacagtttgtttaggcgtgcgtccctgcatggttggttcaccatctccctgagcttcgttgcagattgaattgggttctggagaggaaaggctaatggaaggagagaatgataggcgacgtcattctgtgtaattttaagtgtacactagcgacagcatcacgggatgcaattgtaatctgaggttgatttgtttttcttcttttttttttcctccccttttacccatgtaaaagtcgatcgcatgtcacgctatgatgcatatatatgatcatactattgattattgagccaaaaaaaaaaaaaaaaaaaaaaaaaaaaggggcggggcccgcgtcccgacgcctcctgcccggcgctccccgcttatctatttggcagattctgtgtatggtttgctaattcagaacagtaaggtctcttgataagttgagacaaaaaaaaaaaaaaaaaaaaaaaaaaaaaaaaaaaaaa

SEQ ID NO: 3501 - DNA, 1671 bp, Oryza sativa
  Clone ID: PAT_MRT4530_90537C.1
atgaccactgtggcatcgctgtctttgctgccgcacttgctcatcaagccttccttcagacaatggtttcaaggttctgtgattcttcagaccccatatcttaaaacctgttgtattgaaggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtggtagaggttcttaatcctttagcaagggagttcaagtcaattggaaccttgaggaaagagcttgcagaattacaggaagaattggcaaaagctcacaatcaggttcatctgtcggaaactagagtatcatctgcccttgataagttggcacaaatggagacccttgtcaacgacagactgttgcaagatggaggctctagcgcatctacagccgagtgcacttcccttgctccaagcacgtcatcagcgtcccgtgttgtaaacaagaaacctcctcgccggagtctgaacgtgtctggtccagtgcagccatacaatcccagtctgaagaacttctggtacccagttgctttctccagtgacctaaaagacgatacaatggtgccaatagattgttttgaggagcagtgggtaattttccgaggaaaggatgggagacctggatgtgttatgaacacatgtgctcacagagcttgccctcttcatcttggctcagttaatgagggcagaatccaatgcccttaccatggttgggagtattcaactgatggaaaatgtgagaaaatgccatccacaaagatgctcaacgtgcgcatccggtcattaccatgctttgagcaagaaggaatggtttggatatggcctggcaatgacccaccgaagtcgactatcccttctctgctgcctccttcaggatttacaattcacgcagagatagtgatggagctaccagtggagcatggacttcttctggacaatctattagatcttgctcatgctccttttactcatacatccacctttgccaagggttggagtgttccaagcttggtgaagttcttgacaccttcatctgggcttcaaggatactgggatccatacccgatcgacatggaatttcgaccaccatgcatggtgttgtcaaccattggcatctcaaagcctggaaaactagaggggaagagcaccaagcaatgttcgacgcatctccaccagctccatatctgtttgccctcctctaggaataaaaccaggctgctctaccggatgtctctcgacttcgctccatggatcaagcatgtccctttcatgcatatactatggtcacattttgctgagaaggtcttgaatgaggatcttcgactcgtgctcgggcagcaagaacggatgatcaatggcgcaaatgtctggaactggccagtatcatatgacaagcttggtatccggtatcggttgtggagagacgccattgagaggggagtagacaggttgccattcagtaaccaaagtgagagtggatcatag

SEQ ID NO: 3502 - DNA, 1158 bp, Oryza sativa
  Clone ID: PAT_MRT4530_90587C.1
gagagagagagggcagtgcaggtgtcgctggccatggcgaggaggagcagcagcagagcgtgcgcggccatggcgacggccgccgtctttgcgctgctggccgcgacggcgacggcgtcggggctcgtacgggtggagcacccggccaagagcgacgggtcgctgagcctgctcgtcgtcggcgactggggccggaagggcacgtacaaccaatccagggtcgccgagcagatggggaaggttggggagaagctaaatatagacttcgtcatatccaccggtgacaatttctacgaggatggactcactggcgtcgatgaccaggcgtttgaggaatcgtttaccgatatctacacggcaaagagcttgcagaagccatggtacctggtgctgggaaatcatgactacaggggtgatgtgctagcacagcttagcccagtcttgcgaaagatcgaccagcgattcatttgcatgaggtcgttcattgttaatgcagagattgtggatttcttctttatcgacacaactccatttcagctgaaatattggactcgccctaaagaccatcattatgactggagaggagtggcacctcgacaaaaatacataactaatctacttaaggatatggatgaggcaatgaagaaatcaacagcgaagtggaagattgctgttgggcatcataccattaggagcgtcagtgaccatggtgacaccaaggagcttctgcaacttctacttccagttctgaaggtcaatggcatcgacttctacatcaatgggcacgaccactgcctggaacacattagcagcagagacagtcctatccaatacttcacaagtggaggtggttcaaaagcatggagaggagtcttgcagccaaattctgataagctccagttcttttacgatggacaagggttcatgtccctccagataaaccaggaccaagctgacttcatattttatgatgtttctgggaacatcttgtacaagtggagcaagagcaaagcaaactacctccagccctccacctatatcactgaagcattcacatataacctttggagagagagagagagagagagagactttgggggtttctaagctggtattttcatttaaaagagacaatgaaaagaaaatttgatctatgat

SEQ ID NO: 3503 - DNA, 2166 bp, Oryza sativa
  Clone ID: PAT_MRT4530_90589C.1
acgtgcgatcaatattattcttgataaagcactcaccagtaagatcaaatgagttttagttataacttgcttgctataattttcattataattttattctgttatatgcaatttttattcaaatggacacgtacacaactctgtactgaattacaacctttttccagaagcagtaactaatagccgtcttcaccgacacatgcttgattatcatagatcaaattttcttttcattgtctcttttaaatgaaaataccagcttagaaacccccaaagtctctctctctctctctctctctccaaaggttatatgtgaatgcttggcaatactgaagaaccctgatgccgatatgcaaaggtcactactagcttttagagttttaagccttctttgtaaattatacatggcataatcgatggtcctctggcaagaagttgtatgaatcagatctaatggataccatactgaacatctcttttcctagtctagtaggatggtctcggccttgtctcaaatttctttagtagatcaatcacatgccatgcttaaatactttcctatttcctttccggtcctcttcccttgcgtgccacaataatgcattcaaatttgatacaaatatcttagccaagctaattctccgttttgtggttttgcatctgcctcatgcttcagtgatataggtggagggctggaggtagtttgctttgctcttgctccacttgtacaagatgttcccagaaacatcataaaatatgaagtcagcttggtcctggtttatctggagggacatgaacccttgtccatcgtaaaagaactggagcttatcagaatttggctgcaagactcctctccatgcttttgaaccacctccacttgtgaagtattggataggactgtctctgctgctaatgtgttccaggcagtggtcgtgcccattgatgtagaagtcgatgccattgaccttcagaactggaagtagaagttgcagaagctccttggtgtcaccatggtcactgacgctcctaatggtatgatgcccaacagcaatcttccacttcgctgttgatttcttcattgcctcatccatatccttaagtagattagttatgtatttttgtcgaggtgccactcctctccagtcataatgatggtctttagggcgagtccaatatttcagctgaaatggagttgtgtcgataaagaagaaatccacaatctctgcattaacaatgaacgacctcatgcaaatgaatcgctggtcgatctttcgcaagactgggctaagctgtgctagcacatcacccctgtagtcatgatttcccagcaccaggtaccatggcttctgcaagctctttgccgtgtagatatcggtaaacgattcctcaaacgcctggtcatcgacgccagtgagtccatcctcgtagaaattgtcaccggtggatatgacgaagtctatatttagcttctccccaaccttccccatctgctcggcgaccctggattggttgtacgtgcccttccggccccagtcgccgacgacgagcaggctcagcgacccgtcgctcttggccgggtgctccacccgtacgagccccgacgccgtcgccgtcgcggccagcagcgcaaagacggcggccgtcgccatggccgcgcacgctctgctgctgctcctcctcgccatggccagcgacacctgcactgccctctctctctctctctctctctctctcggtaacgagaggctccgggttaggaggctatttgtactggagtatgtagatgatagtgatttgcaaggacaagttatcacctggttaggttaggtgcctttgcaagcgtagttgttaggaggaaaagaaattaaagcaactggtgattgaaatggctggctggctgacgacgtggcctctccctcccctttctgtttgtgtttgtgtttgggcctttccctgcttgcttgcctcgtcacaactcacaacacaggctcacagagtattctcatgccgtttgtctggccggccggccggcgacgtcaacgtcgttttcactttcgtgtcacgaacagccacgatcgctgtctattgccacggtaattatggttttgctttccctttcccaacacgcgtgtggcggacgcgtgggtcgacccgggaatccggacc

SEQ ID NO: 3504 - DNA, 2341 bp, Oryza sativa
  Clone ID: PAT_MRT4530_90745C.1
ctcctcctccgcatcgcagcgcttcgcgtccccccccccgcgcggagagaacatcgccagcaacgcgcgcttctccccctccccttctccccatcccatccaatccatccatggcggaatgctccattgatcacgaccagtagcttcctacaaccccagatcgggaggaggaagaagaagaagcaagaagcaagaagaaggagacgccgtcaatggggagctacgcgtacaagtactgcatgtgcttcacccgcaagttccgctcgccggcggccgacccgccgccggacgtccgcgccgccttcctcgccgccggcggaggcgacggcgggctccggcggttcctcgcgcaggcgcagggggagacgccggcggaggtggaccgcatcctcgcgctgctcagcggcggtggcggcggcggcggaggaggaggcatcgcggcccgcctcgtgggcccccggcccggcccggccccctcgctcgacgacttctttgggttcctcttcaacgccgatctcaacccacgccatcgccacccaggttcaccaggacatgtcggcgccgttttcgcactattacatatacaccgggcacaattcctacttgactgggaaccagctgaacagtgattccagcgacattccgattatcaaagcattgcagaggggtgtcagggtgattgagctcgatatgtggccgaattccgctaagaacaacattgacattcttcatggagggacattgactgcacctgtacaaatcatcaaatgtttgaagtccattaaagaatacgccttttgtgcttcaccatatcctcttgtcattactcttgaggatcacctcacaccggacctccaagctaaagtagctgagatgctcgtcaaaacatttggaaatctcctttacattcctagttcagacccaataaatgagtttccttctccagaatctctaatgaagaaaataatcatctcaactaaaccaccagaagaatacaagaagtttcttaaatctaaggataatcagaacatcaatggcggcttagctaatctggcagaggaaggaagcttgagaagaatagattcaaatgctgaagaatcggatggaaaggatgaactggatgatcaagatgaggactcctctgatgaggatgatcccaaatttcagcaggaaacagcctgtgagtatagggaactgatcaccatccacgctggcaaaccaaaaggccatttgaaggatgcgcttaaggtggatcctgacaaagtcaggcgcctttctttgagcgaaacacagctagctaaagcaacagcttctcatggtgccgatgttataaggttcacccagaagaatatactcagggtgtatccgaagggtacaaggattaattcttccaactatgatccaatgaatgcctggactcatggtgctcagatggttgcatttaacatgcaggggcatgacaaagcactccggttaatgcaaggattttttagagctaatggaggttgtggctatgtcaaaaagcctgacttcttgcttaggacaggtccaaatggtgaagtatttgaccctaacgcaagtatgcctgtgaagaaaactctgaaggtgaaagtatatatgggagatggatggcgaatggatttcagtaaaactcatttcgacaccttctctcctcctgatttctatactagggtggggatcgctggtgtgcgggcagattgtgtgatgaagaagactcgaacaatcgaggatcagtgggtaccgatgtgggatgaggagttcacattccctctgacagtcccggagctggctgtgctgagaatcgaggttcatgagtacgacatgtcggagaagcatgactttggggggcagacatgcctgccagtgtcggagctgaagcagggcatccgcgctgtgcctctccacgatcgccggggcaccaggtacaagtctgtcaggctcctcatgcgcttcgacttcctctagctagctttctacctagctagtgctgctgccaaaaccagaataccagatgatgtatcttactagttttctaggcttcttcagctggtgcatatatgtactatggatgtagatgtactatttttgtaatcacacatgcatcttgcatgtcttgataatgataataatgctagcatggttggtaggaatacaaaaacattttgtgcgattttgttggctatatctagtattctagtcagtgatatttatcaaaaaaaaaaaaaaaaaaaagggcggccgctaagtaagtaagacgtcgagctctaagtaagtaacggccgccaccgcggtggagctttggacttcttcgccagaggtt

SEQ ID NO: 3505 - DNA, 1547 bp, Oryza sativa
  UNSURE (1)..(1547): unsure at all n locations
  Clone ID: PAT_MRT4530_91041C.1
  unsure (1)..(1547): unsure at all n locations
caaatcaaccacagacgctaattctcacaccatcgatcatcagcactagctgttacaggtttctcgtataatatcgatctatgcttgatttacacattcagatgtgacgaaatctacatgatgcaactgatggtgcatgcatgcatcatantccctgacccttggtgagccatcattttgggtcatatgcacagtttgattagctaccctttgatcgattaggatatgccaatggtcttccctagcagccacatgacgagcgagaactcgatcatgaagagcgcgtggagccatgtccggtcgacgacgaagccgaacaccgtgatccccgccctgttgttctccaggtaggtcactagagcctgtctcttctggaaggagatgtgggtggcatggaacgacacgatcttggtgccgtcgaggccgtcgtcgctcggggacgtctcgtcctcggactcgtcgccggaggacgacgcgttcggcgccggctgggggacgacggggccggcggcgtgtaagtagctggacgccttgatgggcgtcctggggttctcgtggtcacgctcctggctgttgatggtcgcgtcggcgtgccactgcgccgcgacgctggtgatcgcctgcgtcttgtgcgtgatcttcgccgcgctgtggaggcagatcagcagcccggtcacgaggctcaaggagcaaagcgcgagctcgccggaggtggcgatgttgacctgggcgtggggcctcgtggcggcgagcagcgcggagaactggctggccgtgacgaggaggaggcaggagacgatgaacttgcggtagcggtggctgatccgccggagctgctcgcggatgcggcggtgctgccgcagcacgtcggcgacgtcggcgcactggccgaagtccctggcgaacccggtcatccgcaggatctgcaggaagcatatgatccggaacagcacgcacgccatgaagaacatggccgtgcggtacatccacgacgccatctccagcgcgcacgccgcggcggaccaccacagcgggaacggccggttcgcgcagtaccagtacaccttgtacgcggcgtcggcgaggaagcaggggaggacgaagcaggcgaggaggcggaaggaccccgcgagctccacggtgtagccggcgcggacgtcctgggagtcgtgccggagcctgtcgaggtagagcagccggcgcaggccgcggcgccggacgagcctggagagcgtgaggtaggcgagcgccgcggagagggtgagcgacgcctgcacctgcccgtcgtaggcgcggcgcggcagcgcggcgcgcgccgccgccgggacggccacggcgagcagcgtgaacacgagccacgacgcgacggcgctggagccgtccgagtgctcgacgcacatccaccgcaggcacgaccggaagctgcccagctcgtcgcgcgcgtgcgacatggacctcgtgtacgaccccctccgccgcagcagcggcgtcgacgcgggctcgatcatcgcctccctggccgccgccggcgacgccgtgtcggccat

SEQ ID NO: 3506 - DNA, 1759 bp, Oryza sativa
  Clone ID: PAT_MRT4530_91259C.1
atgggaggaggcggcgcgggtggggacggcgaggcgtgggcggatcaggagcaggggaacggcgggggccgcggcggcggcggcggggaggcgaagcggtcggagatctacacgtacgaggccgggtggcacatctacggcatgaactggagcgtgcggcgcgacaagaagtaccggctcgccatcgccagcctgctcgagcagcacaacaaccacgtccaggtggtccagctcgacgagtcctccggcgacatcgcccccgtcctcaccttcgaccacccctaccctcccaccaagaccatgttcgtcccggacccgcactccgtccgccccgacctcctcgccacctccgccgaccacctccgcatctggcgcatcccctccccggacgaggccgccgccgccgccgccgccagctccaactccggctccgtccgctgcaacggcaccgcctcgcccgacgtcgagctgcgctgcgagctcaacggcaaccgcaacagcgactactgcggcccgctcacctccttcgactggaacgacgccgacccccgccgcatcgggacctcctccatcgacaccacctgcaccatctgggacgtcgagcgggaggccgtcgacacccagctcattgcccatgacaaggaggtctacgacatcgcctggggcggtgccggcgtctttgcatccgtctccgccgacggctccgttcgcgtgtttgatctccgggacaaggagcattccacaattatctacgagtccggttctggcggcagctccaattcggcaggtgcagatggcggcgctgcctcgccaacaccgctggttaggttagggtggaacaagcaggaccctaggtacatggcaaccatcatcatggatagccccaaggtggtcgtgcttgatatccgctacccaacactaccggtggtcgagctccaccgccaccattcgcccgtcaacgccatagcatgggcgccacactcctcttgtcacatttgcacagctggggatgactcgcaggcccttatatgggacctgtcatccatgggcactgggagcaacaatggtggcaatggaaatggcaatgctgcagctgctgcggcagctgagggcggtcttgatcccatattggcgtacactgctggggcagagattgagcagctccaatggtcagcgacccagcctgactgggtcgctattgcattctccactaaactgcagatcctcagggtctgatttctttgttccaaccctgttagtaaggggacatcgacaagaacaaagaaggccagcatggataatgaggttaggtgatcagaggacattgttacttcagtcttatttattttaagttgtgcacagatgatatgcgcgctgagttggttctagtgatataacaaattgtttcctacctagaagctggaattggcaatgaactgagctgttagagtaattagctgctctaagtttagtattgatgttaatgtggattgtagttatgtttgttgcttgttctcgaatgtccagctccagtagggcgtaggttcacctcttgacttccatgttgtattttgcactcgccgtatatgcacttataagttataagcttgtgcgtgttattttgtttcaaaaaaaaaaaaaaaacaaaagcccgaaaaaaaaaaaaaaaaaaaaaaaaaaaaaaaaaaaaaaaaaaaaaaaaaaaaaggggggcctgcagcccggggatccactagtttagagcgccgccaccgcgtga

SEQ ID NO: 3507 - DNA, 1401 bp, Oryza sativa
  Clone ID: PAT_MRT4530_91530C.1
gcacgaggcgagagcgctacaaaatggcccacgccgccgcggccacgggcgcactggcaccgctgcatccactgctccgctgcacgagccgtcatctctgcgcctcggcttcccctcgcgccggcctctgcctccaccaccaccgccgccgccgccgcagcagccggaggacgaaactcgccgtgcgcgcgatggcaccgacgttgtcctcgtcgtcgacggcggcggcagctcccccggggctgaaggagggcatcgcggggctctacgacgagtcgtccggcgtgtgggagagcatctggggcgagcacatgcaccacggcttctacgacgccggcgaggccgcctccatgtccgaccaccgccgcgcccagatccgcatgatcgaggaatccctcgccttcgccgccgtccccgatgatgcggagaagaaacccaaaagtgtagttgatgttggctgtggcattggtggtagctcaagatacttggcgaacaaatacggagcgcaatgctacggcatcacgttgagtccggtgcaggctgaaagaggaaatgccctcgcggcagagcaagggttatcagacaaggtctcctttcaagttggtgatgcattggagcagccttttcctgatgggcagtttgatcttgtctggtccatggagagtggcgagcacatgccagacaaacggcagtttgtaagcgagctggcacgcgtcgcagctcctggggcgagaataatcattgtgacctggtgccataggaacctcgagccatccgaagagtccctgaaacctgatgagctgaatctcctgaaaaggatatgcgatgcatattatctcccagactggtgctctccttctgattatgtcaaaattgccgagtcactgtctcttgaggatataaggacagctgattggtcagagaacgtcgccccattctggcctgcggttataaaatcagcattgacatggaaaggtttaacttctctgctaagaagtgggtggaagacgataagaggtgcaatggtgatgcctctgatgatcgaaggatacaagaaagggctcatcaaattcaccatcatcacctgtcgcaagcccgaaacaacgcagtagtaccctagtagtgaaattacgctcctgctatcttctccatcacgaataatgcaaattctgacgagttagcacctactgatggcgatttgttgatttggggaacagccagtgcactgttaccacgtcattgattttgtactcgtcagacttaaaaaaaaaaatatccatgaatgtgcactccaaatacgtcaagaaattcttagatcttcagaccaactcgtcagctagaggcggctaaaaagctcatttagctccctcggtgcaagattgctttgattgaccctcgtgc

SEQ ID NO: 3508 - DNA, 1540 bp, Oryza sativa
  Clone ID: PAT_MRT4530_91961C.1
atggctaccacggatgcaaccattgctcacatcatggatgaacaagaagatatcaaggtcaaggcatccaagtgctggaatccgattcggccacctgctacactgctgatttcaaacggccgccaaatctccatacaagctccgttttcggcccgtgagtacttgatggaaagctctcggagtcctctttccaacggatccaacctcatcaccaaattccatcccagtcaaccgcagatgaagaaacaaggtgcaacatcacctgtcatgggcctttgggcttgtaacttcgtttgggaccccggcccaagaatagggttgatctgcaccggcaagatcaacaacccacggagaggtgtatcgatcgctaaggcgcaacacaacgtctcgtttcagaggctgttgcttagttgcgctggtccaaccgtggaaacgaacacagtgaattcgaattcacggttcgttccgtcctcctccctggacgccaacccggtttgcgaccgcacctaccccaggaacaagtccgcattgatcgatcgagcgatggccgtggcggtggaggagatcgtcaggagggccggcgggtgcgccgtgatcgacggcggattcgccacgcagctggaggcgctcggcgccgacatcaacgacccgctctggagcgccgcctgcctcatcaccaagccgcacctcatcaaggaggttcacatgcaatatcttgaagcaggtgccgatgtcatcatttcctcatcataccaggcaactatcccaggattcttagccagaggaatgcttcttgaggaggcagaagggttactgcgaaggagcattgaattggcactggaagcacgagatgaattctggaagtcgacgctgaggaagtccaagcctgtttacaaccgtgctctggtcgccgcatccattgggagctatggagcttaccttgccgatggctcagagtacagtggatcgtatggagaagacatcacggcagagaaactgaaggacttccacaggcgccggctgcaggttcttgcgagcgctggccctgacttgatcgcgtttgaggccatcccgaacaaaatggaggcacaggctttagttgagcttctggaggaagagaacatccaggtcccctcctggatctgcttcagctcagtggacggcaagaacctgtgctcaggagagagctttgcagagtgcctccaattcctcaacgccagcgacaaggtgaccatcgtgggtgtcaactgcacgccgcctcagttcatcgagggcatcatacgcgagctcaagaagcaaaccaagaaggcgatcgcggtgtacccgaacagcggcgagatttgggacggcagagcgaagagatggctgccggcacagtgctttgggcacaagagcttcgacgcgctcgcgaagaggtggcaggaggccggcgcgagcttagtcggcggatgctgccggacgacgccgtcgacgatccgggccgtctccaaggtcctcaagggcaagacgtcctattcagcaactcagatttgagaccgat

SEQ ID NO: 3509 - DNA, 1604 bp, Oryza sativa
  Clone ID: PAT_MRT4530_9221C.1
aagcccaacgcaaaccgcatcgatcaactccttccccaagtcgaagcaaaatccctagcgatgtcgtcgccgccgcccgccgccgccgccgcgatggccgtcgacgacgccgacgacgaccagctcgcctccatgtccacggaggacatcgtcagggcaacccgcctcctcgacaacgagacccgcgtcctcaaggatgagctgcagcggacgaaccttgaggtggaatcctacaaggagaagatcaaggagaaccaggagaagatcaaactcaacaagcagctgccttaccttgtcggcaacatcgtcgagatattggaaatgaaccccgaggatgaggctgaagaggatggtgcgaacatcgatctggattcacaaaggaaaggaaaatgcgttgttttgaagacatccacaagacaaacaatattccttcctgtaatcgggcttgttgaccctgaaaagctcaagcctggggatttggttggagtcaacaaagacagctacttgatactagacacgctaccttcagaatatgattcacgggttaaggcaatggaggtagatgaaaagcctacagaggattacaatgacattggtggccttgagaaacagattcaagagcttgttgaagcaatagtattgcccatgactcacaaggaccggtttcagaagttgggaattcgccccccgaaaggtgttcttttgtacggaccacctggcactggaaagaccctaatggctcgtgcatgtgctgcccaaactaacgccacatttctgaaacttgctggtccacagcttgtccagatgttcatcggtgatggtgcaaagcttgtccgtgatgcctttcagcttgcaaaggagaaatccccctgcatcatttttattgatgaaattgacgcaattggaacaaagcgttttgatagtgaagttagtggtgacagagaagtgcagcgcacaatgttggagttgctgaatcagctagatggattcagtagtgacgagaggataaaggtgatagctgcaactaatcgcgcggacattcttgatcctgctttgatgaggtctggtaggctggaccgaaaaattgagttccctcatccatccgaagaagcacgagctagaattttgcaaatccattcaagaaaaatgaatgtaaaccctgatgtcaactttgaagagttggcacgatctacggacgacttcaatggtgcacaactgaaggccgtttgtgtagaagcaggcatgcttgccctacgccgagatgctacagaggtgacacacgaggatttcaatgaagggatcatacaagtgcaagccaaaaagaagtccagtttaaattattacgcttaattcttccgagagagttattaggcctaaggaaacgctccgtccaaaattgtttgtttgtaacactaccgttttatatatttgtgtggttcaagatgtgattgtacgaaacatgtcttgcgctgttccttctctgcttgatatatactgatagaagttgactcgtcccttgcgtaaaaaaaaaaaaaagtgtttggcttcttgcgtgtcaaaactggcaattcgaatactggacgatttaggattactcggctggc

SEQ ID NO: 3510 - DNA, 2142 bp, Oryza sativa
  Clone ID: PAT_MRT4530_92341C.1
atggaggactggatgccaccacccacacccagcccgagaacactcatgtcaagcttcttgaatgaagattttgtctctggttcattttccaatattttcagtgatcatgagagcaacaaaccccaggatcagtttgagagaaacagagagcttgtggatttgagtaaggaagtgccttcccaattcgcaagacccgcattccagagggatgcttccctggatcatagcttggtcagtcctacacagagatcaaactcgcatggtggtttggcagagcgcagggctgcgagggctggtttcagtgtcccgaaaatcgatacatcccgtggtggttcgtccacagtaattcgatcgcccgtggcaattccaccaggtcttagtccaacaacacttctcgagtcaccggttttcctttacaacgcaatggcacagccttctccaaccactggcacactgccatttttgatggcttcaaatgctaagtcaacaataccgtcagctaccaagatggacgaagattgcacatttggcaatgacactttctccttccaaccgcatgtagggtcgagacggccaaatttctccgctgcagaaaagggtcccaatgcttgtcaccaaaaccaatcgctgtcgaatatccatcagcgggaatccagtcttcagtcaagctttactgcagtcaaagatatcactgatgaaaaaaacattaaaacaaagacatctgactccatgtttggtgataaccactcttctgatgaacaagatgatgagactaaccaaaatggagaaaactctatgccacctccgaaccaccgttcaggtgtccctctgtcacataccaatgatccagaagtgaatgtcctagagaaccgcggttcacagacatgccataactctgcatccttgtgggacaatgccaaaaatgattgccttcaagatgttcaaagtgaagttattgaaacaagaacagctgcttgtcttccagtatcaaccaattgtgatacatctatcatggagtcccaagatgcagttgatgtgtcgtcaacactatctaatgaggaggatgatagggcaacgcatggcacggcttctatagagtgcaacggggatggagatgagactgattccaagagaaggaagctggatgctttgacagctgcaactgctgctattaccaccaccagtaacattgacatgggagctgcggcatcgagaggtgtccgggagcctcgtgttgttgttcagacaacaagtgaggttgacatccttgatgacggttaccgctggcgcaagtatggacagaaggttgttaaaggaaatccaaacccaaggagctattacaaatgtacgcaccaagggtgttcggtgcgcaagcacgtggagagagcatcgcatgatctaaaatccgtcatcacgacgtacgaggggaagcacaaccatgaagttccagctgccagaaatagtggacatgggagctctggatctggaaacgctccatctgcaccgcaatctaacggctctcagcgcaggcaagaacaagggcaagccagcttcagccagtttggtggcgcggctcccttcagctccttcgttctcccaccaagaaaccaatttggaccatcggcgagcaatttcccctttgggatggtcccgccaggcatggcgattcccatgccatctctagggtctcttgctccagcaaagatggctggtcatccatccaccatgcagggctaccaggggctcatgattccggaaggagagatgaagacagagcccatgtcgcagctcggcttccccgcggtaaaccaatcttcatcatccttccaacagatgatgaacaggcctccatcatttggacctcagatgtaaataataatattaaagaaagaaaagaaaatgatagatgtgcttcagcttctatacatggtagcaatgctacaacatagctttgttgttctagcttttacctgttattttttctttgggcttttattttttggaagcaaagaatgcagaagatgttacccgttttgtttatgttgtaattggaaaaaaaaggtggtggtagtgttcaggacaaaaggcaaaatcattcaattggaaaaaaaaaagaaaaaaaaaaaaaaaaaaaaaaaaaaa

SEQ ID NO: 3511 - DNA, 1842 bp, Oryza sativa
  Clone ID: PAT_MRT4530_92556C.1
cccacgcgtccgcccaccggccgggacacgacgctcgcactcctctcctctcatctgacatatctcctcccgtcctttcgaagcctctcgaatcgcatcgccgagccggatggcggtcaccgccgacgtgaagctcgagggcctccgcgccgccaccgacaagctcgaccagatcagcgagaacgagaagtccgggttcatcagcctcgtttcgcgctacctcagcggcgaggcggagcagatcgagtggagtaagatccagaccccgaccgacgaggtggtggttccctacgacacgctctcggctgctcccgaagatctcaacgagacgaagaagctgctcgacaaactcgtcgtgctcaagctcaatggaggcctcgggacgaccatgggctgcactggtcccaagtctgtcattgaagtccgcaatggctttacgtttctagaccttattgtgattcaaattgagtccctgaacaagaagtatggatgcaatgtccctttgcttctaatgaactcattcaacactcatgatgacacacagaagattgttgagaagtactccaactccaacattgaaattcacactttcaaccagagccaatatcctcgcattgttactgaagacttcttgccacttccaagcaaggggaagactggcaaggatggctggtatcccccaggccatggtgatgtgttcccctccttgaataacagtggaaaacttgataccttgttggcacagggcaaggagtatgtctttgtcgcgaactcggacaacttgggtgctattgttgacatcaagtttgaatccttaaccatcacagagatcttaaaccacctgatccataaccagaacgagtactgtatggaggttactcctaaaacattggctgatgttaaaggtggtaccctcatctcttacgaagggagagttcagctgttggagattgctcaagtccctgatgagcatgtgaatgaattcaagtcaattgagaagttcaagatcttcaataccaacaacctgtgggtgaacttgaaggccatcaagaggctggtagaagctgaagcacttaagatggaaatcattcctaaccctaaggaagttgatggtgtgaaagttctgcaactcgaaactgcagctggagcagccattcggttctttgaaaaagcaattggcattaatgttccccgctcgagatttctgccagtcaaggctacatctgatttgttgcttgtacagtctgatttgtacaccttggtcgatggctttgtcatccgcaacccagccagaacaaacccatcaaacccttcgattgagcttggacctgagttcaagaaggttgccaatttcctggcccggtttaagtcaatccccagcattgtcgagcttgacaccttgaaggtctctggtgatgtctggttcggctctggagttacactcaagggtaaggtgaccatcaccgccaagtcagggaagttggagatcccagatggagccgtgcttgagaacaaggacatcaacggtccggaggatctttgaggctgctcacggaaaccttccagatatatttagctgagcgttttgtaattgtcgtgtgcattcggcagccagggctcgatgatcccattacagaataattgtaatcatcttggcacatccgtacttctgttttttggtgtgccaagggcgttgtatttcatttacttaaatgatctcgtaataccatagttttgcatgcactgtagctgggagctcgtagtttactggtaattctattcagagtttactactaaaaaaaaaaaaaaaaaaaaaaaaaaaaaaaaaaaaaaggggggggg

SEQ ID NO: 3512 - DNA, 1353 bp, Oryza sativa
  Clone ID: PAT_MRT4530_92598C.1
tcgcgtcggtgtgccagcaccctcccggcggccggagcggcgcgacttcccatctaacatattgcttccggcagccgccgccggacaccatggctgactctccgagcccacgcctggacgaggaggacgccttcggccgcgacttcaactcgtccccttcgcccacagccccacccgcccgctccggcgagaagaggccgttcggcgatctggacgacgatgacgaggacgttttcgcttccaagaagggaaagacaaaggtggaagaaagtgcgccaggtgctgccacgggaatgattctgtctcttcgcgagagtttgcagaactgtaaagataatcttgcgtcatgtcaggtggaacgggaggctgccaaatcagaagttcaaaagtggcattcagcatttcagaacattccagctgtacctgctggaaccaatccagatcctgtttcggttgtttcttatctcaataacctgaagtcgtcggaagaatcattgaaggagcagctggagaaagctaagaaaagagaggcggctttcattgtaacatttgcgaaacgtgaacaagaaattgcagaactgaagtctgcagttagggatttgaaaactcaattaaggccaccatcgatgcagacaaggagattattgcttgatccagcaatccacgaggaatttacacgattaaagaatcttgtggaggagaaggagaaaaagatcaaggaactacaggacaatgttgctgctgtcaattttactccatccagtaaacatgggaaaatgctaatggccaagtgtagaacattgcaagaggaaaatgaagagattggggcgatggcttctgaaggaaaaatccatgaacttggaatgaaaattgcagttttgaagactcggaacaatgaactcaggaatcagttcaatgagctgtataaacacatggatggtctaacaaatgacgttgaaagatcaaatgaaatggtggccattcttcaagatgagttagaaacaaaagatgtagagctgagaagattgaaggagatgcttgcccagaaagaagcaactgatgagaacaaaatacctcaagaaaatgacgtcgctggagatgatatagttgctgccgccgagagtcagccaataaaagtagaaacataagctacgccttcagcagtcatttctagagtagcttgcgttctcaacattcttattattttttgtatcatgtatcagaagtgtttacttgtgtaatttatctaatgtcgtttattcttgccgatttgcattgcgctttgtctgagcactgcagcatgagacgtgttacctacttaccttgaatctaaactctcttagttcgtgcgtc

SEQ ID NO: 3513 - DNA, 1380 bp, Oryza sativa
  Clone ID: PAT_MRT4530_92707C.1
atggtctcatacgtcggcccaagcacggcacggcccacaagcgggcgtgcctgggccggctacagtgatgatgccgcggcagtgcgggaatcgcgcgttgctagcggagggatcgagcacggtggtggtcgtccatggccgcaagaccagaggtggtatcagcactgtcacctccagcaggaggaggagccatggcggtgtcagatcaaggcccacacggtgctgcaaggttcagatgctctaagcagcatcagggagtggagcaggtcgcatttggtcaccatgacagggctggtggcgtgtgctgttcttgtagtcccttctgccgatgctgtggatgctctcaagacatgcacttgccttctcaaggagtgcagaatagagctggccaaatgcatagcaaacccatcctgtgcagcgaatgtagcatgcttaaatacatgcaacaatcgccctgacgagactgaatgccagatcaaatgtggagatctgtttgagaacactgtggtcgatgagttcaacgagtgtgctgtttcgcgcaagaaatgcgtcccacaaaagtccgacgttggcgagttcccagtccctgatccatccgcccttgtcaagaacttcaacatggctgatttcaacggcaagtggtatatttcaagtggcctcaatcccactttcgacacattcgattgccaacttcacgagttccgtgtcgagggagacaaacttatagcgaacttgacatggagaattcgcacccccgactctggcttcttcaccagaacagccatacagcggtttgtgcaggacccagcacaacccgcgatcctctataaccatgacaacgagttcctgcactatcaagatgactggtacattatctcatccaaagtagagaacaaggaagatgactacattttcgtgtactaccgcggcagaaatgatgcgtgggatggatatggaggtgctgttctgtacaccagaagcaaagttgtgcctgaatcaatagtacctgagctagaaagggcggcaaaaagcgtaggtcgtgacttctccacattcatcagaaccgacaacacctgcggtcctgagccacctcttgtggagagaatagagaagaccgtcgagcaaggagagaagaccatcatcagggaagtgcaggagatcgagggcgagatcgagggagaggtgaaggagctggaggaggaggaggtcacattgttcaagaggttgacagatggcctcatggaggtgaaacaggacttgatgaacttctttcaggggctaagcaaggaggagatggagcttttggatcagatgaacatggaagcaactgaggttgagaaggtcttcagccgcgccctgccaataaggaaactaaggtag

SEQ ID NO: 3514 - DNA, 1887 bp, Oryza sativa
  Clone ID: PAT_MRT4530_92709C.1
ggcggcgcgcgcgttatccatctccccctcgccgccgccctatcgccgctgctcgagctctcgatcccctcctcctcgctccgccggccgccgcggccgcaacccagatgatgccgcggcagtgcgggaatcgcgcgttgctagcggagggatcgagcacggtggtggtcgtccatggccgcaagaccagaggtggtatcagcactgtcacctccagcaggaggaggagccatgggcggtgtcaggtaccaccggtgctgccccccgagggcttacctatggaggaagggcgatcatcttcctctccatcatgccaaaatctctgctcgttgttccgagatcaaggcccacacggtgctgcaaggttcagatgctctaagcagcatcagggagtggagcaggtcgcatttggtcaccatgacagggctggtggcgtgtgctgttcttgtagtcccttctgccgatgctgtggatgctctcaagacatgcacttgccttctcaaggagtgcagaatagagctggccaaatgcatagcaaacccatcctgtgcagcgaatgtagcatgcttaaatacatgcaacaatcgccctgacgagactgaatgccagatcaaatgtggagatctgtttgagaacactgtggtcgatgagttcaacgagtgtgctgtttcgcgcaagaaatgcgtcccacaaaagtccgacgttggcgagttcccagtccctgatccatccgcccttgtcaagaacttcaacatggctgatttcaacggcaagtggtatatttcaagtggcctcaatcccactttcgacacattcgattgccaacttcacgagttccgtgtcgagggagacaaacttatagcgaacttgacatggagaattcgcacccccgactctggcttcttcaccagaacagccatacagcggtttgtgcaggacccagcacaacccgcgatcctctataaccatgacaacgagttcctgcactatcaagatgactggtacattatctcatccaaagtagagaacaaggaagatgactacattttcgtgtactaccgcggcagaaatgatgcgtgggatggatatggaggtgctgttctgtacaccagaagcaaagttgtgcctgaatcaatagtacctgagctagaaagggcggcaaaaagcgtaggtcgtgacttctccacattcatcagaaccgacaacacctgcggtcctgagccacctcttgtggagagaatagagaagaccgtcgagcaaggagagaagaccatcatcagggaagtgcaggagatcgagggcgagatcgagggagaggtgaaggagctggaggaggaggaggtcacattgttcaagaggttgacagatggcctcatggaggtgaaacaggacttgatgaacttctttcaggggctaagcaaggaggagatggagcttttggatcagatgaacatggaagcaactgaggttgagaaggtcttcagccgcgccctgccaataaggaaactaaggtagcttctagttgccactccagcaagtacaaggcaacaagtaatgctcaaaatatattctattcaccaaggcaataccaatagtaacagattattctacagagaacaaagaattttcgaatccgctaatgcatccccattattacaatacatttccagcttagagctatgtaaagtatcagtaactatgtaacttccattaaaaaaaggtatatagtgaactttgtacaactgttccaaatatgatatggattatgtccttttgatgacgatagtttgaatgctgttaattttcttcggtactttatggcaatttaggttatgtcaaatgcaaataatattgaattgtagcttcataattccaaaaaaaaaaaaa

SEQ ID NO: 3515 - DNA, 1951 bp, Oryza sativa
  Clone ID: PAT_MRT4530_93023C.1
aattgcatccgagctcacctagcttctctcttgcaaccagcgattcgatcgattccatctccaagaagcagcggctagcagcagctagtagttgccatggactcgtcgacggtgggcgctccggggagctcgctgcacggcgtgacggggcgcgagccggcgttcgcgttctcgacggaggtgggcggcgaggacgcggcggcggcgagcaagttcgacttgccggtggactcggagcacaaggcgaagacgatcaggttgctgtcgttcgcgaacccgcatatgaggacgttccacctatcatggatctccttcttctcctgcttcgtctccaccttcgccgccgcccctctcgtccccatcatccgcgacaacctcaacctcaccaaggccgacatcggcaacgccggcgtcgcctccgtctccggctccatcttctccaggctcgccatgggcgccatctgcgacatgctcggcccgcgctacggctgcgccttcctcatcatgctcgccgcgcccaccgtcttctgcatgtcgctcatcgactccgccgcggggtacatcgccgtgcgcttcctcatcggcttctccctcgccaccttcgtgtcatgccagtactggatgagcaccatgttcaacagcaagatcatcggcctcgtcaacggcctcgccgccgggtggggaaacatgggcggcggcgcgacgcagctcatcatgccgctcgtctacgacgtgatccgcaagtgcggcgcgacgccgttcacggcgtggaggctggcctacttcgtgccggggacgctgcacgtggtgatgggcgtgctggtgctgacgctggggcaggacctccccgacggcaacctgcgcagcctgcagaagaagggtgacgtcaacagggacagcttctccagggtgctctggtacgccgtcaccaactaccgcacctggatcttcgtcctcctctacggctactccatgggcgtcgagctcaccaccgacaacgtcatcgccgagtacttctacgatcgcttcgacctcgacctccgcgtcgccggcatcatcgccgcatccttcggcatggccaacatcgtcgcgcgccccaccggcggcctcctctcggacctcggcgcgcgctacttcggcatgcgcgcccgcctctggaacatttggatcctccagaccgccggcggcgcgttctgcctcctgctcggccgcgcatccaccctccccacctccgtcgtctgcatggtcctcttctccttctgcgcgcaggccgcctgcggcgccatcttcggcgtcatccccttcgtctcccgccgctcgctcggcatcatctccggcatgaccggcgccggcggcaacttcggcgccgggctcacgcagctgctcttcttcacgtcgtcgaggtactccacgggcacggggctggagtacatgggcatcatgatcatggcgtgcacgctgccggtggtgctcgtccatttcccgcagtggggctccatgttcctcccgcccaacgccggcgccgaggaggagcactactacggctccgagtggagcgaacaggagaagagcaagggcctccacggtgcaagtctcaagttcgccgagaactcccgctccgagcgtggccgccgcaacgtcatcaacgccgccgccgccgccgccacgccgcccaacaactcgccggagcacgcctaaggcgtaaacaattctgcgaccgagaccagcaatacgctggagttcgactcgatgataacacgccggagcacgtccttgttgcaaacggtgatgaaattaagagtgaaatatttccttaggaattgaatcctttgaaattaattcctttggaatttctccgatacaaacggaggtataataagggagaggcatttatacctatgtacatgttacacttttttgaaaaaaaagtgtattccatattgatgttgtc

SEQ ID NO: 3516 - DNA, 404 bp, Oryza sativa
  Clone ID: PAT_MRT4530_93123C.1
ctcacgcattcgaaccaatactacctgttccaccacaagaaggacgacgagcacgacaccggaggtagactcctacggagggggcgtctacacatcgaatacggtgaccaccgatgtgttcatcggcggacaaaacgagtacaagaggtacaagatggaggagaagtagcacacgcacaagcagcacctggtggaggccggcgccctcgtcgacggcgccttcatcatgtatgagaagcacgaggcgaagaaggacccggagaacgcgcacaagcacaagatcatggaggagatcgcgttcacagactggttcaacgccggaaggtacaccttacacgagcaccacgagaagaataaggaccacacgagcgccgaggagtccaccggcgagaagaaacaccacc

SEQ ID NO: 3517 - DNA, 1809 bp, Oryza sativa
  Clone ID: PAT_MRT4530_93287C.1
atggatacgctgtttaggttggttagcctccaagccgcctccgagcagcagcagcagcagcagcagtcggcgtcctacaactcgaggagcacgacgtcgagcgggtccaggtcgtcgtcgcaccagacgaacgcgtcctacagctactaccaccacagcagcaacagcggcggcggcggcggaggcggcggagggtactactacggcggccagcagccgccgccgtcgcagtactactacctggagccgtaccaagaagaatgcggcaacgccccacaccaccagctttacatggatgaagacttctcctcctcgtcgtcgtcgaggcacttccaccacggcgcgcgggtgcagcagcagcagccgccggcgtcgtccacgcccacggggacggcgccgacgccgccgctgtcgacctcgtccaccgcggcgggcgccgggcacggcctgttcgaggcggcggacctgtcgttcccgccggacctcaacctcgacttctcgtccccggcgtcgtcgtccggcggcgggacagcgtcgtcgggcgcggttgggggcggcggcggcgggaggtgggctagccagctgctgctggagtgcgcgcggtcggtggccgcccgcgacagccagcgcgtgcagcagctcatgtggatgctcaacgagctcgcgtcgccgtacggcgacgtggagcagaagctggcttcctacttcttgcaggggctgttcgctcggctcacggcgtccgggccgcgcacgctgcgcacgctcgccgcggcgtccgaccggaacacgtcgttcgactcgacgcggcgcacggcgctgcggttccaggagctcagcccctggtcctcgtttgggcacgtcgccgccaatggcgccatcctcgagtccttcctggaggtcgccgccgcggcgtcgtcggagacgcagcggttccacatcctcgacctgagcaacacgttctgcacgcagtggccgacgctgctggaggcgctggccacgcggtccgccgacgagacgccgcacctctcgatcaccaccgtggtgtccgccgcgccgtccgcgcccacggcggcggtgcagcgcgtcatgcgggagatcgggcagcgcatggagaagttcgcgcggctcatgggcgtgcccttccgcttccgcgccgtgcaccactccggggacctcgcggagctcgacctcgacgcgctcgacctccgcgagggcggcgccaccaccgcgctcgccgtcaactgcgtcaactcgctgcgcggcgtggttcccggcagggcccgccggcgcgacgcgttcgcggcgtcgctccgccggctggacccgcgggtcgtcaccgtcgtcgaggaggaggcggacctggtggcgtccgatcccgacgcgtcgtcggcgacggaggaaggcggcgacacggaggcggcgttcctcaaggtgttcggcgagggcttgcgcttcttctcggcgtacatggattcgctcgaggagagcttccccaagacgagcaacgagaggctggcattggagaggggagcagggcgcgccatcgtcgacttggtctcgtgcccggcgtcggagtcgatggagcggcgggagacggcggcgtcgtgggcgcggcgcatgcggtcggccgggttctctccggtggcattcagcgaggacgtcgccgacgacgtgcgatcgctgctgcgccggtacagggaagggtggtcgatgcgcgaggccggcacggacgactcggcggccggagccggcgtcttcctcgcgtggaaggagcagcctctggtgtgggcaagcgcgtggcggccatga

SEQ ID NO: 3518 - DNA, 1491 bp, Oryza sativa
  Clone ID: PAT_MRT4530_9330C.1
atgagagaagggaatgtcacacatcatgagtatatgcaagttggtaaggggcgtgatgtgggaatgaatcaaatttcaagctttgaagctaaggtggcaaatggcaatggtgaacaaacattgagtcgtgatatctatcggctggggcgcagattcgatttttatagaatgctatccttctactttactacagttgggttttactttagtagcatggttacagtacttacagtttatgtgtttctatatgggaggttatatctagttatgagtggtctggaaaggtctattttgctggatccacgtatcgagcagaacattaagcctcttgaaaacgcactggcctcgcagtcttttttccagctaggtttgctgcttgttctccctatggtaatggaagttggcttagaaaagggattccgcacagcattaggagagtttgttatcatgcagcttcagctggcatctgtgtttttcacattccagcttggcaccaaaacgcactactacggaagaacaatactgcatggcggggctaaatacagacctacaggtcgtggatttgttgtctaccatgcaaagtttgctgacaattaccgcatgtactcccgcagccactttgttaaaggacttgaactgttgatacttctggtggtttatttagtgtatggaagttcctaccgcagctcaagcatgtacctatttgtcaccttctccatatggttcctggttgcatcttggctcttcgcaccctttatcttcaatccgtcatgcttcgaatggcagaagacagttgatgactggacagattggaggaagtggatggggaaccgtgggggtatcggcatgtctgtggatcaaagctgggaggcttggtggataagtgagcaggagcaccttaggaagactagcattcgctctctcctcttggaaatcattctttcgctccgcttcttgatctatcagtacggtattgtgtaccatctgaacatagcacgccgcagcaaaagcattctggtatatggattgtcatggctggttatgctctcagtcctagtagttctaaagatggtttcgattgggcgacagaagtttggaacagatctgcagcttatgttccgcattctcaagggcctcctgttccttggttttgtctctgtgatggctgtattattcgtcgtttgtaacctcacaatttcggatgtttttgctagtattcttgggttcatgcctactggttggtgcattcttctgattgggcaggcatgttcgccgttggtgaagaaggcaatgctgtgggattccatcatggagctcgggaggtcgtacgagaacctgatgggactcgtcctcttcctccccatcggcctcttgtcatggttccccttcgtgtccgagttccagacacgactgctcttcaaccaggccttcagccgtggcctccagatctcaaggatcctcgccgggcaaaaggacattggagaggaatga

SEQ ID NO: 3519 - DNA, 2043 bp, Oryza sativa
  Clone ID: PAT_MRT4530_94258C.1
atggcggcgccgtcggcggccacgcgcaggaagctgcagcgcaagttcaagctgcgaggcttcaccctcaaggtggacgccctcgaggaggccgccgccttcctcgcccgcttccccgacgccgaggacgacgccctcgacctcctcctcgacgagctcgacaaggagccgctgcagtcgtcgattcttgaccgggacgcggtgcggcgcgtggtggcgctgctcgtcgaggcggacgaggcggtggatgcggcgtctccggcggccaccagcgcgcgctcggcgctgcgggtggtggattcgttcgtcgtgccaaggttccactacgatccgatcaagaaagtcttctacgaattagccatacatggagaagctggagataaagcagccctgtacagggacaggtatcaggttctgcttcagaggctagctcgtgatatatacttctctaagccagcttttgacactgttatgaccgaagatgataattgtgaggtaaatacatgtggattccctcctttagaggatagagaagcatcactttcgatgcttatggggctagatttcttcggtggaggcccttctaaagcccttccaaggtgtgcacttccgaaatatctaactgaggaactgcagaagcacatcccaaatgcaatattcgtaagcaacccttgcagcacccacgggcacgctgtggactgccggctggtccactacacacggtccatcgcggatgctcagccacaggacgtgccgcagtggagctgggccgagaggtttgccataggtcgaccagtggtggacagcgcaccctacggggttggtcgcagcgcgcagtggccagaggacggtcccacgatggggacttactggtgtcgacgtgggcgtcgttacgctcacgtccaggtgagacgaggttacccggacttcgtgtttgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgttagctacagaggaggtgatcaacgagctcttcctacacacggaggagaactaccgtgactaccttcgctggtaccttcctcgcactcatgcgcgtgtgaccttcactccagacgccccagagccgcacgttgctgctgtcacggacgcgtatcccacgcaccgtgaccgagactacttcgtgggggccgatgccgcacgggatatcagtgccaatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggacctcgtttgccttcgagcgcccctagcttcggagcagtgcgacctacagcaccggaactcgtctgccttcgagcgcgttcacagccacgaccggcgcttccgcgagctccgcaggggcattcgccagcacttccggcgcgttcgccacctcttcgagcgcgttcgccagctcttcctctcacggagcgtcgatccctcgtccacacgccgggatcttcggtactggggcctcttcgtctcacgccgcttggaggagctccagaggcgcacactcaggagcagccagaggtcacacctgtacaggcaggacgggttggccgtgccatacccccggaccgactcacgtactcccaggggcacgttagggcgcaggcgtgacacgcttgaccagactgcaataaatgctgttaggaggagggcggacacctcaccctcgggcccgacgtccccgaaggtgccaggccacgtgggcgattgcgtctgcctcaagcctctggtcatgatactcccggtcccatatcaccgacagtag

SEQ ID NO: 3520 - DNA, 666 bp, Oryza sativa
  Clone ID: PAT_MRT4530_94515C.1
aacaacaaaattacttcctcggtttcactacttgcatgccattatgtcaaccatttttttgtgttgttccacaatgcttgcctcctttaccttcttaagtaagtatcatccactcacgtagaccatatgttttaacttttgaatggccttccaaggtattatcctctgtccacatatgcaaggcctgttcttgattcgctttgtccacaaatgtaaatatttcatacccctgtgcaaaacaagtataatgtcctttatacctctgataagtatccaactttccaatatgcatgtgttaaatatagtagctagagagaataaatagtaaaagtctttttcaatctcattttgaggaaaatatgccatacatttctgaatggcgggagtactagtatttactcatttgaagaattttaccccttgtttttcttatggcaccaaaaacacccctgctgttaagtctctatttaatgtacagataaacatttttttaggagaaaaaaatagatattaggaatagcttcaccttcacctctctctgtactccctctgccccataaagattcaacttttttctacacgaatttggacacaccctatttgtccagatttgtgtataaaagtttatttatttcgggaggatggaagtatatgtttaatataatg

SEQ ID NO: 3521 - DNA, 2903 bp, Oryza sativa
  Clone ID: PAT_MRT4530_94553C.1
gtggtgctgcagcccagccggccgcaccccgaaaccctcctccacggccgcctccccgccgcgccgccggccgccgccgccgccgccatcgcgtctaggatccccgccctcctccgtcgcctctcctcttctcccggagacggtcagtgccggcgacgactggggctcgtcctggtccaccggcatcaccaaggaacactgcgacggccccggctccccggtcggttgcgcggtcacctccccgccggagacgggctggcctgagcgtggggccagcgggcgcggcgggggccgggccgcgcgcggcggcggcgagcggccacgggaatggggccaccggtggagcgcgaaactggaggggctgcggcggccgctggcctacgggcgaccgggagccgctccgcgtcgtcggtccgcgggcgccggggcccatgggggagcgtcttctgcgcgctgatgcaggtcgcgtaggggcacctccgcgacaaggtccaggtacgcatctggcgccgcccgggccgcgccgtcgaccgggccaccgccgagcacctgcttcgaggtcatcaacgcccgggaggacagcatccgccgcaagatccgccgcggcgcctacatcaagtacgtcgagagccgccccagcgactgcaccctctacgccgacaagatactcagggtcagcttctgcctcaacatgatcgacgagtcgctcatcacgctcaagggcgtcacctacctccaggaggccgtctgagaagccgacattgtgatgaactggctgccgtccacggaaaccagggaagtcttcgggtggattaggaggtactggaaggcgaggagtactgcccccagcaggtgctctgtgaccagaagggtcgacgccgcagccgacgacggctggaccaagattgtagctacacgagggacgaactccaagcggaggggaggtggagccgagaagatggctagtcttgcagatgtttacatgaccccacaaaacgacaactaaaagatttctagaaggaggctaagtccagcacgccggaggagaataatcccacccatcatgtagcaataggctactctacttacatgtgtgcagattgtcctagcactgttgcagcattaggcaagaaagcagaaacactgaaaccggctcaagttttacccaccacttctggtcctgtcctcttcaagcatagggaggccaaacctaccggtggttattgtattcatgtcatttgtagcaagttccgttgcccccttttatatgggaaggctgcgacgacaagggaaggcggagaggtggaggagggagcaatgggcggggcggaggacgcgccgcgcgcggcggcggcgaacgggcacgggaatggggccaccgtggaggagaagctggacgagctgcggcgcctgctgggcaaggccgacggcgacccgctccggatcgtcggcgtcggcgccggggcctgggggagcgtcttctgcgcgctgatgcaggacgcgtacggacacctccgcgacaaggtgcaggtccgcatctggcgccgcccgggccgcgccgtcgaccgcgccaccgccgagcacctcttcgaggtcatcaacgcccgggaggacgtcctccgccgcctgatccgccgctgcgcctacctcaagtacgtcgagggccgcctcggcgaccgcaccctctacgccgacgagatactcagggacggcttctgcctcaacatgatcgacacgccgctctgcccgctcaaggtcgtcaccaacctccaggaggccgtctgggacgccgacattgtcatcaacgggctgccgtccacggacaccagggaagtcttcggggagattgggaggtactggaaggagaggattactgcccccatcatcctctctctggccaaagggatagaggcctccctggatcccctgccacggatcataactcccacacagatgattagcaatgcaacgggggttccattggagaacattctttatcttggaggccctaacattgcttcagaaatttacaacaaagaatatgcaaatgctcgtatatgtggagctgacaaatggagaaaacctctagctaaatttttgaggcagcctcattttattgtatgggataatagtgatctcattactcatgaagtcatgggaggtttgaaaaatgtgtatgccattggtgccggtatggtggcagctctaacaaatgagagtgcaaccagcaaatccgtttactttgctctttgcacatctgaaatgatttacataacccaccttttggaagaagagcctgaaaaacttgctgggccattattggctgatacttatgtcacactgctgaagggtcgtaatgcatggtatgggcagaaactagctaaaggtgaactgactctagagatgggggacagtataaagggcaaagggactattcagggtgtctctgcagtccatgcattttatgagctcctgagccagagtagcttaagcgtgacacatccagaagtgaagaagcttgttgctccggtcgagctgtgcccaatactaaaggcactttataaaatcctaatcaagagggagcttgccactgactccattctccaggcaatacgagatgaatcaatgtatgatccacgggagaggattgagatggctcagcgccagtgtctttaccgaccatctcttcttggcctacctaaagtagatattacccaggcttagatctattcttttttttttctgcagatttgttttgagatttgcaggattctttgatgtattctttgcatagtggtcctcaagatccttccttgtgtgccaagtgcatctcgtgttcgaacactgattccattctctactagagaatttgataatgaggtgttttggttttttattgtcag

SEQ ID NO: 3522 - DNA, 2589 bp, Oryza sativa
  Clone ID: PAT_MRT4530_94738C.1
ccgcgccccccccgacttcctcagctgtcttccccctcctgcatgttttttttttttttttttttttttttttttttttttttttttttttgcaagaaacctttttcagctaattacattttataattaaccaagagtaagttacatgtagtatgccaaaaaatccggccggcaaagtaaagttagtgtacaccaagaatcgaaaatatgaacatcttacagcatgttccattcctacaaaactagtgggatttaggcagggagagctgccggcgtggctgggggaacccggttctcgacagggatctccgtgaactcggagagaatcgccctgaactcgtcaccactcaatgtctccttctcaaggagcacctccacgatcttgtccatggcctcccggttgctcctgatctggctcaaagcgatctcgtaggcctcatcggacaaccgcttcacagcggtatcgatgtcctccgcgagcttctccgacatggagttccttgccatcatcctcatgatgacatcgccgctctgagctcctgagtccattagcgaccacggaccaatgtccgacataccgaatgtaaccaccatctgcttggctaggccagtaatttgctgcaagtcaccagcagctcctgtggtcacctcaggctccccaaaaatgatctcctcagcagcacgaccgccaaggccaccaacaattctggcgaacagttgttgcctggagatgagcgttgggtcgtccattggaatgaaccatgtgagaccacgagcttgacccctcgggatcaaagtaaccttttggacagggtcgtggccaggcgtcaaagttccacaaattgcatgcccaacttcatggtaagcaacaagacttttgctcttcccatctgtcatcacagttccttccataccagccactattctgtcaattgaatcatcaatctcctttgaggaaattgctgtccgaccacgtcggcccgctaatatggctgcttcatttagaagatttgccaagtctgctccactaaagccaggtgttctcattgctatgacttcaagagagacatcagtatcgaacttcttgttgctaccgtgcaccttaagaatctctgtccttccgcgtacatcaggaacatcaacacttacctgtctgtcaaaacgtccaggtctgagtaaagcagaatccaggatatcagccctgttggtggcagcaataacaatgattccagtgttcccctcaaaaccatccatctcagtcagcaactgattcaaagtctgctccctttcatcatttccaccaccaatacctgtccctctttgcctcccaacagcatcaatttcatcaacaaatactatgcaaggagcattctcctttgccttcttgaagagatcacgaacccgggaggcaccaactccgacaaacatctccacaaactcagatcctgatatcgagaaaaacggcacaccagcttcccctgcaatagccttggcaagcaaagtcttaccagttccaggaggaccaacaagcagaacacccttagggatgcgagcaccaacagcggtgaacctttctggtttcttcaagaactcaaccacttccatgaagtcttgctttgcttcatcgacaccagcaacatcatcaaatgtaacaccagtgttgggttccatctgaaacttggccctagattgaccaaaaccaaggggaaagccaggaccgttaggtccaccaaggccaccttgtgctcttcttgacagcaaaaatagaccaccaataaggataagtgggaaagccaagtttccgatcaggttgaacagaagagaaccagagtcctcctggttgctgtgtgcagcaaaatcgatattcttttccctcaacttctggagaagctcctggcttagaccaggaagctgcacacgaactctctgcacacggttgccgagctcaggagaaatagcctctacaatggcaatcgtgccattctcaaacaaatcaaccttcttcactctgtccttgtctagatactcaaggaacctcgagtaagacattctcgacgacgagacaccttgctcttcagcaagagctctcttagcacccaacaaggtgggaagcccgaccccgaggttcccaagcgcgagctttaggaacttccttctggcatcattagtcttgtgctcgagggaggcagtcacagaaactggcctctgtgcaacgccactcgaaggaagtgtcgagaagggaagcggcgtctttgcagcaaggctcatggatgttggagccatcttcgctcactgagtggatcggagcggggcgtggaggggagagggggggggggtgggccgaactaggaaggggagggaggagggagtggagtgtataaatagcccgacaccgacgaggagggtagcggcagattgatttttcctcctccgctcgcttggcctctctctctctctctccggtgcgcagttgcgtggggatttggggaggaagaggaggagagggggatgggggcgacgtggccgcctccgtgcccacagcgtcgataaggaagagatgagcccacttagacggaagccaaagcccat

SEQ ID NO: 3523 - DNA, 1230 bp, Oryza sativa
  Clone ID: PAT_MRT4530_94829C.1
tttttttttttttttgtcaagcatcaatgtatataaactggaaattggtgcaaattgcaaacaagatttggggaagaactattcttacatgtatacaacacatggagacaacatcccaataattgtacatcatatccatcaaaacagtcaaaactaaaaaaagaaaagaaaataaaatggctcctcctaattatagtactacatatgaggctataaaaagccagatgcttatcctacatctacatgcaaatattctatgaacacttcatgtaaatacgcaaaataacttatgccacatttggcaggaagaaactgcacgcaccacaacgccacagggatatgctggcaattcttttaccatcttctatcaccaggtgaatctgttaacaatcttaaaatgcaagaaggcttgcaaccacaagaaatccaaccatgattagcagggccttcaggtagatgtctgcctgctgcggttgctccagtggtccttgtcgagggacaccgtgggcggcatgacccatatgtccgccatggaatccatgaccatggccatacccatagtgaaacccagcaggctgtgcataaggatttgcatctggaaatccatgcacttggaagctaagcatagggaataggcctccaaacgcagctgagaatgcataattcccccaccgtgcattagccaatggtactccagtgcccatgaaccatggattggcattagcattaggattggcatgggcaaaattgttgttaggatcggcctgtggagctgtggcaggcctctggccagttgggcggttaggaatgtcagcctcgggtatgttctttgaccttggatcgacgcggtccttgccacgcccataaaggggaacgagcttatcctcttcaacgacagctttgcacaccgggcactctggagagtgtgcgtggatgtgcaaccacctgtaaatacatggccagcagaagaggtggccacagagagtaactattggttcttgtggcaattcaaagcagatattgcattcaaagctccccccagctgcatcgccattggtgccgctgcttgtagattccccaacattggctgccatcttgctgtttcttcaaagtgcaagaagctcctcctcctctcggcgagcgtggggatccgcgacgcggcggcggcggcggcgtggctcgatccgacggcgaggccacgcgggggaaggcgaggcgaggcgaggcgac

SEQ ID NO: 3524 - DNA, 3141 bp, Oryza sativa
  Clone ID: PAT_MRT4530_94961C.1
atgggttgctcctcctccgtgccagctcgaagcactggagggttgaacaatattagcaacgataactccgctactgattcaaaggacttgcgtgctaagttggtattgcttggtgactctggtgtagggaaaagttgcattgttcttcgctttgttcgtggtcagtttgatcccacttccaaggtaactgtcggtgcatcatttttatcacaaacattggctttggaggactcaacaatagtgaaatttgaaatatgggataccgctggacaagagagaggagctgctgctgcagttgttgtctacgacataactagtccagaatcatttagcaaagcacaatactgggtgaaggaacttcaaaaacatggtagtcctgatattatcatggttttggttggtaataaagctgatctacatgaaaatcgacatgtatcttctcaggaagcacaagagtatgcagagaagaataatatggttttcatcgagacatcagcaaagacagctgataatataaaccaagtatttgaggtcaccgtttttgcattagggttccgagcccgaatgcgccctgtgttagttagaagaggtttggggaaggggaagaaggatttctcgacggcgatcctcgagaggaagaagtcgccgaaccggctggtggtcgacgaggccaccaacgatgataactccgtcatcgggatgcaccccgacaccatggagaagctccagcttttccgcggcgacactgtgctgctcaagggtaagaagagaaaagacaccatctgcattgttcttgctgatgacacctgcgaggagccgaagatcagaatgaacaaggttgtcaggaagaacctgagagtacgacttggtgatgtcgtgtctgttcatcaatgcccagatgtcaaatacggcaagcgtgtgcacatacttccaattgatgatactgttgagggcatcaccggaaacttgtttgatgccttcctgaaaccgtacttccttgaagcataccgtcctttgaggaaaggagaccttttccttgttaggggtgggatgagaagtgttgaattcaaagttatagagactgaccctgcagagtactgcattgttgcacctgatacggagatattctgtgatggtgagcctattaagagggaggatgaggaaagacttgatgaagttggttacgatgatgttgggtggagttaggaagcagatggcccaaatcagagaacttgttgagctcccattgcgccatccccaacttttcaagtctattggtgtgaagcctccaaagggcatactgctttatggaccccctggctctggaaagaccctcattgctagagctgttgctaatgaaacaggtgctttcttctttctgattaatggcccggagattatgtcaaagctagcaggagaaagtgagagtaatctcaggaaggcatttgaagaagctgagaagaatgcaccatcaatcattttcatcgatgagatagactccatagcaccaaagagagagaagacccatggagaagttgagaggcgcatcgtttcacagctgttgactcttatggatgggctcaaagctcgttcccatgtcattgtcatgggtgctacaaaccggccaaacagtattgatcctgctctcagaaggtttggtaggttcgatcgggagattgacattggtgttcctgatgaagttgggcggcttgaagttcttcggattcacaccaaaaacatgaagctggctgaagatgttgacctggaacacattgccaaagacactcatgggtatgtgggtgctgatcttgctgctctttgcactgaggctgctctccaatgcatccgtgagaagatggatattatagatcttgaggatgagaccatagatgctgagatacttaactcgatggctgttacaaatgatcacttcaagactgcactagggacaagcaacccgtctgctctccgtgaaactgttgttgaagttccaaatgtctcttgggaggatattggtggactggagaatgtcaaacgggagctgcaggagactgtccaatatccagtggagcatcctgagaaatttgagaagtttggcatgtctccgtccaaaggtgttctgttctatggccctcctggctgtggtaagactttgttggccaaggcaattgctaacgagtgccaggctaacttcattagtgtcaagggacctgagctgcttaccatgtggtttggtgagagtgaggccaatgtgcgtgagatttttgacaaggctaggcagtcagctccttgtgtcctcttctttgatgagcttgactcaattgctacccagagaggaagcagtgttggtgatgccggaggtgctgctgatagagtgctgaaccagttgttgactgagatggacggcatgaacgcgaagaaaaccgtgttcattattggtgctactaacaggccagatatcattgaccctgccttgctaaggccagggcgtcttgatcagcttatctacattcctctgcctgatgatcaatctaggctgcagatcttcaaagcttgcctccggaagtcacctgtggccaaggatgtagacctgaatgctcttgccaaatacacccaaggtttcagtggtgctgatattacagaaatctgccagcgtgcatgcaaatacgccatcagagagaacattgaaaaggacatcgagatggagaagcggaggaaggacaaccctgaagccatggaggaggacgaggttgatgatattgctgagatcaaggcggctcacttcgaggagtcgatgaagtacgcacgccggagtgtgagtgacgccgacatccgcaagtaccaggccttcgcccagactctgcagcagtctcgtgggttcggcaccgagtttaggttcgctgaccagccagcgtctggcgccggcgccgccgctgaccccttcgcatccgctgccgccgcagctgacgatgatgatttatatagttagatcgctgtgctatttatatttaacctccgtgcttttgttcagtatgtctatttcgctttggtaaactttatcatatgtaacatacggggaaacagtgtactatttttaagttaatattttgagaggtactgaaccgaattgcatgtttctgt

SEQ ID NO: 3525 - DNA, 1052 bp, Oryza sativa
  Clone ID: PAT_MRT4530_95069C.1
ggagttcgctctcccgccgccgccgccgccgccgctcgcctgcgtcgatctccaccccgcgagcggagcagcggtgcccggcgtcgtctgctgcttccgccgcatcctccctcgctcgctgggcaaggatcttttattgcttttcttcccctggaatttttttagctagcaaggaacacggttgaaagtaggatgagtctctctaccatagcaagacgactatgttgttcaagaccaacatctgggggtcgtctttcagcggtttgggctcatttgtacagcacagaggctgccaaagacacaggtgctaagaagtataaataccctgaagtctatgatccatacgggcctatgtcacctccatcgcagaaagttgtggatcttgctgatcgcattgctgccctccctcctgaggagatcaaacagattgctccggctctccttctcagactgaaccaacccccaccacaggcaatttctggacagggtttcagtttcagtcctcaaggtggtggcggtgctgctggtgctgcaaaggcagaggagaagaaagcagagaaaacagtctttgacgtcaagctggagaaatttgacgctgctgctaaaattaagatcatcaaggagattagaacattcacagatttggggctgaaggaggcgaaggagctagtggagaaggcccctgtcattctgaagcagtcactcacgaaggaggaagctgaggcaatcatagagaagattaaggtagctggcggtgtcgctgtgatggagtgaaggattaactcctttggcactactacccttttgttttcttcaatttttgttagcatggtcaggcattagaggtcgcagtatctctacacttttgtaggaaatgttcagctgtgacaggtaaacatgggccatgatttggtctgaataaactttcttcgaccactacaactttcctgatgtattattgtgacattgggaccgagtgaatggaatgtagacagaattgcctatgctgatacctgtaacttgttctgcatctgttattgtaacttacaagc

SEQ ID NO: 3526 - DNA, 5406 bp, Oryza sativa
  Clone ID: PAT_MRT4530_95078C.1
cccgtgcggccgcgggagccacggggcccaggccggcgccggggtacacggcggcacgctgtgatcgagaagaaggaggacgggccgggctgccgctgcgggcacacgctcacggggtgccggccgtcggggaggaaggcacgccggggtacatcggccacgcctgatcctcttctggggcgccacggcgctcgagggcaactgctacacgccaccatcctcgggcgggagcgccgggatccgtcttgctggtgctacagcagatgtgcactgctacgatgtgtcatcaaataatgggagcaggagggggagctgctcatatcgcggctgctgctatcgctgccgccgcgtcggcggcggtggtggcgggcccgaggcccgcgccggggtagacggagggcggaaagaatattttcaagtgaaccaagtgtcctacagcttaaagctccaattaagatattgggtgatttgcacggtcaatttggtgacctaatgcgcttgtttgatgagtacggtgctccttcgacagctggagcgattgcttacattgattacctcttcttgggagattacgtggatcgtggtcagcactagtttggagagcttcacctcatctgctcgcccttaaggttgcatatcctcttagggtacatttagttcgagggtgtcatcaagccgatggtgggattggtcctgctggtttatctgcagaagaccttcatgttctggatcttacacaacaacgaccgcgatggcacagagtggtggttcaaggtcctggccctggttctcgatatggacatgtgatggctttggttgggcagcgtttcttgttgacaatcggtggaaatgatgggaagaggcccctggctgatgtgtgggcccttgatacagcagctaagccatatgtgttgaggaaacttgaaccagaaggtgaaggagcacctccatgcatgtatgcaactggaagtgcccgttgtgatggacttctattactctttggtgggagggatgctaatagtgtggttttcgtcaatgcacgacttcatgtcttaggaggaccccttggaggcggtcgcatggttgaagactcctcaaatgttgcagtgttggatcctgctgctggagtgtgatgtgatacaaaatcagtaattactactccaaggacaggaagagatagtgcagatgcagcaggcggtggtgcttctgtagagcttacacgacggtgcaggcatgcagctgctgcagttggtgatatgatatatgtttatggaggtctacggggaggtgtgctgctagatgaccttcttgttgccgaagatcttgctgctgctgaaacaacaaatgcagcaactgaggcagctgcacttgcttaaggctgtgatagacaaccctgaatagatcctgttagatatgcctacaatgatgaacagacaaggtagacagctacgatcacatcaccggatggagctgtggttctaggaaatccagttgctgctcccgttaatggggacatgtatactgatattagccctgagaacgctgtgatccagggacaaaggagaatgagcaaaggtgttgattatttggttgaagcatctgctgcagtggctgaggctatcagtgatacttaagctgctgtgatagctcagcaggttaatggtgaggcagagcattcgcccgacagggttaagtcgatggtcgccacagcgaatgtgaagcagaatgcaatcctgatagatccagactatttgctttccaataagtcaacactacctactggggtttggacacagcattcagcacttggggtactagcattaaccggaagtgccttagaaggcaaggtgaggcagctctagatggaccattatgagaaggggggaaggctgttagtgtatcttaagcttcagagaaggctaggcaggttaacgttgctatggaggaaaatcctgacaagtagcaatctccaaaatgcgcttcgatcagcaagcattcatccctcttcaaagcagacagtattatctctaacattattagacttccacgtggtggtaggttgcatcatagagctgttgtagtggctgcagaaactggaggtgccttaggtggcatggtcaggcagctgtcaattgaccaatttgaaaatgagggaagaagagtcagctatggcacccctgagaatgcaactgctgcaagaaagttgctagatcgacagatgtccattaatagtgttcctaaattacgtggttcgtcgccagcatagtttggagacaatcactcttctccttgcacttaaggttgaatatcctcttaatgtacatttgattcgagggaatcatgaggccgctgatatcaatgctttgtttgggttccgaatagagtgcatagagcgaatgggtgagcgtgatgggatctggacctggcatcgcatgaataggctatttaattggcttcctttggctgccctaatagagaagaaaataatatgtatgcatggtggtattggccggtctatcaatcatgttgaacaaattgagaatcttcaaagaccaattaccatggaagcaggctcggttgttctaatggatcttctgtggtctgatccaactgaaaatgatagtgttgaaggacttagaccaaatgcccgtggcccaggccttgttacctttgggccggatcgtgttatggagttctgcaacaacaatgacttacagttaattgtgcgagcacatgagtgtgtgatggatggttttgagcgttttgctcaaggtacggcaaacaatgcgggtgcaatcttggttctaggaagagatcttgtagtagttccgaaactcatccatcctttgccgcctgccattacatctcccgagacctctccagagcatcatcttgaggacacatggatgcagattcttggcttcttctgcgccggcgtcgtgctcaaccagttcggcctcatcaggaacctcaccgatgtcaagctcctctccgagtgggggattctcttcctgttgtttgagatggggctggagctctcactgtctcgccttaaggctcttgccagatacgcctttgggatgggtttgcctcaggttcttttgtcaacccttgctttcacggcgttcgagcttcctcctaatggtgctattggaaccaagattttgcagttcctctttgattcaagacctgatctggtgaatatcaggagcgttgatgaagcaatagtaattggggctgccctctcactatcctcatctgcttttgtccttcagcttcttgctgagaaaggtgaactcccaacaagatttggctcagctacactgggaatcctcctcctgcaggatattgctgttgttcctctcttggtcatactccctgtgctagagagtcagaatgtggtggagcaaagtgtgtggccaatgttattagctgaaagtctaaaagcactcggtggacttggcctactttttgcatccagattggactggctaaaacgcatcgtgttattgtacgcagtgttctttcctctcgtttttttttttcctttctttttgggatcttgagttctgattttgcaaggtgcttctgaatctgctggagagagaccgatggctggtgttcgtggtccagtcgtgtataatagccttccctcctgctactttcgtcgcagcataccccttgtaatttcagtctgatgatgctgatgtacaattttgtgttcaagttttgggtggcgaatggagtttgatttggtttactaggagagagacattgataattactgcattaggcccaagagttgggctaactcttcaagaaagcgtaaggataggattgctgctttctcaaggaggagaatttggttttgtggtgttttcgttggcaaacaggcttggtgtcctaccacttgagttgaataaactgctcatcattgttgttgtactgtctatggcgctaactccattactcaatgaaattggaagaagggcagcagggatcatcgatgagaaatcagaaacaaaagaaaaaccagctgagatggtgaattatgatgccactgaacctattgtgattcttggttttggagaaatgggaaaggtccttgcaaagtttttgtctgcaccattatcttttgggcttgacaaagatgcggaaggttggccatatgttgcatttgatctaaatcctgctgtcgtaaagtcagctagaaaatcaggctttccagtgctatatggagatggttcacgccctcttgttctgcaatctgccggcgtatcttctccgaaagctgtcatggtcatgtatactggaaaggaaaagacaattgaggctgtcaacagattgcggcaagcttttcctggcgttccaatgtatgcaagggctcaagacatgtcacatttgttagatctaaagaaagcaggtgcaacagaagttgttctggaaaacgctgagactagcttgcaactaggctcgatgcttttgagaggactgggtgtcatgtctgatgatgtatccttctttagtaagcttgtgagagactcaatggagttacaagctcaggaagcactcaacaacatcgaaaatcgagaaattgatatcatgaagccacttgagataagaatatcagacttggttgagcgcaatgggaatggttcaagaatgatagcccaggaggattcactaaggctaagtagtcgcccaaacataccactaattgaagcaactctagaggaccgaatacccgaaactacaggggaaaatgaccagactggatatgacttcaacaacatagattctgaagatggtgtcaaatattgtctcttggaagctagtgatgacgaaagcgaagcctccaattcaagcaaggaaatgatcgaccaatctgtatagcgccactagtaaagaaccaagatactaaacttccacttctaggatcaagcccatagaatggtagccaggcagagcagaagttcagacctggcacttctcttgcaattggacatatgcctatagcttacatgcagcatatatttctgaggactggattgatggttatcagtgaagggcatatgatcactggattatatgtcactcaatcctaaatcatgctgcagatagagaaaaatttcagctgacaaacctgatactcatatacctactgatgcagctcagagtgccagactgaaggatcaccatccagaattcagaatagcatttttactttttacaggacccttaatttgttcagttaggacgacacctatatgcatatatagatgcacattccttacacaattgtgctgtatttgtagcgtatatcggaccgaacattaattcctgtaccaattcaggtacgcacagagaattacagaaatagtattgcagtcatcgtggatttgtgat

SEQ ID NO: 3527 - DNA, 1361 bp, Oryza sativa
  Clone ID: PAT_MRT4530_95103C.1
ccggccgggcaacccaattcatccccaagtccaccaccacacacacacacacacgcacaccactcctctccccacaacccatccactcccacgccgccgccgccgcccggatcgccgcgagatggagcagtacgagaaggtggagaagatcggggaggggacgtacggggtggtgtacaagggcaagcaccggcataccaacgagacgatcgcgctcaagaagatccgcctggagcaggaggacgagggcgtcccctccaccgccatccgcgagatctcgctgctcaaggagatgcagcatcgcaacatcgtcaggctgcaggacgtcgtgcacaaggagaaatgcatatacctcgtcttcgagtacctcgaccttgacctcaagaagcacatggactcatccccggatttcaagaaccaccgcatagtcaaatcgttcctctaccagattctccggggcattgcgtactgccactcgcaccgtgttctccaccgagatttgaagccccagaacctgctgatagatcggcgtaccaactcattgaagctcgcggactttgggttggccagggcatttggcattcctgtccggacatttactcacgaggtggtgacattgtggtatagagcacctgaaattcttcttggtgcaaggcattattccacccctgttgacatgtggtcagttggttgcatttttgctgaaatggtgaatcagaagccactatttcctggagattctgagattgatgaactctttaagattttcagtattatgggcactccaaatgaagaaacttggccaggtgttgcttcactacctgactacatatcaactttcccaaagtggccatctgtggatcttgcaaccgtggtcccaacacttgattcttcaggactcgatcttctctctaaaatgctccgtttagatccaagcaaaagaatcaatgcccgtgctgccctcgagcacgagtacttcaaggacctggaagtggcgtagattatgcctcatcttgtccatttgtaaattaagattgcattgtttgctcagccgagttcttttttggctttccttaatctaagttggtgtgctcctcccccaactctatttttgcccttttggttgtgtagagatgagaacagaaggtacctcctggctatccctctgtgtaattcaagccaattgaaagatccttattgcgggagctctacattgcaattttgctctcttgcctaaaaaaaaaaaaaaaaaaggggcggccttaagctgccaatgtggcatggacttctccagtcattcaaccagttaatttaaactcttttgccaacattttccaactgaaaaaaaaaaaaaaaaaaaa

SEQ ID NO: 3528 - DNA, 241 bp, Oryza sativa
  UNSURE (1)..(241): unsure at all n locations
  Clone ID: PAT_MRT4530_95268C.1
  unsure (1)..(241): unsure at all n locations
agnccaggcacctcatgggagagcggcttcaacctgtcctgatcccaaggacgttcgcctccagcatttacaaggtcggtcagaatgacctngacctgagccccgacgcgcccgtggaagaggaagaggaggtcgaggagccgaggtgttgaagagaaggaatcatcccacatcaaggaggaggcgganccgtcgtcgtatgataaggacgagctgtagtgaggtgtcccaccactgttgt

SEQ ID NO: 3529 - DNA, 1757 bp, Oryza sativa
  Clone ID: PAT_MRT4530_95963C.1
ttttttttttttttttttttttttttacaaaaaagaatgtaaactacgtgttgatattatgtcctgctggcaagttgttacaatgctgaagcagatgctgaagttgaacacatgaaaaatattacaaagagatctagcccttttgtgtctagctttaaggccaatctgccatctggagtgtagaggtaaataatttcctcttcaaagtgagatttcatttactgacagcaccacatggtaagcaaaaagaaaaaaaaaagaccaaaaatggaacagacatcgttcattacactcagggttggcttccttccaaccctagtactatctgcctactaagctgaactctgtatagaaccatacactagtatcatcagagcagtttcttcatgcctttgagtacttggagctccacataggtaccttcagagcctcgtcgtcgcctgcgttgcccccattttcagcagtgctcaaagagtccgagatcaaggggtccgattcgctttcttttacctggttgagttgtggggaggcttcagtgggttttggtggagcctcttttgtgcagaagtatgagtacgataccatcccaatcacagcaatgaggattccaagtatatttctccagctaaatggatcgtgaagcaaaacataaccaaaggcaagaaccaagcatgtcttgagatggccaagcacttggtaagttacaggagaggttttcccgatcacaagaaaagtgctgaagttcactgagactgatatcaagcatgacagcacaatgaaaaacacaacttgagatgtgtaatcaaaagcaaagacattttggttagtcaaaaacccatcaaggaaagggccgacgatgaacaaggtcaatgcttggtatgggcatgattggtacagcagctgtgttgaagataccttgaatttcttctgaattgtgtttgtcatgatttgagcaatgcaggttgtaatgattgcgagcaaagacaggacagatcccacagcattaagctgcaggtcagtcacagttgcaactccaacaccaaaaaggagaacactaagggagagctggatattccgactaaacttcttcctgaagaaaagagtctcaagtataacagtgcaggggataattgccagctttgtcatctggtagaaaccaacagaattgaaacctagactcaagttgagaagaccaattgaaatgccattgagcacaccaaatcccatgacagtccttgcatcaaaaggtttgtgctcaaagagcttcatacataatgccacgtgaagagagcaaaatgtaacgaggagatgccagcttgtcaaagtagtggcgaagttgaagccgagggagctcatgagggccttgttgcagatgacaatggagaccgaggacaccaccgagaggctgagcgcccccaccgtccccagctggaacttctcccctgtcacccccatctccaccgctcccaagaaccaccacaaccagcagcaagcacaaaaccgagcaggaacaccaaaattccccaaccaaaacccgccgaatcagaccacctacagagccttgcgcggaattcggaataggcgaagctggatctgggagaagggcgcgcgaatcttggcggggaactggcaatggcggggagatctgggaggcgagcaggggcaggagggatcggctcggctcgcttcagctgctgctgcttcgcctcctccccgtgccggcctcggcccgaggcctcgtgccgaattcctgcagc

SEQ ID NO: 3530 - DNA, 2987 bp, Oryza sativa
  Clone ID: PAT_MRT4530_96163C.1
cttccttctctctcttcctccacctcctcctcgatccccaaatcccccaaaccctagctcgccggagcagtggagggcctcgccgccgtgctgcctcttggcccctccgtgtgatgccactgagtgcgcgtgggtgggtgtgcgtgatggatgcattctctttcatggcgtcgcagcctcccgccgccgtggaggctcgtctcgcggatctctgcaaggagctgggagtggacgagggcgtcgccggcgaggccgcggcggtgctggaggaggggaagggcgcgctcctcgcgtcgccgtcgttcgggagcaaatcgcccgaggatgctgagaagctgtgcttcgcgttcgtgctgtactgcgtctccaagctgaaggagaccaaggcgggttcctccggcgttaggctctgggagatcttgaagggttgcaagctcaagtatgatgatttcttcaaggaatcacagcggcttgcttcaaggatcgaccaggttttgggaagccgttatgggtcagattgggaagctcggctagagctgaagcaattggagaatttagtaaatctattggcagatgcaagccggttctattgcaaagcatttaatgagctattcttgagcccaagtactgatcaggagcctggatcaactacaaatattcctgattatatccgttttgggtggctgctcttcttaattcttcgctcaaaatcacccgaactgtttaaggacctggtatcctgcatccatggactagttgccatattggccatacttttaattcacgtacctgctaactgaaccaatgccatctcttgatggcatagtagcacggcagagtattcaccctgatggctggccacctactccctcataaagaaggtcttgatgctggcccagatggcaagctgttatccgtcgatcaccaaagagattatgcaccgaatctaggaactcattggtagagcacaattcgcagacaccacccccaaagcaaagccaaacagggttaagtattttgaaagcaaaataccatcctctccaggcaacattcgcaagccccactgtcagtaatcctgttagtgggaatgaaaaatgtgctgtagtaggggtccagatcttcttttccaaaatcttgaagttggctgctattagaataagaaacctatgtgaaaggctacgacatgaagagctgactgtgagcgtctataatatctttaagcagattcttgaccaacagacagctttatttttcaacagacacgttgaccaaatcattctttgctgcctctatggtgttgccatggggtctcaattatcattgacgttcgtgcagacgcatttgatattccatgggcagaagcaagaaaaatggaggcttccaagttgtattatagggtgctggaggcaatctgcagagcagagtcacagaacaataatgtaaataatttaaccccattgttgtcaaatgaacgttttcatcgatgcttgattgcatgttcagctgagctagtattggcaacacataagacagtcatcatgatgtttcctgctgtcctggagagtactggtttaactgcatttgatttgagcaaaataattgagaactttgtgagacatgaagaaacccttccaagagaattgaaaaggcatttaaattcattagaagaacagctattggaaagcatgtcatgggagaaaggttcatcgttatataattcactggttgttgccaggccatcactttctacagaaataaacagccttggtcttttggctgaaccaatgccatctcttgatggcatagtagcacggcagagtattcaccctgatggcttgccacctactccctcaaaaagatggccttctgctggcccaggtgctttctcaatcattcttaaatttaatgtttttgtaatcaactactctcatttccaaaactactgttcttattgggaagatggcaactgttatcctcaatcaccaaagagattatgcaccgaatctaggaactcattggtagagcgcaattcgcagacaccacccccaaagcaaagccaaacagggttaagtattttgaaagcaaaataccatcctctccaggcaacattcgcaagccccactgtcagtaatcctgttagtgggaatgaaaaatgtgctgtagtaggggtccagatcttcttttccaaaatcttgaagttggctgctattagaataagaaacctatgtgaaaggctacgacatgaagagctgactgtgagcgtctataatatctttaagcagattcttgaccaacagacagctttatttttcaacagacacgttgaccaaatcattctttgctgcctctatggtgttgccaaggtttctcaattatcattgacgttcaaggagatcgtcaacaattataagagggagccacaatgtaaaccagaagttttcagaagtatctttgttgggagtacaaatcgcaatggtggatttggatcacgtcatgttgatatcattgttttttataatcaagtatttgttcccacggtcaaacctttgctggtggctctaatgccttctagtactcgtcctgaagacaagaggaacactaatagccaaattcctggatcacccaagtcatctcctttctcaaatttaccagatatgtccccgaagaaagtctcatcttctcataatgtgtatgtctctcctctacgacaaactaagatggatgcattgctttcaccaagttcacggagtttctacgcgtgcatcggtgaaagcactcaagcttttcagagcccatccaaggatctggctgctataaatagccgcctaaattaccctaccaggagaatcaacacacgaataaacttcgacatggtgagtgactcggtggtggctggtagtctgggccaacccaatggtggttctgcctcttcggatcctgctgctgcatttagccccctctcaaagaagagcaaaacggactcttga

SEQ ID NO: 3531 - DNA, 2709 bp, Oryza sativa
  UNSURE (1)..(2709): unsure at all n locations
  Clone ID: PAT_MRT4530_96281C.1
  unsure (1)..(2709): unsure at all n locations
cgcgaggccaccacgaactcccgtcctcctcctcatcttgcacacagctgcgcactcgagcggcgaggcttggatttttccgcggggagatctccctggcgggggtctaggtaggcccgaggcaaatccgggtgggcgggcggcgcgggcattgcagtagcgggactgccccgcgagcgtggtggagtagttcagtgggttcggtcactcccgcaggctcgatggcttggtagccgttgaacgtcgccgcagtagtgtcgcgtggagcgggctagccagacgaagcaattgcaggtgtttaattcgatgtaatagaaagttagttagggagtcgtcgggatgcttggtggtgcagacgaagcagacagagccgcagcatcagcagcggaggtgagggttcgccagagataggatttcttcagcgaatatggtgatgctaacagatacaaaatacaggaagtcattggcaaaggaagctataggtgctagatttgttcagctattgaccaacatactggcgacaaggttgcaatcaagaaaatacacaatatctttgagcacttatctgatgctgcccgaatcctccgtgagatcaaattgctccggctattacggcatcctgatatacttgagatcaagcatgataatgctacctccatcaaggagggacttcaaggacatatatgttgtctttgagctgatggataccgatctccaccaagtcatcaaggcaaatgatgacttaaccaaagaacattatcagttctttctttatctggtgctacgtgctttgaaatatattcatactgctaatgtctatcatcgtgatttgaagccaaagaacatattggcaaacgctaactgtaaactcaaaatatgcgatttcggtctagcacgagtggcatttaatgacactcctacaacggtattctggacggattatgttgctactagatggtatagggctcctgagttgtgtggttctttctttactaagtattcaccagctattgacatatggagtattggctgcatttttgctgagattttaactgggaagcctttgtttcctggtaaaaatgtggttcaccagttggatctgatgactgatctcttgggtactccatcaatggatactgttacaaggattcggaatgagaaagcaaggaggtacttgagcagtatgaggaaaaagcagccagtacctttttctgagagattcccaaaagcagatcctgctgcactcaaacttctgcagaggcttttagcattcgacccgaaggatagaccaactgccgaagaggcgttggctgatccatattttaaaggccttgcgaaagcagagagagaaccatcatgccagccaataacaaagatggagtttgagtttgagcggagaaaggtgactaaagaggatgtgaaggaacttatattccgtgaaatactggagtatcatcctcaacttcttaaggattacatgaatggaaccgaaaaaacaaacttcctatatcctagtgcccttgacaactttcggagacaatttgctaacctggaagaaaatggagggaagaatggagatgctgttccatcagacaggaaacatgtttcgctcccaaggactactacagttcattctgctccaattcctcccaaagatcatcaaaatataacttcccaagtaccccaaaggattccaggtagaacaggacgaggggcttgccctgtaataccatttgagaatttgagtgcaatgggcccatacaatcaacgaagggtggtaaggaatccagtgcttcctccagccaccaccaacctatcagcatatgcctaccaccgtaaatcggatagctcagaaagagagctccagcaggagcttgagaaagatcgcatgcggtaccagccatcagagcatttcatggatgctaaggtggtgtcacatatgtcccatgatttgagagcttcctcttactacgtttcaaaggcgaaatctgatgtagcagacagagctgccttacaatccaacatgatgcagggaattggcccttttaatggcattgctgcagttggaggattgtcagaactgaccgcaccactaactactgagatgtatttggttaacggttacaggcttacagcatgatgnaggtanctacaataaagtcagtactgttcagtatggggtctcgaggatgtattagggtgcaatggccacttcaaaaaatgctccgctgagctgattaataacatgaaagaatccaagtacncaagtgccttatcagccaaagattcagacaaagaatacaggaccaacaatctgatcgaggaagcgtcgaggcggtgaaaatgaaattacagaatgggaaaagacaaacatcttgctagccattgatctagcctgccaagaaaggcatgccatattgccgtgccgtcagttatttgctgctaagaagaaaaagaaatgggagaaaagggaaaaagatgagcgagtgatctactttgaatgaaagagaacttatgggaataaaaatagcgagcttatgtatatacaataacttgattctatatattactgccagagacagccatttcttttgttccacatgtggacatgtggtggtgtgtgttttctttttgtatcactgggcgtctgagcacaaatgcttgcgagacaattcccttgtagaacaggagtacattttggtgtaacat

SEQ ID NO: 3532 - DNA, 296 bp, Oryza sativa
  Clone ID: PAT_MRT4530_96382C.1
gaaaagcatgactgatattgctgataagaataacaagtgggcatcatatgctggacccggtggatggaatgacccggatatgctggaagtcgggaatggtggcatgacctttgcagagtatcgtgcacattttagcatctgggcacttatgaaggcccctctcttaattggttgcgatgtcagaaacatgactaaagaaacaatggaaatattgagcaacaaagaagtaattcaagtaaatcaagatcctcttggagttcaaggaagaagaattttaggtcaagggaaaaatggat

SEQ ID NO: 3533 - DNA, 1567 bp, Oryza sativa
  Clone ID: PAT_MRT4530_9638C.1
atggccattggccaccaccacccaaggggagcgcaagcgcagaggacaagagcgcctcctcgtctggtctgcttcggccccccgctcgctcctcctgccgaagcactcactcttcggctgctcatcctcctcctcctcctcagacaggagcagaaccagacttgccacgaaggatttgataatctaggggttcgggacgagatgatattttcagtcagcttatttggtagttcccaccagtccattcacaaactttacaggaaatgctggtcaagtaactcacattctacactgaatgtgctttcacttgcaaaaactgtgggtcaaagtatgagaatgaagaggatacgtgtcaagcctcatgccactgacctgaagaatcgcccccaggcccatgaggataatgtgttctacaaattggtttataggctccctgaaaacctcagctggctgttggcgtcaccagaaatggctagaagaccaccctcaaagaagaaactaaagaaggaagaaatggtaagtagtaatcaatttggtgtgatcttggagtgggaaggagttgttgtggaagatgatgatccagatttggagcctcgagtttggtacgtgttatcacttgaagaggcaaagtcttttcctccagatgcagtgctgaaggaaattgaggggatgaggactgatcaggctattttagaagtcttacattggtcagaagatccacaagaagtacaaaggctggcagcacgcaaggaggtaatatataaaacattacgtggtagattctaccaactgcgaccaggtgttcttgatttcctgaacacccttgtggattttgacattccaatagcaatcacaactcctcgcccacggttgagcctagaagaagggataaaagctgttggtcttcaaggctactttgatgctatagtggcagcagaggatttctgccgagggaaacccgagggggagatgtttgaggtcacagcagggcaacttggtcttgagcctgatgtttgtcttgtgctgggtaactcaaattcgacaatagaatctgcgcatactgctgggatgaggtgtgttgcggttgcaagccgataccctgcctatgagctccaagcagcaaaccatgttgtaagatggcttgatcagctatctgtcgctgacctgcaaaggattgccaatggcgagattcttgggctcaggggcagaagatctgacatggacatggacatggagattgtgatcgaggagtgatttttctatatgtatggtgtgctaatattgccctatgtatatagctccaattgcaacctaggtaatgcattacattttgttaacagatcaagctgattaacattggccgttagcttgttaactgcttggtttcttgtaatgcagaaatggaacttttgtagcctagatgctttcgatctctagaagaattggaagctaagaaaaactcccaatctgtatcgcgcctgccgcccgaatatataatttatataaaaaaaaaaaaaaaaaaaaaaaaaaaaaaaaaaaaaaaaaaaaggggggggcctgcagcccg

SEQ ID NO: 3534 - DNA, 1667 bp, Oryza sativa
  Clone ID: PAT_MRT4530_96586C.1
gcgtcgagctgcctagctatcgagatcttcgtacgtaaatacgtctccctcgtctccggcgagccaccggcttgggcgtacgtgagagatggcgccgccgtcagccatgaacacgtcgagggcggaggagaaggccatcgacgactggctccccatcacctcctcccgcaacgccaagtggtggtactccgctttccacaacgtcaccgccatggtcggcgccggcgtcctcagcctccccttcgccatgtccgagctcggctggggtccgggggtggcggcgatgatcatgtcgtgggtgatcacgctgtacacgctgtggcagatggtggagatgcacgagtgcgtgccggggcggcggttcgaccggtaccacgagctcgggcagcacgcgttcggggacaagctggggctgtggatcgtggtgccgcagcagctcgtcgtcgaggtcggcgtctgcatcgtctacatggtcaccggcggcaagtcgctcaagaagttccacgacctcgtcgcgccgccctccgcgccgccgatccggacctcctacttcatcgtcatcttcggctgcctccacctcgtcctctcccagctccccaacttcaactccatcagcggcgtctccctcgccgccgccgtcatgtcgctcagctactccaccatcgcctgggccgcctcgctccaccaccacaaccacaacaatggcgccgccgccggaggcgtggactactcgctgacggcggcgacgccggcggggaggacgttcaacttcctgagcgcgctgggggacgtggcgttcgcgtacgcggggcacaacgtggtgctggagatccaggcgacgatcccgtcgacgccggagcggccgtccaaggggccgatgtggcgcggcgtcgtgctggcctacggcgtggtggccgtctgctacctccccgtggcgttcgcggggtactacgtgttcggcaacgccgtcgacgacaacgtgctcatcacgctggagcggcccgcgtggctcatcgccgccgccaacatgttcgtcgtcgtgcacgtcgtcggcagctaccagatctacgccatgccggtgttcgacatgctcgagaccttcctcgtcaagaagctccgcttcaaacccggcatgcctctccgcctcatcgcccgatcactctacgtcttgttcaccatgttcgttgccatcgccgtccctttctttggtggactgctaggcttctttggtggctttgcgtttgctccaacgacctacttcttgccatgcattatgtggctgtcgatcatgaagccaaagaggtttggcttgtcctggtgcatcaactggttctgcatcatcatcggcgttcttctgtcggtgttcgcaccaatcggaggtctccgctcgatcatcgtgaatgcccagagttacaagttcttctcgtgagtgattaattgagaggtgttttaccattcaattaagtgtgttcttaattaattaggggattgttttagataatgcacagagttctatttaattagatgaaagagaaattcgtgtgtccctatgagacatctgtgtgtggatgatatagtagtcgatcaaatgaaggcatattatttatttggcctttgtttgtcgatctatattctagcgttaatttaattcgtgtcgagtttatccc

SEQ ID NO: 3535 - DNA, 2099 bp, Oryza sativa
  Clone ID: PAT_MRT4530_96587C.1
ttgcgttgagctgcctagctatcgagatcttcgtacgtaaatacgtctccctcgtctccggcgagccaccggcttgggcgtacgtgagagatggcgccgccgtcagccatgaacacgtccgggctgcagcccttcttcatcttcttctttttcgtcttcttcttcttcttcttcttcttgatcctccattgctgcaaaagaagaagaggtagacgaaggaggaggagatcaggtgatcatggggactcaggtggcagataactacccaccggccaaggatggccggagcgcgcaggagaaggcgatcgacgactggcttcccatcacgtcgtccaggaacgccaagtggtggtactccgccttccacaatgtcaccgccatggtcggcgccggcgtcctcagcctcccctacgccatgtccgagctcggctggggacctggcatcgcggtgctgatcctgtcatggatcatcacgctctacacgctgtggcagatggtggagatgcacgagatggtgcccgggaagcggttcgacaggtaccacgagctcgggcagcacgcgttcggcgagaagctgggcctctggatcgtggtgccgcagcagctcgtcgtcgaggtcggcgtcaacatcgtgtacatggtcaccggcggcaagtcgctgaagaagttccacgacgtgctctgcgagggccacggctgcaagaacatcaagctcacctacttcatcatgatcttcgcctccgtccacttcgtcctctcgcagctcccaaacttcaactccatctccggcgtgtccctcgccgccgccgtcatgtcgctcagctactccaccatcgcgtggggcgcgtcggtggacaaggggaaggtggccgacgtcgactaccacctgcgcgccacgacgtcgacggggaaggtgttcggcttcttcagcgcgctgggcgacgtcgcgttcgcgtacgcggggcacaacgtggtgctggagatccaggcgaccatcccgtcgacgccggagaagccgtccaagaagccgatgtggaagggcgtcgtcgtcgcctacatcatcgtcgcgctctgctacttccccgtggcgctcgtcggatactgggcgttcggcaaccacgtcgacgacaacatcctcatcacgctctccaggcccaaatggctcatcgcgctcgcaaacatgatggtcgtcatccatgtcatcgggagctaccagatctacgccatgccggtgttcgacatgatcgagaccgtgctcgtcaagaagctcagattccctcccggcctcacgcttcgcctcatcgcaagaacactctacgttgcgttcaccatgttcatcgcgatcaccttcccgttcttcggtggattgcttgggttcttcggtggattcgccttcgcgccaactacttacttccttccctgcatcatgtggctagcaatctacaagccaagaaggttcagtctctcatggttcaccaactggatctgcatcattcttggagtgatgctcatgatcctgtcaccaatcggaggactccggcagatcatcatagatgccaagacatacaagttctactcgtagattacatgttcatcatagtaatctcatgtggctgcaagttcaagttctactcataggcacacatgatgaaaccagttactgcaaaagttttttttttagccaacaaaggaagaagaaagttcaacaccaagttcatacattgtcactacgacgatgatcttttgagacgtgtcatgcatgcatcagtcgttaattatgtgacttaattaaaaacaaagaggttgtgtttgtgcattgtcgctgggttaatcatactgtgtttttatatttcaatctactattatattgtaggctggacatggaaactgtgtgcagaaagatgaaagggatggataattactggttgattctttttaagaaaaaaatttacataaatgaaagaaaaattcgtgtgtccctatgaaacatctgtgtgtggatgatatagtagtcgatcaaatgaaggcatattatttatttggcctttgtttgtcgatctatattctagcgttaatttaattcgtgtcaagtttacccc

SEQ ID NO: 3536 - DNA, 588 bp, Oryza sativa
  Clone ID: PAT_MRT4530_97109C.1
atggtggtggcatccggtggagggcggaacgcgtgggcgaaggagatgaccatccgccgcaggattaccagcatattcaacaagacgcgggagcattttccgtccctgaaagattacaacgactatcttgaggaagtcgaggatatgactttcaacctgatcgaggggatagatgtcgaggtgattgaagctaaaattgccagatatcaacaggaaaatgctgaacagatatatttgtcccgggctaaaagggccgaagatcttgctgccgcacttaaagcaagcagaatgaaccctggcaaggctggtgccaatgacacggctgctggaagctctcagggcattagtagtggcgcgggagttcaggaaggccagtatgcgcctgctgctgttcccggtgggctagctcagcctcggccaacagggatggcccctcaaccgatcggcggttcatcggttcctcttcaaggagatgatgaggagaccatgaggctacgtgcggagagcggggctcgagctggtggatggtccatcgaaatgtgcaagagaagagcattgcaggaagcgttcagtaccatattcgtctga

SEQ ID NO: 3537 - DNA, 2028 bp, Oryza sativa
  UNSURE (1)..(2028): unsure at all n locations
  Clone ID: PAT_MRT4530_9713C.1
  unsure (1)..(2028): unsure at all n locations
atggcgatggcgctgggccgagcggcgaaatctccggcggagcagcggcggggtgccggcgctcgccagcgcagcatcggcgaggggtttggtgttgggcagcagacagctgcagccacccggcggggtggtggcggtgaagaggatgaaactgtgcgaggaggaggaggaggaggaggaggggatggaggggatgagnagnaggagnaggtggggtgggtgtgnaggccgccgggggggctagcgggggaggataaggcggcggcgtggaaggggagggcgccggcgatcgtggtgtcggacgcggtggaggtggatttcccggtcatctacgtcaacgccgccttcgaggccgccacggggtaccgcgccgacgaggtcctcggccgcaactggctgtcttcaggaggcaaggtttacctcctgacacggaaaacaatccgattcttacaattccgggatccacgtgcccaaagacgacatccgcttgttgatcccatggttgtttcagagatccggcgatgcttgaatgagggaattgagttccaaggtgagctattgaattttcggaaggacggtgctccactgtacaacaggctaaggctcattccaatgcatggggatgatggttttgtgactcacgtcattggaatccagttgttctctgaagctaacattgatcttagcaatgtatcatatccagtgtataaacaacagtccaaccacagacccaacattcaagagatcaaccctgcttctcatgaacatattcctaagattcaaagttccgagtactgctgcatcctccagctctcagatgaagttctggcgcacaacatattgtctcgcttatcgccaagagatgttgcatccatcggatcagtctgcactagaatgcatgagttgaccaagaatgatcacctgagaaagatggtatgtcaaaacgcgtggggaagagacgtcactgtgaggcttgagatgagcaccaagatgttaggatggggtcgtcttgcaagagagcttacaacccttgaggcagcttcatggaggaagtttacagttggaggtcgtgttgagccttcccgttgcaacttcagtgcctgtgctgttggtaatcgccttgtcctgtttggaggtgaaggagtcaacatgcagccaatggatgatacctttgtgctcaacctggaatctgcaaagcctgaatggcgccgtgtcaaagtttcagcttctccacccggccggtgggggcacactctctcatggctgaatggctcatggctagtggtctttggaggctgtggacagcaaggtttgctcaatgatgtctttgtccttgaccttgatgccaagcagcccacctggagggaggttgcaagcgagggcccaccattgccgaggtcatggcacagttcatgtaccctggatggatcaaagcttgttgtctcaggggggtgcactgaatccggtgtgctcctcagtgacacattcctgcttgacctcaccaaggaaaaaccagcatggaaggagatcccaacatcctggtcaccaccatcccgcctcggccacaccttgtccgtctttggtaagaccaaactcttcatgtttggtgggttggcaaagagcggctctctccggctacgctcctgtgatgcctacactatggacgctggtgaagacagcccacaatggaggcaactggcgacaaccgggttcccgagcatcggtccacctccgaggctcgatcatgtcgcggtcagcctcccctgtggacggataatcatattcggtggctccatcgctgggctgcactcgccctcacagctgttcctcctcgacccagcggaggagaagccgacatggaggattttgaacgtccctggccagccacccaagttcgcctggggtcatagcacatgcgtggttggcggcaccagggttcttgtcctgggtggccacactggggaggagtggattctcaatgagctccatgagctgtgcctcgcgagcaggcccgacgaagatgagtga

SEQ ID NO: 3538 - DNA, 1254 bp, Oryza sativa
  Clone ID: PAT_MRT4530_97364C.1
atgatgatgaacgttccatccgccgctgccgcgagctcctgcgatgatttcggctacaacgccaccccgccgccgccgccgtcgcttctcccaatcatggaccaggacggcggcggcggtagcatccagagggatcaccaccaccaccacaaccaccagcagctcggctacaacctggagccgagctccctagctctgcttcccccttccaacgccgccgccgccgcagcacaccacgccaccatcgcccacgcctccccacatgacctcctccagttctacccgacctcgcactacctcgccgctgccggcggcgccggtggcggaggcaacccctacagccacttcacggcggcggcggcggccgggagcaccttccagtcgtactaccagcagccgccgcaggccgcgccggagtactacttcccgacgctggtcagctccgccgaggagaacatggccagcttcgccgccacccagctcggcctcaacctcggctaccggacctacttcccgccgagaggcggctacacctacggccaccacccgccgcggtgccaggccgagggctgcaaggccgacctctccagcgccaagcgctaccaccgccgccacaaggtgtgcgagcaccactccaaggcgcccgtcgtcgtcaccgccggcggcctccaccagagattctgccagcagtgcagcagattccatcttcttgatgagttcgacgatgccaagaagagctgcaggaagcgactcgccgaccacaaccgccggcggaggaagtcgaagccgtccgacggcgagcattctggtgaaaagagaagggcgcaggcgaataaatcggcagctactaaagacaaagcaggaagtagcagcaagaacgcaggcattggagacggtttcgagacacagctactggggggtgcacacatgtccaaagatcaagaccaagccatggatctgggagaggtggtgaaagaagctgtagatcccaaaggtaaggcatcgatgcagcagcagcagcagcaagcacatcatgggattcatcagcagagccaccagcagcatggcttccctttcccttcgtcgtctggctcgtgcttattccctcagagccaaggagctgtctcgagcactgacacatcaaatatagctcaagtgcaagaaccaagcttagccttccatcagcagcatcaccaacacagcaacatccttcagcttggacaggcgatgtttgatctcgacttcgatcactag

SEQ ID NO: 3539 - DNA, 789 bp, Oryza sativa
  Clone ID: PAT_MRT4530_97559C.1
ccggccgggctctcttcggtatcctccacacctcgtcgccgatctcccaccccgcgcggcgccggcgcccgtccgtcctctcctctcctgcctccgccgcatcctcgcctcgcctcgccgaacacacaagattttgaggatgccgagggccacgagcgatgcgaagcttctaattcagtccctgggcaaggcttatgctgccacaccaacaaatctcaagatcattgacctctatgtggtctttgcagtcgccactgcccttattcaggttgtttacatgggaatagtggggtcatttcctttcaactctttcctttctggcgtcctctcatgcataggaactgcagtcctcgctgtttgccttcgtattcaagttaacaaagataacaaggaattcaaggatcttcctcctgaaagggcgtttgcagatttcgttctgtgcaatctggtgctccacttggtgatcatgaacttccttggttgatgtcctgcccctacaactgatcaaggttttgtagccccagtttatggtcactggtcagaacaccctgatgtttgggagtgtcatagtatgagatattcatatgatctttcacacttcaccgatgtaattcgacaatttttcgagaaactataagttctctacctgccgttcgctgcggcttatctttatatctgtgtatttagtgtttaacaatcttagaacatgtgatcctgttttcttcaagtgaccgaaggttggcaacatgctattcgaccatgctgttactgttgtttgtcctttgttac

SEQ ID NO: 3540 - DNA, 313 bp, Oryza sativa
  Clone ID: PAT_MRT4530_97655C.1
gcgtggagaatgccataatggtcaagcttccgaagcgtgccgtttcgtacaagaatgacaagctcgcgtaggacccgttgatgctgcttttcaagactgccctgctgacctccggattgagctcggaggaccccaacaccttctgcaccatggatccagcgcatgctcaagctggtgctgagcatataccaggactagtccaccaaggctgacaccgacatgccgacgatggaggactacccctgcgagagcaagatggacgaggtcgacttaacaggatggacccatggatgccattctggacattttagtg

SEQ ID NO: 3541 - DNA, 451 bp, Oryza sativa
  Clone ID: PAT_MRT4530_97805C.1
ttttcctctcgaccggccacatcttactgcgggtttggtttcattttgataacagtcaacactagctactagctagattaattaattaattaggcatggcggatgataagcaccaagaccacctgctccaccacaagaaggaccactagccggccaccggagtagactcctacggagagggcgtatacacgtgggagaccgtgaccaccgaggtggccgccggcggccaggacaagtacgagaggtacaagaaggaggagaagcagcacaagcacacagcaggacctcggcgaggccgacgccctcgccgacggcgcctccgcccatgatgagaagcacgaggcgaacaaggacccggtgaaggcgcacaggcacatgatcacggaggatatcgcggccacgggggcggccggcgccgggggctacaccttggacgagcaccacgagaaga

SEQ ID NO: 3542 - DNA, 1472 bp, Oryza sativa
  Clone ID: PAT_MRT4530_97968C.1
tccttttcctcgatcctttgtcttcttgcttagctggctctgccatggtggggagctacgcggcgggagggggacggggagcggcagtggcggcggtggcggaggggaagctggacgagctgcggcggaggatggggaaggcggacggcgacctgctgaggatcgtcggggtggggggcggggcgtgggggagcgccttctgcgcgctgctgcaggacgcgtacgggcggcaccgcgacaaggcgcaggtgcgggtgtggcggaggcccgggcgcgccgtcgaccgcgccaccgccgagcacctcttcgaggtcatcaactcccgggaggacgtcctccgcaggctcatccgccgctgcgcctacctcaagtacgtcgaggcccgcctcggcgaccgcacgctctacgccgacgagatcctccgcgacggcttctgcctcaacatggtcgacacgccgctctgcccgctcaaggtcgtcaccaacctgcaggaggcggtctgggacgccgacatagtcatcaacggcttgccctccaccgagaccagggaggtgttcggggagatcgggaggtattggaaggagaggatcagaccccccgtgatcatctcgctggccaaggggatcgaggcgtcgattgaccccgtgccccggatcattaccccgacacagatgatcagcaatgcaactggagttccattggagaatattctatatcttggaggtcctaacattgcatctgagatatataacaaagaatatgcaaatgctcgcatatgtggagctgacaagtggagaaaacctctagctaaatttctgaggcagcctcattttattgtgtgggataatagtgatctcatcactcatgaagtaatgggcggcttaaagaacatatatgccattggtgctggtatggtggctgcactaaccaatgagagtgcaaccagcaaatcggtttacttttcactttgcacgtctgaaatgatatacatcacccatctcctagccgaagaccctgagaaacttgccgggcctttattagccgatacctatgtaacactgctgaaaggtcgtaatgcatggtatgggcagaaattagctaagggtgaactgactcttgaaatgggggacagtatcaagggcaaagggactatccagggtgtctctgcagtccatgcattttatgagctcttgagccagagtagcttaagcgtgacacatccagaagtgaagaagcttgttgctccggtcgagctgtgcccaatactaaaaacactttataaaatcctaatcaagaggcttaagttctttgcacatttcacctgcagggagcttgccactgactccattctccaggcaatacgagatgaatcaatgtatgatccacgggagaggattgagatgtctcagcgccagtgtctttaccgaccatctcttcttggcctacctaaagtagatattacccaggcttag

SEQ ID NO: 3543 - DNA, 3554 bp, Oryza sativa
  Clone ID: PAT_MRT4530_98306C.1
agcgagtcccccgggcggccgcgggcggccaagcgagcgatctctctctctctctcgcatcgcgcgcagccttcctcatccccgtcctgatccactccacctccctaatccacagcgcgcgccagaggaaatccggcgccggtcgaggcggccgcgccgcgccgccgtcacgcccagcccactcgattcggtcgcgtgtgcgctaggaagttcgtcatacgcctcgcggttttcacttcgtgtgtttttcttttaaatttttacctgtgcttcgtttaaagcctctcttgatcttaggtatagctttgctcgatctgattataggtatgtgggatgtttctggtctcccgtgattgcgcgtggattgtgattatgactaatttgcttgatctgaatatctgattgtggtggtggtgtgtgtgtgtgtgtgggcctgatttgcctgatctgttgtggattattattgtatgatttaccgtggttttatgttgtttatatataagcgtttgccatgagtctgattaattgtattgttgcggtttttcctaggtgtcatactgtcatgctcgatttttacaaggtttagtgcaaactgatagatgatgtccatccccaaaactccgtctaccagtattggttcatgtgcgagcacacgggatagttcgagttcctgtttgatattgattcgctggcgctggttgtttggttggtttattagctagagttgtttgtgtgcaaaggtgggatcatggttgcaaaggcatattgatgaatgacgattcataagcgtggaaagcaatctctgtgcaaggggttattaggattctttgtgcgtattcactctaaaccgatagtcttgtattgctatcagcaccacgttatctatttcctaaccaatgttttctgcatatggactctgcattttgcttcctctccttgtaccacacccagtaccctatgtttgtgcctctcccatggtccatctctcctgttaaaaaaataaaaataaaaataatagaatagaaaaattctagaccaaatacagggaagaaaataaattttgtcaggcaagagagcgacgaggcgatggggaacttattacttttctggacaaatccttcaatttgcctcatctatatcaatgggattgggaaagcagtggactacttaccatgtattggctactaatttccaccactccttgccagagaattgggaaagtgaattctcttatgcaggttctgtcagagtattgtaccagtcattgagatgactgtattcagtagagaagttttgtagataggttaaatttcaggtacaaaccaatgaagtaaaaaacgtcttgaggtatgagtggatgtgcagaggctcaagaagttccctgattggagaagcaaaggaataagttttttatatggatgtgctatggattttcctacacctacgggagaagtttcttttgttgaagatgaagctgttggcagctggagagaatgggggtggacaccacagtaagtttgatgcagatggacactgttcgaattgcttgggaactcttccatggaatctggatggataccttattgagtagtaaatttcttaatacagctcgctatccagatagtgctagctgtgattgtttggtgatcaatctattgggattgtgccgactggagctgttcgacattgctttggtcttttgttgatttgcctggagttcggcagtatacagcaaccctggagtgcatgcagtggtttcctcattttttaggacctgactgcattctgtagtgagaactatcctgctaaatgcataatacttgcaggtgttttctgttgtattggcaacgtgatagtttttgtggtgcaaaacattcaagatgggcgccatggacgtacaacttgagtctactgctgttcaacatggacaagctaagataaatgtggaggaacatgctctagtttctctgttgtctgatgagaagtacgcaactgaaaagaccgaagatgtggaccctgatgattatgagaaacttgaggaagggataatgcagtatgggtgtgcacattatcgaagaaggtgccgcattcgagctccatgttgcaacgagatttttgattgtcggcattgccacaatgaaacaaagaattcaattaaaattgatgctgtgaagaggcatgaactcccacgccatgaagtgcagcaggttatatgctcgttgtgtggcacggaacaagaggtacggcaagtatgtatcagttgtggtgtatgcatggggaagtacttctgtgaagtgtgcaagctctttgatgatgatgtttcaaaacagcaatatcattgcaatggttgtggaatatgcagaattggtggcaaggagaatttctttcactgctcaaaatgcggatgctgttattctatagtattgaagaacagtcatgcatgtgttgaaggagcgatgcatcatgactgtccaatctgctttgagtacctttttgaatcaaccaatgatgtttccgtcttgccctgtggtcataccattcatgtcaagtgcttgcgagaaatggaggagcactgccaatttgcttgcccgctttgctctaaatctgtctgcgacatgtcgaaggcatgggagagattggacgaggaactagcaacgatatctgacacctgtgacaataaaatggtgcgcatattgtgcaacgattgtggggcaacatcagaggtgcagttccatttgattgcgcacaagtgccagaagtgcaagtcctacaacacccgccagatctgaagtggcgaagttttgatgtgattcattttgtatgggaagagagccctgggggatgctcattttgcaacacaaatcccgctaacgcctctgggaatctgatgagctctcggtcgttttcttgctcattggatgcctcagccgaggcaaatcactcgcatctgaaattcatctatgaagtggatgctgttccctcctgtgttcaatttattacctcaccatgtcgcagactcagagtcctgttcagcttaagtttctactagcactagccgagataataagtgcacgtctactcaagcttctgggcataaatggtggctagcttgtgtgttatggtgtgtacttgttgagtctcgggcaaacactgtaacggttagtggcatagtattacttcttgctcgtgtgcgtgtgtagtaggatggcggattgcaggacgtgggtgttatttactggtaggaactgtggtacttgcagtagccaccatttctcatgttcaatgccggtcccatatgccggtcttgttcagttcctataccttgctcggttgagaaaaatggcaaatctacctcagttcattttgttctgattatttaaaagagggccaagtattgaattcttaagaaaaaacacattgatggtgctagtatctgggctctagtagggataatggctttttctatcttttgacttgtagcatgtagcatataagcaactttgaaagttttaaattttaaatttgatagaattctaatctaaaaaaaaaaaaaa

SEQ ID NO: 3544 - DNA, 1601 bp, Oryza sativa
  Clone ID: PAT_MRT4530_98621C.1
cggttctttatagagtttattttacttataatctggaccagattgtctttatctggtatcggagggatgctgggcagtttaccaacattactgccttgcaagcgtgcaataaccgtgatcagatttacaatatcctgtgtcctatttgctgcattttcctggtttccaggtagcagcagctgcgaacgaacatctgttggctgggtttttcttcgccgcctgttgtgaccggcgagcctacgtctgcagctcctcttaccctcatcaaactcagagagcgggtgaaatctactgcactgctgacagaagcgctgcatctggttgccaaccagcgccttcgtggtcttgccgtggatctcgcagactttgtgtctccggtgataatccttggcgttggtcagatccgccctgcagtcatccacctggcacatcgggtagcttccgccactaccgcctgagtttccaccgcctccgcctcccccatcctccagtgctacggtgtcacgcagccatggcgctccgctgcgtggcctcgaggaaaaccctagccgccgcggcgctgccgctggctgcggcggcggcggcgaggggtgtgacgaccgtcgcgctcccggacctcccctacgactacggcgcgctggagccggccatctccggggagatcatgcgcctgcaccaccagaagcaccacgccacctacgtcgccaactacaacaaggccctcgagcagctcgacgctgccgtcgccaagggcgacgcccccgccatcgtgcacctccagagcgccatcaagttcaacggcggaggccatgtcaatcattcgatcttctggaataacctcaagcctatcagcgagggtggtggtgagccaccacatgcaaaacttggctgggccattgatgaggattttggttcatttgaggcacttgtaaagaagatgagtgcagaaggtgctgctttacaaggatccggatgggtgtggctagctttggataaagaggcaaagaagctttcagtggaaacaactgctaaccaggaccctctggtaacgaagggggccaacttggttcctttgttgggaattgatgtctgggagcatgcgtactacctgcagtacaagaatgtcaggccagactacctgagcaacatctggaaggtgatgaactggaaatacgcaggggaggtgtacgaaaatgcgactgcttgatgttgtctgaaggcaacgctcgtggttttttttcacctagtactgccatggatctttgtatgcaataaaaatgggcctattgcacttctggaccttgtgtacattgcgtagaggtggactaatgcataacataatgggtctgttcggaagagctggctgctgcagcgctgcggctgcacagcacagccaaccagcagctgcaactagccaatagtagctacaacctatatgtgttaaagctagcaaagtataggagcagtagtttgtatgcagccgaacggattggctgtacagcacagccaaacagctgtaaaaattgacctaccgaacagacccaatatgcctgagattttcttcttgtgctgctttcctgcaaaaaaaaaagaaaacaaaa

SEQ ID NO: 3545 - DNA, 2413 bp, Oryza sativa
  Clone ID: PAT_MRT4530_98682C.1
tcaccatgagtaggctgggtgattgtcttcgtcatcacatgccaggaaggcttttgcaatttcatccattgtaggcctgctgtttctttcttcaagacaagatatagcaacttccaccattacctttgcttgctcagaattgaaatgcccattcagtctagtatcaattacatccttgacgtccccagtagccagaatatgtttcatgacctgcacaaaatctctgagctccacctccctcccatccacttttatcccgcttgatatcctgcttccagttacaatctcaagaagaacaacaccataactgtagacatcaacctttgcattgattggtgagttcaacgcccattctggtgccatgtagcccattgtacccctcatatgcgtgaagtttaaactggtactgtctctctttgagagtttggccagtccaaagtctgctatcttcacttcaaaatctctggtcagaagtatgttctctggttttacatcacaatggacaacccactctaggcactcgtgatggagataggccaaacctctagctgtacccaacgctattttgaaccgttggctccatgcaagcaatcgctcagcacttacatcaccaaataaatacttgtccagtgattcattgtccacatactcatacaccagtagtttttgttgaccctcggagcaaaaaccccacatcctaactaagttcatgtgattgatccttccaataatactcatttctgcccagaattcctcctcaccatgtgaaatattcattagcctcttcacggctatcactctcttatcttcaagtactcctctgtaaacaataccagaggctcctcttccaatctcttccttgaactttccagttgcctcccttaattctcggtacgtgaacatcctgaattggcttgttaccatcctgtagcctgcctccattgacatgggtatgttgtgcttgctgtaaagaaaccaccagcttgtacctgtgaagattagcactagagctcccaatactgctgcaaacacataataggttgcataatttttatttgcatcattcattccatacatacttgaagatcctagtacaatctctttggttgggttgcatgagagatcggactgtttggaaaccatattcttgggtagtttgatgtagttatcacccggaaaatttgtggagctgtagccattgaagagtacatatttgatgtaacaagttccagaccctgtcttatacgtgactgctgagcaggagcagatgtccaagcaagtctttttacattctttaagtgagatggattggttgatgattagatcgaagccataaaagtcggtttgagcgagcttgaagaactcatattcttctattttgctgcagtttttgctgaatagtggacgacaacctctgctccagtttgttggatctctcatctcatatccagggggacaagaacacttgaagcttggcaagaactcacatataccattctcgccacacagtccatgcacatcacacaattttgctatagcctgccatgagactttccagctcccatctgatgcattcaaactatacattcttagattcccatcataatcaagcgtcagccttctgttgattccagcaccccaatcagcagccttgatatccagcttatcacttgagaggaagtgtccttcagtgtcaaggattgcattcctggagccattgtagctagtcctcccaatatcaaacactgagtagtctggacttggccaatagatgctagatatttctggcccatcatacatgaggcgtaacacattgtcattgtcaaaatagaggttgaaataaccagagaccagtcttgtacctttggtgagaggctgtaatggaagcaaggtatccgttggtgcccagaagctttgccataacttcgtgcctgtggagtctctgatgacgagattgccagtgtcaagaaggacagccgttgtgcccttgccagagctcgtcttgctgtcccaatttgcggtgccattgacatcagcgaggaccaggttaccttcatggttcagtgtcaccttagagccatggccatttaccggggacttggggtttgcagaccatacgacggtcctattcttgctgttggtgaaccagatggagaaggagaaagcattccctccaacttcatagaagccacaagagaaatcggcgtttggtgaggtaaggaaggtttgcttatgctcttcaacaaataaggatgagccggtgcttagcatcaacaggggtgaagcatatgagaatggcagtacactttggcggttggctagagccgcgataccggccatggaaggagagtgatgagaggatggttagatacagcagcgcagccattatctccttttccagggagctttggcc

SEQ ID NO: 3546 - DNA, 5923 bp, Oryza sativa
  Clone ID: PAT_MRT4530_98926C.1
gggtttgttttttttttttttttttttttttttttttttttaaaaaaacattcatcacatcaggcaaggtattttgtcttacaattgcatttctcttcccaagtttgttttcatacacacacatcacatcactaccaaacaggaactttacacattctactgtactattctacaacacatcgctccctgggccgcacaataagcggcctcagcagcgcggcgattagcaactaccaaaatgcacgctttctttctttttctttttttttgggtctctcaatcaagataagtggagtagtagaataggagtaacaaattacagcagcaacaggagggaagaagacacaacagaatacatgtccagtgaatggcagacaggctactactccttgttccgtgtagctcggtctttcttgtggccgccaaggattcgcgagatctgcagacctctgctgaaggcctggttgaagagcattctggtctggaactcggacacaaacgggaaccaagcgaggaacgctatgggggtgaatagcaggagtcccattaggatctcatagccccgggcaagagccttgattgatccccaaagcccaatagcctggacagcaggtttgatggcttgcgcaatcagaagcaagccccatccagttggcatgaaagcaaggatgcaaacgaagatatcaagaactgtcatgtgagggatggcaattaatatcacaacaatggcgacaaatgttatgaatataaggcccttgatcaaccggaagacaagctggaactccgcactgaacctcctcctaccgactgaaacagtcttcatgacaagtaaaattacgaaaatcacaacccatgaaaagcaataaaccagtacactgcgagtatgcttggttatattcaaatgatacacaagcccatattggtagacaaagaagcgcaacgcgagcagaatttcaagaatagtaccacgctttccagagtatcgaagaggctcctgctctttttcccaccatgattcccaactttttgttggtgctactccaatacctccacggttgctgatccacttattccaatcagtccagtcatccacaatcttctgccactcaaatccagaaggattgaataggaatggtgcaaagagccaggtgcccaccataaaccacatggaaacagtgatgaaaatgtatgtgatagcccctctgtatgattgcccaaagatttcatacacaaccagcaaaatcatcagctcaatacccttgacaaaatggctgcgagaataaagtcggtagttgtcagcaaacttggcatgaaacaccacaaatccacgcccagtggctctatattcagctcctccgtggagtaatgtccttccgtaataatgagttttggtcccaagtgaaaatgtaaagaaaacagatgccaactgaagttgcataagtacaaagtcgcttagtgctgttctgaatcccctctccagaccaatttccatcatcatgggcaacgccatcaaaaatccaagttgaacaaaagactctgatgcaagagcaacttggaggggtgcattatgcacaaacttctttccagtggctagtgcttggtccagtccactgaggacaagatataagcgcccatagaggaaaacatatacagtccatactgtaatcattgtactaaagtagaagccaattgttgtgtaatagcatgacagcattctgaagaaatcaaaccggtgccctagtcgataaatgtcacggctcagtgtttgttcaccattaccatttgctatctttgcctcaaacagagcaatttggttgagacccacatctcttcccttgccaacttgcatgtactcatgatgagtgacattgccttcacgcaatgttgaattgaaaccggcaaatatatcttcactaagattgataattttggatgctttacttacaccaccccttgtgaggtggaaaagacgatcaaagatatcaggatggccatagtggaatcgaaccctcagggggttggcaagcacacgctgtccaatagtcacaaaactggtctcctgatttgacatgaaccatgcaagggatgaaacactgccagtaaatatatgctctcttactccaagtattgatggatatctcacaccatcatgtttcttcagaaactcatccagcagatttctcattttcaaagcctcctccatataatgctcctgattcatatctatagtttggaggcattcaccacgagtaaaaataattgcatgattctgattttctggttttccttcacctaaaatagcattacctggaagttttatcttgtatatgacctgatcaagactttgtcctggttcattaggttttgtaacggaagctttcaccaatgctgagtagtaaactttgtcagtcttcttgtttctatcttggctaggtgcttcaacctcatcaatataagcaactcgaagtgatggatatagaaagacactcgattgcactgttgcactaagaacaatcatgtgtgctccaaaggcttcaccagaacgtttctggattccatattgctggcacgagacaacatatgtaaatttcatgtcagctatagctttgcattgagtcatcaattgcgagtcctcagacatcagttcagttgctctgtaaccttccataagatcatcatctttggccatgtcaaggaaagcctgaagctccaacgcttttcggtagtacatcattcctctcacagttcttgtcaatgtctgtcccctatatgatgcccaaaggcgaagctcctcttccaatgtttcatcctcacggagctcctcctcgctcttgcggtccaccctatcaaggaaatttttccattcatctgggtagattttttgtaagtagaaaagtatggaaaccccatcctcatttggctcttccagattatgagaggagaaaagaacatcttccttgtaataaggagtcaagacagagaagggcaacatatgccgcacttttggagcattaggcatctccataaaaagagaatttgcaaagaacgatatccgtctcctagcatcaaggttcgtagggacatccatagcagactctttcacagtgagaagaaggtgaagcctctttatcttttccgtccatgcatttgattcctccacggggaacctaatagctttagtgaacaactgatcttgttgatcaagtgaagtcattccttcgtgttttctatttccaccatgtacagaatccaatagtccgcctagctggtcttgctcatccattatatcccttgtgaccacctcaagcatatcttggaataaaatgacaacttggcccaagtcttcttccttattcttttgcagtaattcaagtagttcaatgaacttcttgctcagggcaggaaggctcctcatgttcaaatcctttattagacttcccccttctatgtgttcatcaacaattgtaaaaatctgctgtattactattttctcacgttgaccaaacactaaagtattgatgatgtttttgaatgaaccatagcactctctgatagcataggaaaaatacggatctgatcccattctcttcttcagatcacgatcttttcctccactgtctgccgccatatccaatgctattggaatcttgctagcaagtaggaaaggtggccactggaatatattcaattcacggtctttacagtatgggacaagtagcaagtccatctccctgttatctataagatcttcctcacggaaacttgtgataattaggttccacatttgagcaaatcttgcggctattttctctttctcttgctcatcaccagaagtcttagaaggtttaccagtaaaggcagcacgcaaacctttactcttgtgtgaatcagaaggaatcaagtgctcattgaaggcctcaggcagagattcaaaacgagatctcaacattcctaatgtccgtatctcaccaagacgacgataagccccatagataccaccgatcaatgtagagaaaagtgcataccaaatttgggtgtccatgaagtagacaagaattattggagcccacagcgcaataacaacaccaatgttattgttagcacgagggaaaaattcatgccactggaaatcccggatcggctctttcattatatctttggttggctgtaccagaggcttgattgtcaatttcattgctaaaaggaggacccagaacatggtatacttgaagagggaaaatgcgccttcatgcattcctctgccaacaaatagtcgaggctgagaccaccacatgatgaatgttatgaccttaacatttgaactctcaagaaaccttctgcggatctgttctcctgcattcgcgaccaaacgagaaatgggtacccagaggattaatactccaagcaagtatttctttttcttggcattacattgaaggacaaggctggaaatgtaatccattccaattattccattaagacgactagggtaagcatcttcaggagttttgaaaaaatcagcatctgctctcataggccatcctagccgaaaacaatccactgaccaaaaatactcatttaaatcatcatagttcctccaatgtgagtgttttgactttatggtcttgctccgttcagcttccttctctataactttgtaaattggagtcactactttcatcaggaaggcctcttcatcaccaccatacgctggtttaacattttcaccagtcattggactcacgtttccagccaacatgccatagagttcaaaagccatctcaatgtaatttattgagttcaataaagcttccattatatgatggtagatgtagcaaagacactctggcatgaacctcaagttagccgcctcaccccaaattagcaaatagagacccatgtagagaagcttacgctgctgaacttcctgctggatagttggcaaccataaactgcttttgcggccaaggtacttgcaccacttcttataattcttaaatagcttcttcattacagcatctagagctctgtcgtccaactttgcttgttgctcagtcttaggagactgccttatgtgcacatttgcaagtaacagtattagatgttctctttggttggacacattatctttctgaaacccaaacatggcctgaagccaatcaagaaggtctttgccagtcttcttttcatcaggcttcttttcatgttccttgggccacggcaggcctctaatattccttagcgcattaacagctgcttgaatctctggatattgcataataggttgataagtactctcaggatcgagtggcagaatattgtaaggaacatagagctttttcttttcctcaactttgttgtgtgtatccagaatcgcttgatcgacttcaacagattgggaaacattgacggctttcaagacctcgaacaagacagcagcagtttggtatgccttagtgagcagagcacggtcagccttgtcggcagcattttgaagtgcctggatgtacttcttgtagtattcacggtagaaacgttgcatctctcgagcgtcactctggtgaacccttcccttcaatgttggatcattttccctttcaagcctctgcagaagcgcggttttgaattgacgaacaccacggccattggaggtggggtcgaggcgatgagccttctcgaaagcatagaaacggcataggtaggcgacgcgtgggttggtggcctcgacctcgttggcgacacggaggatgggggcgatctcgacgagcgaggaggggacgacctcactgtcgaagatggactcgcccaagttgccgacggtctgggtgcggagcagcctcctcccggctgcccccgccggcgagggagagggcgaggccgcggaggagaagtcgggcctcctggcgccgccgggcgccgccat

SEQ ID NO: 3547 - DNA, 134 bp, Oryza sativa
  UNSURE (1)..(134): unsure at all n locations
  Clone ID: PAT_MRT4530_99003C.1
  unsure (1)..(134): unsure at all n locations
acagaatttagttgcttctggggtcgatggattgcgtgctgggatgggctctggcttaataggcactacccaagaggtttgngccgtgggccgaggacaagctacagcagtgcataaggttgcatcttatgcca

SEQ ID NO: 3548 - DNA, 291 bp, Oryza sativa
  Clone ID: PAT_MRT4530_99181C.1
atggccttcaaccttgaagggcctgaaaatgagaggagcctttccttgagcttcttgtgtgccatggaggagggaagactcatggacattataggtcatcacattcaaactgatgagaatgctggggtgctcgaggaggttgccaaccttgcaagccggtgcctggagatgatcggcaataaccgcccgtcgatgagagatgtcgctgacaaatttggccggctgaggaaggtcatgcagcacccatgggcgcagcatgacccggaggagatggtgcaacattcaaaatag

SEQ ID NO: 3549 - DNA, 478 bp, Oryza sativa
  Clone ID: PAT_MRT4530_99963C.1
tagaggggcaggtgtgaatccaattccacaatagtccaacaattacatagtgtccaggcccttgcgatcgaccttgaagaggatgcagcagctggagggggtgcaggcgatgcccaggatcacctagaggtgtgaggccctccgccctattgtagccgaaaacgtccctttggtctgcacagtttaacagggtgttcgccaaaaattgtgtattcggcgaagcaaaaacaagaaatttgtggcgttgaagggtttgccaacggtgcgatgcccatttcggcctgtttattgcgaaatagtgataaacggccgcagctataaggtttttaaggttgccgactggctacaggcgctgacagctttcgcacttcttgacttgctcaacacagactttcagcatggtgggccagtatactccttttggcgtaatcatggtcaaagctgtttcctgtgtgaaattgttatccgctcccaattc

SEQ ID NO: 3550 - protein, 147 aa, Glycine max
  Clone ID: PAT_MRT3847_100307C.1.pep
LISYLTKSAGTGIGIEFRESGLNINAKNEQLVKEGMVFNVSLGFQNVQRESSKSKNKHFSLLLADTVIINKDKTEVVTSMSSKALKDVAYSFNEDEEEENPRAKADTNGAEPLMSKTTLRSDNHEMSKEELRRQHQAELARQKNEET

SEQ ID NO: 3551 - protein, 371 aa, Glycine max
  Clone ID: PAT_MRT3847_100511C.1.pep
MAKRVFLYKDLVPFGAMVTMECLNVALNTLFKAATLRGMSYHVFVVYAYAVAAIVLIPGPFISQRCRSRVLPPLSFPLLRKIGLLGLIGCASQIVGYTGISFSSPTLSSAISNLVPAFTFLLAIIFRMEKVIVRNTTCQAKVLGTIVSITGAFVVTFYKGPPIIIVHTPSLSLHQPINTLNSVDRSWAIGGLLLTAEYILVPLWYIVQVQIMKVYPNELTVIFFYNLCVSIMAAIVAIFTETNAGAWKIGLDTALASIVCSGIFGSFVNNAVHTWVLRIKGPVYVAMFKPLSIAIAVALGVMFLGDTLHLGSLVGATVISIGFYTVMWGKATEENVDEDVPGQQSPPTTENVPLLQSYKTDTAEKKMHGSV

SEQ ID NO: 3552 - protein, 186 aa, Glycine max
  Clone ID: PAT_MRT3847_101219C.1.pep
MKSMENDDNADLNNQNNWLGFSLSPQMHNIGVSSHSQPSSAAEVVPTSFYHHTAPLSSYGFYYGLEAENVGLYSALPIMPLKSDGSLYGLETLSRSQAQAMATTSTPKLENFLGGEAMGTPHHYECSATETMPLSLDSVFYIQPSRRDPNNNQTYQNHVQHISTNQQQQQQELQAYYSTLRNHDMI

SEQ ID NO: 3553 - protein, 66 aa, Glycine max
  UNSURE (1)..(66): unsure at all Xaa locations
  Clone ID: PAT_MRT3847_101254C.1.pep
  unsure (1)..(66): unsure at all Xaa locations
MAGSAPTPREEFVYMAKLAEQAERYEEMVEFMEKXTPTPRAXELTVEERILLCVNYLNAFRARSAF

SEQ ID NO: 3554 - protein, 103 aa, Glycine max
  Clone ID: PAT_MRT3847_101657C.1.pep
MSGRGKGGKGLGKGSAKRHRKVLRDNIQGITKPAIRRLARRGGVKRTSGLIYEETKGVLKIFLKNVIPDAVTYTEHARRKPVTAMDVVYAPKRQGRTLYGFGG

SEQ ID NO: 3555 - protein, 103 aa, Glycine max
  Clone ID: PAT_MRT3847_101658C.1.pep
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 3556 - protein, 103 aa, Glycine max
  Clone ID: PAT_MRT3847_101659C.1.pep
MSGRGKGGKGLGKGGAKRHRKVLRDNIQGITKPAFGRLARRGGVKRISGLIYEETRGVLKIFLENVIRDAVTYTEHARRKTVTAMDVVYALKRQGRTLYGFGG

SEQ ID NO: 3557 - protein, 103 aa, Glycine max; identical to SEQ ID NO: 3555
  Clone ID: PAT_MRT3847_101660C.1.pep

SEQ ID NO: 3558 - protein, 103 aa, Glycine max; identical to SEQ ID NO: 3555
  Clone ID: PAT_MRT3847_101661C.1.pep

SEQ ID NO: 3559 - protein, 103 aa, Glycine max; identical to SEQ ID NO: 3555
  Clone ID: PAT_MRT3847_101662C.1.pep

SEQ ID NO: 3560 - protein, 103 aa, Glycine max; identical to SEQ ID NO: 3555
  Clone ID: PAT_MRT3847_101663C.1.pep

SEQ ID NO: 3561 - protein, 80 aa, Glycine max
  Clone ID: PAT_MRT3847_101916C.1.pep
PQSIAVAPSSTTTTTTNYGYEYGGHLQDQAYYTQQQTTNATLLPQHQSMTPAAAAAALSDAPKQYPAHNIQQSNTASQPV

SEQ ID NO: 3562 - protein, 239 aa, Glycine max
  Clone ID: PAT_MRT3847_102149C.1.pep
MGRGRVDLKRIENKINRQVTFSKRRSGLLKKAREISVLCDADVALIVFSTKGKLLDYSNQPCTERILERYERYSYAERQLVGDDQPPNENWVIEHEKLKARVEVLQRNQRNFMGEDLDSLNLRGLQSLEQQLDSALKHIRSRKNQAMNESISELQKKDRSLREHNNLLSKKIKEKEKELTPQEQEGLQNNMDVTSVLVTQPPESLTIGGFPEAKCNEETPTSCRPKTILPPWMPLPTNE

SEQ ID NO: 3563 - protein, 239 aa, Glycine max
  Clone ID: PAT_MRT3847_102150C.1.pep
MGRGRVEFKRIENKINRQVTFSKRRSGLLKKAREISVLCDADVAFIAFYTKGKLLDYSNQPCSERILEPCERDSYAERELVGDDQPPNENWVIEHEKLRLGWRYYSRNQRNLMGEDLDRLNLTGLQRWEHQLDSALKHIRSRKNQAMNESISELQKKDRTLREHNSLLSKKIKEKEKELTPQEQEGLQNNMDVSSVLVTQPLESLTIGGSPEVKSNKETPPSCRPKTILPPLMPLPTNE

SEQ ID NO: 3564 - protein, 320 aa, Glycine max
  Clone ID: PAT_MRT3847_102634C.1.pep
HASAVIITKDKTEIVTATSSKALKDVAYSFNEDEEEERPSTKPDAKKAEPFMSKTTLRSDNHEVSKEELRRQHQAELARQKNEETARRLAGGGSETGESRSSARTSAELMAYKNINDLPPPREMMIQIDQKNEAVLLPINGSMVPFHVAFIRTVSSQQDTNRNCYVRIIFNVPGTPFSPHDANSMKFPGSIYLKEASFRSKDSRHISEVVQSIKTLRRQVVARESERAERATLVTQEKLQLANNRFKPIRLSDLWIRPAFGGRGRKIPGTLEAHVNGFRYSTTRQDERVDIMFPNIKHAFFQPAENEMITLLHLHLDNHI

SEQ ID NO: 3565 - protein, 511 aa, Glycine max
  Clone ID: PAT_MRT3847_103232C.1.pep
MLLELALGLCVLAWFLHLRPTPSAKSKALRHLPNPPSPKPRPPFIGHLHLLKDKLLHYALIDLSKKHGPLFSLSFGTMATVGGSTPELFKLFLQTHEGTSFNTRFQTSAIRRLTYDNSVAMVPFGPYWKFVRKLIMNDLLNATTDNKLRPLRTQQIRKFLRVMAQSAEAQKPLDVTEELLKWTNSTISMMMLGEAEMIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVATEWALAELVRRSTAVVGKDRLVDEVDTQNLPYIRAIVKETFRMHPPLPVVKRKCTEECEINGYVIPEGALVLFNVWQVGRDPKYWDRPSEFRPERFLETGAEGEAGPLDLRGQHFQLLPFGSGRRMCPGVNLATSGMATLLASLIQCFDLQVLGPQGQILKGDDPKVSMEERAGLTVPRAHSLVCVPLARIGVASKLLS

SEQ ID NO: 3566 - protein, 521 aa, Glycine max
  Clone ID: PAT_MRT3847_103233C.1.pep
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEAGPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 3567 - protein, 521 aa, Glycine max
  Clone ID: PAT_MRT3847_103235C.1.pep
MLLELALGLFVLALFLHLRPTPSAKSKALRHLPNPPSPKPRLPFIGHLHLLKDKLLHYALIDLSKKHGPLFSLSFGSMPTVVASTPELFKLFLQTHEATSFNTRFQTSAIRRLTYDNSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVATEWALAELINNPRVLQKAREEVYSVVGKDRLVDEVDTQNLPYIRAIVKETFRMHPPLPVVKRKCTEECEINGYVIPEGALVLFNVWQVGRDPKYWDRPSEFRPERFLETGAEGEAGPLDLRGQHFQLLPFGSGRRMCPGVNLATSGMATLLASLIQCFDLQVLGPQGQILKGDDAKVSMEERAGLTVPRAHSLVCVPLARIGVASKLLS

SEQ ID NO: 3568 - protein, 560 aa, Glycine max
  Clone ID: PAT_MRT3847_103671C.1.pep
MGEVPAVMQATQGEQSNNASAVHWERFLPRMVLRVLLVEADDSTRQIIAALLRKCGYKVVAFCDGLKAWETLKNKAFDLDLILTEVDLPSISGFSLLTLIMEHDICKNIPVIMMSSHDSVSMVFKCMLKGAADFLIKPVRKNELRNLWQHVWRRHAISRPPQNLTLPEIELGFAAENHAASNDSSGSVASTPKDDECSEKTSEAHSTCPSPFLEAESTYMENMQDILQLKSSSNLSNIDTVKHENSTKYPSTGAIDLIATFKNLPKSTDEKCSFSSGNTAKFDFDTQLELSLRRDFPGSSCKAAFKERQILNHSNASAFSRYSNSKLLQPLFPTPSTISAKLTNASQNSHESLKLSKNTSTSHQYSEKSQNQEEKIITSVIGQSGQVDPKLPNSQLGLFPATGVTSDHKSKGNGNVFPSKLYAKSGVHPISTPKSVCQKESSPFPTSTSSQSNPQSHNSERHHWLEDATHASDQNVNDQSNLECETHDSPAASQSADSHRTSQREAALTKFRLKRKDRCYEKKVRYQSRKRLAEQRPRVKGQFVRQVHDDHPVADVGGGS

SEQ ID NO: 3569 - protein, 555 aa, Glycine max
  Clone ID: PAT_MRT3847_103672C.1.pep
MGLVAADKGSMQTQEEQSDNASAVQWERFLPRMVLRVLLVEADDSTRQIISALLHKCSYKVVAFCDGLKAWETLKNKPSDIDLILTEVDLPSISGFSLLTLIMEHDICKNIPVIMMSSHDSVSMVLKCMFKGAADFLIKPVRRNELRNLWQHVWRRHAISRPPQNFTLPEIEIGFAAENHAASNDSSGSVASTAKNGECSEKTSEAQDISQLKRSSNLSNIDTVKHENSTKYIHGCSDELVDPYTGAIDLIATFKNLPKSTDEKCSFSSGNTAKFDFDTQLELSLRRRDFPGSSCKAASEERQLLNHSNASAFSRYSSSKLLQPLFPTPSTISAKLTNSSLSSHESHKFSENASTSHQYGGKNQNQEKIITPVIGQSGQVDPKLPNSQLGYFPATGVTSDHKSTGNGNVFPSMLYAESGVHPIWTPKSVCQKESSPFPTITSSQSNPQSHNSECHLWSEDSTHASDKNLNDQINLDCETHDSPDASQSAGTNSHRTSHREAALTKFRLKRKDRCYEKKVRYQSRKRLAEQRPRVKGQFVRQVQDDHPVADVGGGS

SEQ ID NO: 3570 - protein, 155 aa, Glycine max
  Clone ID: PAT_MRT3847_104342C.1.pep
MDVGQMQRQWIDYTKSLFLEGFLDGQFLQLQQLQDENNPDFVVEVVSLFFEDSERLLKDLTFALDQNGVDFKKVDAHVHQLKGSSSSIGAQRVKNACIAFRNFCEEQNTDACLRCLQQVKQEYCIVKNKLETMFRLEQQIVAAGGSIPTELSFIG

SEQ ID NO: 3571 - protein, 200 aa, Glycine max
  Clone ID: PAT_MRT3847_104343C.1.pep
MDVGQMQRQWIDYTKSLFLEGFLDGQFLQLQQLQDENNPDFVVEVVSLFFEDSERLLKDLTFALDQNGVDFKKVDAHVHQLKGSSSSIGAQRVKNACIAFRNFCEEQNTDACLRCLQQVKQEYCIVKNKLETMFRLEQQIVAAGGSIPWVTERVYYDPRLLKIILYLIKSMVNVWVFIKIEVFHPMYLFLHQKALHASDL

SEQ ID NO: 3572 - protein, 155 aa, Glycine max
  Clone ID: PAT_MRT3847_104344C.1.pep
MDVGQMQRQWIDYTKSLFLEGFLDGQFLQLQQLQDENNPDFVVEVVSLFFEDSERLLKDLTFALDQNGVDFKKVDAHVHQLKGSSSSIGAQRVKNACIAFRNFCEEQNTDACVRCLQQVKQEYCLVKNKLETMFRLEQQIVAAGGSIPTELSFSG

SEQ ID NO: 3573 - protein, 392 aa, Glycine max
  Clone ID: PAT_MRT3847_104458C.1.pep
ISCVFLKIICLSSTFDALSSYLPNASWHNRKIQKEYNFLRFRWPSLNHHYKSIEGACTCKKCNIKFVVKATSEKSFESEPQAFDPKSILDSVKNSLDAFYRFSRPHTVIGTALSIISVSLLAVEKISDISPLFFTGVLEAVVAALFMNIYIVGLNQLSDVEIDKINKPYLPLASGEYSFETGVTIVASFSILSFWLGWVVGSWPLFWALFVSFVLGTAYSINVPLLRWKRFAVLAAMCILAVRAVIVQLAFFLHIQTHVYKRPPVFSRSLIFATAFMSFFSVVIALFKDIPDIEGDKVFGIQSFSVRLGQKPVFWTCVILLEIAYGVALLVGAASPCLWSKIVTGLGHAVLASILWFHAKSVDLKSKASITSFYMFIWKLFYAEYLLIPFVR

SEQ ID NO: 3574 - protein, 159 aa, Glycine max
  Clone ID: PAT_MRT3847_104508C.1.pep
MTGSADPLVISFGEMLIDFVPDTSGVSLAESCAFIKAPGGAPANVACAISKLGGNAAFVGKMGDDEFGRMLVDILRKNGVNTDGVCFDTEARTALAFVTLRKDGEREFMFYRNPSADMLLKESELNMGLIKQAKVFHYGSISLISEPCRSAHLAAMKVA

SEQ ID NO: 3575 - protein, 197 aa, Glycine max
  Clone ID: PAT_MRT3847_10478C.1.pep
SRIEAVVIATGVHTFFGKAAHLVDTTNQVGHFQKVLTAIGNFCICSIAVGMVIEIIVMYPIQDREYRPGIDNLLVLLIGGIPIAMPTVLSVTMAIGSHRLSQQGAITKRMTAIEEMAGMDVLCSDKTGTLTLNKLTVDKNLIEVFAKGVDADTVVLMAAQASRLENQDAIDTAIVGMLADPKEARLGIQEVHFLPFN

SEQ ID NO: 3576 - protein, 354 aa, Glycine max
  Clone ID: PAT_MRT3847_105008C.1.pep
MVEAQTWTTRRMSNPRLDTSTTDQVLDIPPTPPGELRNSFGSNPNNLSPTLLTALIISSWYLSNIGVLLLNKYLLSFYGYRFPIFLTMLHMLSCAAYSYASINFLELVPLQHIHSKKQFLKIFALSAIFCFSVVCGNTSLRYLPVSFNQAIGATTPFFTAIFAFLITCKKETGEVYLALLPVVFGIVVASNSEPLFHLFGFLVCVGSTAGRALKSVVQGILLTSEAEKLHSMNLLLYMAPLAAMILLPFTLYIEGNVLALTIEKAKGDPFIVFLLLGNATVAYLVNLTNFLVTKHTSALTLQVLGNAKAAVAAVVSVLIFRNPVTVMGMAGFGITIMGVVLYSEAKKRSKVTTH

SEQ ID NO: 3577 - protein, 444 aa, Glycine max
  Clone ID: PAT_MRT3847_105313C.1.pep
MDEEYDVIVLGTGLKECILSGLLSVDGLKVLHMDRNDYYGGESTSLNLIQLWKRFRGDDKPPPHLGASRDYNIDMNPKFIMANGNLVRVLIHTDVTKYLYFKAVDGSYVFNKGKVHKVPANDMEALKSPLMGLFEKRRARKFFIYVQNYNESDPKTHEGMDLTRVTTKELIAKYGLDDNTIDFIGHALALHSDDRYLAEPALDTVKRMKLYAESLARFQGGSPYIYPLYGLGELPQAFARLSAVYGGTYMLNKPECKVEFDEEGKVVGVTSEGETAKCKKVVCDPSYLPGKVRKVGRVARAIAIMSHPIPSTDDSHSVQIILPQKQLGRKSDMYLFCCSYTHNVAPKGKFIAFVSTEAETDQPAIELKPGIDLLGPVDEIFFDIYDRYEPVNEPTLDNCFISTSYDATTHFESTVDDVLNMYTLITGKVIDLSVDLSAASAAEE

SEQ ID NO: 3578 - protein, 224 aa, Glycine max
  Clone ID: PAT_MRT3847_105406C.1.pep
MAAAGCQKLLELSTKIVAVGRNYAAHAKELGNAVPKEPVLFLKPTSSYLSNGGTIQIPHNEGSLHHEVELAVVISKKARDVSESSAMDYVAGYALALDMTARDLQAAAKSAGLPWSLAKGQDTFTPISSILPKTTVPNPDDLELWLKVDEEIRQKGSTKDMIFKIPFLISYVSSVMTLFEGDVILTGTPPGVGPVKEGQTITAGITGLVDVQFNVEKRARPVLS

SEQ ID NO: 3579 - protein, 749 aa, Glycine max
  UNSURE (1)..(749): unsure at all Xaa locations
  Clone ID: PAT_MRT3847_105522C.1.pep
  unsure (1)..(749): unsure at all Xaa locations
SNASGTGTVAVAAAAAAAAPTMSFSYPNMPGNETPYLAILQNNAYSFPIPAHVGGPPGYRGTPHAQAFPFFNGSFYSSQMLHPSQIQQQQLPAQSQQQSQQGHQNASMSSGSSTSQKQHAQNQQQKPNNNATGSNGGGSLQGFPVTKNPPSLPLQLQQQQPQQRQNHHPSHPARQVESEMGGEDSPSTADSRLARATMNIYGQNFAMPMQSPNFALMTPASISAAGSNGGHGEKKQPQQHPGPNDAXTWKKQANWSRSRPTKIEMIWIPQFWXEIDQTKNIDVPELCLVICLYPGVYKSDKVDXKSNQNSIGXSEGCGGEKKMEERKGKNHLFFFWGCNGXLPTCSFSSSFLFSYFILSSRATWAAVXGSASSRASTSVMPAGISTNPASSQQQMQRNQQQQQILQHQKQNQFAAAAAAAARNKTPSTSNGSVYSDNLPSTSSMANKFPSAVSAFPQSLVQSSNTVAQSPQWKNSVRATTTSQSPPSMASTTPPSSVKNLPQQQARSQQPHTQISFATNPKSSAAQVQPSSSTQSPSPPVMVGSPTTSSMSKNTGSPRTTSASTTNNKISQSSSLSSQQAKNSSAVPARKSSPVGSRNVPSILNVPQLTPSSSTGSKSQLPQKQQPQQQIPKQALQQAQLLFSSPYVHPQSNSTTSTTTVPSGYYLQHQQRRGPEQMQRPGSSPAVNNVKGSSALPTQGLLHPAQVAAMQPSGSHPQFVPTGFSYASYHVHSVPSVQVKPAEQKQPAGE

SEQ ID NO: 3580 - protein, 315 aa, Glycine max
  UNSURE (1)..(315): unsure at all Xaa locations
  Clone ID: PAT_MRT3847_105727C.1.pep
  unsure (1)..(315): unsure at all Xaa locations
MTVEKEDLGLSLSLSFPQNPPTHLHLNLVSSSPSSHNPQKPSWNDPFTSSAGSSFLRGIDVNRLPSVVDCEEEAGVSSPNSTVSSVSGKRSEREEANGEENDTDRACSRGIISDEEDAETSRKKLRLSKDQSIILEESFKEHNTLNPKQKLALAKQLGLRARQVEVWIQNRRARTKLKRTEVDCEFLKRCCENLTVENRRLQKEVQELRALKLSPQFYMHMTPPTTLTMCPSCERVAVPPSSAVDPAMRHHHVPPTQPRAFPIGXMGHRCRHYPAQALRCPPSQILTRRNKMTKFEKKKTVVIVGSHELCVQSVV

SEQ ID NO: 3581 - protein, 58 aa, Glycine max
  Clone ID: PAT_MRT3847_106565C.1.pep
IDKDFKNPISFFGQILIKPRKNGDLVCLRPNSPGGSPSFYGGSVTLKLVLPPYSKWKK

SEQ ID NO: 3582 - protein, 234 aa, Glycine max
  Clone ID: PAT_MRT3847_10661C.1.pep
MAAKIFCFLMLLGLSASAATATIFPQCSQAPIASLLPPYLSPAVSSVCENPILQPYRIQQAIAAGILPLSPLFLQQSSALLQQLPLVHLLAQNIKAQQLQQLVLANLAAYSQQQQFLPFNQLAALNSASYLQQQQLPFSQLPAAYPQQFLPFNQLAALNSPAYLQQQQLLPFSQLAGVSPATFLTQPQLLPFYQHAAPNAGTLLQLQQLLPFNQLALTNPTAFYQQPIIGGALF

SEQ ID NO: 3583 - protein, 44 aa, Glycine max
  UNSURE (1)..(44): unsure at all Xaa locations
  Clone ID: PAT_MRT3847_106796C.1.pep
  unsure (1)..(44): unsure at all Xaa locations
LMTHGTGFKPYERCSMXAKRNRVGAISNQGVEQGCXRIRLEGKT

SEQ ID NO: 3584 - protein, 452 aa, Glycine max
  UNSURE (1)..(452): unsure at all Xaa locations
  Clone ID: PAT_MRT3847_106878C.1.pep
  unsure (1)..(452): unsure at all Xaa locations
MVEKSSRTNLGHHQDFGMEAYSIDGVSSQSESKFYDDDGHVKRTGNVWTTSSHIITAVVGSGVLSLAWAMAQMGWVAGPVVMIFFSAVTLYTMXFLADCCRHVVTVTRKRNYTFMDAVQSILGGYYDTFCGVDQYSVLYGTAVGYTIAASISMMAIKIQIFMKSGGSPXVAAIMSLVYPTMXSIIQILFSQIPDFHKTGSLSIVAAIMSFVYSTIGLALGIAKVAEMGTFKGSLTGVRIGTVTEATKVWGVFQGLGDIAFAYSYSQILIEIQDTIKSPPSEAKTMKKSAKISIGVTTTFYMLCGFMGYAAFGDSAPGNLLTGFGFFNPYWLIDIANAAIVIHLVGAYQVYAHPFRLVWRTVFVIITTFVAMLIPFFNDVLGLLGALGFWPLSVFLPVQMSIKQKRTPRWSGRWIGMQILSVVCFIVSVAAAVGSVASIVLDLQKYKPFHVKY

SEQ ID NO: 3585 - protein, 371 aa, Glycine max
  Clone ID: PAT_MRT3847_106879C.1.pep
MEPYSIDGVSSQTNSKFYDDDGHVKRTGTVWTTSSHIITAVVGSGVLSLAWAMAQMGWVAGPAVMIFFSVVTLYTTSLLADCYRCGDPVTGKRNYTFMDAVLSILGGYYDAFCGVVQYSNLYGTAVGYTIAASISMMAIKRSNCFHSSGGKSPCQVSSNPYMIGFGIIQILFSQIPDFHETWWLSIVAAIMSFVYSTIGLALGIAKVAEMGTFKGSLTGVRIGTVTEATKVWGVFQGLGDIAFAYSYSQILIEIQDTIKSPPSEAKTMKKSAKISIGVTTTFYMLCGFMGYAAFGDSAPGNLLTGFGFFNPYWLIDIANAAIVIHLVGAYQVYAQPLFAFVEKWASKRWPEVETEYKIPIPCFSPYNLSPF

SEQ ID NO: 3586 - protein, 59 aa, Glycine max
  UNSURE (1)..(59): unsure at all Xaa locations
  Clone ID: PAT_MRT3847_106982C.1.pep
  unsure (1)..(59): unsure at all Xaa locations
FARSSARGTNTVHTGTGPRSGXTGGTGSGGHGATGYGPTGGTGYGSGTGYGVTTGGALT

SEQ ID NO: 3587 - protein, 202 aa, Glycine max
  UNSURE (1)..(202): unsure at all Xaa locations
  Clone ID: PAT_MRT3847_107885C.1.pep
  unsure (1)..(202): unsure at all Xaa locations
SSSRSSRATLYVLTLTLPSASAVYWAFGDQLLTHSNALSLLPKTGFRDTAVILMLIHQFITFGFACTPLYFVWEKFIGVHETKSLFKRALARLPVVIPIWFLAIIFPFFGPINSTVGSLLVSFTVYIIPALAHMVTFASAPARENAGERPXSKLGGFXILYSMNVFVAVWVWGVGFGFRRWPTSICRLPLFLLFLFFFYHII

SEQ ID NO: 3588 - protein, 103 aa, Glycine max; identical to SEQ ID NO: 3555
  Clone ID: PAT_MRT3847_107992C.1.pep

SEQ ID NO: 3589 - protein, 45 aa, Glycine max
  UNSURE (1)..(45): unsure at all Xaa locations
  Clone ID: PAT_MRT3847_108009C.1.pep
  unsure (1)..(45): unsure at all Xaa locations
KIFHGMPGRFQGYGVSMSRPIITXGLXLLPXPVSLTXXGNXQDII

SEQ ID NO: 3590 - protein, 103 aa, Glycine max; identical to SEQ ID NO: 3555
  Clone ID: PAT_MRT3847_108585C.1.pep

SEQ ID NO: 3591 - protein, 109 aa, Glycine max
  Clone ID: PAT_MRT3847_108680C.1.pep
MASETASSADEETVVVVSAAAGAGGTDKRGKHRILAELKRLDQESKFLQEELEELEKTENVSTICTELLQNIDTRPDPLLPEVHGPVNLLWDRWFEGPQDPQACRCWIL

SEQ ID NO: 3592 - protein, 45 aa, Glycine max
  Clone ID: PAT_MRT3847_108684C.1.pep
FLRNASYSSTTHNLSKSLTNDNQIRRVNKTKLYLATHIASPQPTT

SEQ ID NO: 3593 - protein, 326 aa, Glycine max
  Clone ID: PAT_MRT3847_109156C.1.pep
MDNTKPLIELELDDDGRIRRTGNVWTASIHIITVVVGAGVLSLAWVMAQLGWLAGIASIITFSAVSIFTYNLVADCYRYPDPVTGKRNYTYMQAVKAYLGGTMHVFCGLVQYTKLAGITVGYTITSSTSLVAIRKAICIHKTGDAASCKFLNNPFMIGFGILQLFLSQIPNFHELTWLSTAACITSFGYVFIGSGLCLLVVLSGKGAATSITGTKLPAEDKLLRVFTGLGNIALACTYATVIYDIMDTLKSHPSENKQMKRANVLGVTAMAILFLLCSGLGYAAFGDNTPGNILTGFTEPFWLVALGNGFIVIHMIGAYQVRSFFH

SEQ ID NO: 3594 - protein, 106 aa, Glycine max
  Clone ID: PAT_MRT3847_109315C.1.pep
TRPRTRGHGDKKDEPWWPVLDTRDSLVETLTTIMWVTSGHHSAVNFGQYHFAGYFPNRPTTIRKNMPVEEGGPGEEMEKFLKQPETTLLDMLPTQMQAIKVMTTLD

SEQ ID NO: 3595 - protein, 411 aa, Glycine max
  Clone ID: PAT_MRT3847_110258C.1.pep
MEMDPPPKSWSIHTRSEIIAKYEVMERVGSGAYADVYRGRRLSDGLTVALKEIHDYQSAFREIDALQLLEGSPNVVVLHEYFWREDEDAVLVLEFLRTDLATVIADTAKANQPLPAGELKCWMIQILSGLDACHRHMVLHRDLKPSNLLISEHGLLKIADFGQARILMEPGIDASNNHEEYSRVLDDIDNKDTITSTHDGNATCNTSDVDREEEELGCFTSCVGTRWFRAPELLYGSRNYGLEVDLWSLGCIFAELLTLQPLFPGTADIDQLSRIIGVLGNLDENAWAACSKLPDYGIISFSKVENPAGLEACLPNRSPDEVALVKKLVCYDPAKRATAMELLHDKYFSDEPLPVLVSELRVPLTRKEQDGDSPGGWGDINDMDSDSDSQFDEFGPLNITRTGTGFSIQFP

SEQ ID NO: 3596 - protein, 105 aa, Glycine max
  UNSURE (1)..(105): unsure at all Xaa locations
  Clone ID: PAT_MRT3847_110470C.1.pep
  unsure (1)..(105): unsure at all Xaa locations
QVPYNQPITIXQKHYDDQGRXVDXYGNVEKHTDXYGNPVXHAASVTYVAXXTAAGGYSDVINXQHDTTNAYGGGTGRQHSSGGYDGDTXXQHXTTGGYNDDTNSH

SEQ ID NO: 3597 - protein, 331 aa, Glycine max
  Clone ID: PAT_MRT3847_110893C.1.pep
MANSMSFFLLLSFLAFAPLCLCHYNQEGYLYPQFYDYSCPQAQHIVKSVLAKYVAEQPRLAASILRLHFHDCFVKGCDASLLLDSSESINSEKGSNPNRNSARGFEVIDAIKAELERQCPSTVSCADILTLAARDSVVLTGGPNWEVPLGRRDSLGASISGSNNNIPAPNNTFQTILTKFKLQGLDLVDLVALSGGHTIGNARCTTFRQRLYNQSGNGEPDSTLDQYYASTLRTRCPSSGGDQNLFFLDYATPYKFDNSYFKNLLAYKGLLSSDQVLFTMNQESAELVKLYAERNDIFFEHFAKSMIKMGNISPLTNSRGEIRENCRRINA

SEQ ID NO: 3598 - protein, 78 aa, Glycine max
  UNSURE (1)..(78): unsure at all Xaa locations
  Clone ID: PAT_MRT3847_111031C.1.pep
  unsure (1)..(78): unsure at all Xaa locations
MASXXKHXADQGXARLHXYSNVEKQXDXYGNPXHAASVTYVSTRTAAGXYSDDINKQXXAXNXYXXDTGRRHSSXGYX

SEQ ID NO: 3599 - protein, 113 aa, Glycine max
  UNSURE (1)..(113): unsure at all Xaa locations
  Clone ID: PAT_MRT3847_111790C.1.pep
  unsure (1)..(113): unsure at all Xaa locations
AASKDRENCSCIAKLAEHAERYEEMVESLKNEANLDVELTEEERNLLSVGYKNVIGARRASWKILSSIRQLEXTKGNEXNAKRIKDNTHXVKLELTNICNDEMTVIDEHLMAS

SEQ ID NO: 3600 - protein, 295 aa, Glycine max
  Clone ID: PAT_MRT3847_111906C.1.pep
MAQSSSIVVTLRQHLFKRNLTSLTLPHSPSLPSFSFSLRTTPHTPLSLSASFSSHTSMAHTSLPSADAGMDAVQRRLMFEDECILVDENDRVVGHDSKYNCHLMEKIEAENLLHRAFSVFLFNSKYELLLQQRSATKVTFPLVWTNTCCSHPLYRESELIDENALGVRNAAQRKLLDELGIVAEDVPVDKFTPLGRILYKAPSDGKWGEHELDYLLFIVRDVNVNPNPDEVADIKYVNRDQLKELLRKADAGEEGLKLSPWFRLVVDNFLFKWWDHLEQGTLGEATDMKTIHKLT

SEQ ID NO: 3601 - protein, 35 aa, Glycine max
  Clone ID: PAT_MRT3847_111927C.1.pep
TLELIGVQYFCILSCIILWFNHMHYFMLCKIVIRI

SEQ ID NO: 3602 - protein, 595 aa, Glycine max
  Clone ID: PAT_MRT3847_112250C.1.pep
VATKTESNKVAGNAILYECVQTIMSIEDNGGLRVLAINILGRFLSNRDNNIRYVALNMLMKAVTADAQAVQRHRATIIECVKDSDASIRKRALELVYVLVNETNVKPLAKELIDYLEVSDLDFRGDLTAKICSIVAKYSPEKIWYIDQMLKVLSEAGNFVKDEVWYALVVVISNASELHGYTVRALYRAFQTSAEQETLVRVTVWCIGEYGDMLVNNVGMLDIEDPITVTESDAVDVIEIAIKRHASDLTTKAMALVALLKLSSRFPSCSERIKEIIVQFKGSFVLELQQRAIEFSSIISKHQNIRSTLVERMPVLDEATYIGRRAGSLPGAASTPTAPSFNLPNGVAKPVAPLVDLLDLSSDDAPAPSSSGGGDILQDLLGVDLSPASQQSVAGQASKSGNDVLLDLLSIGSPSAESSSSTVDILSSNSSNKAPVSSSLDGLSSLSLSTKTTSNAAPMMDLLDGFAPIPPTENNGPVYPSVTAFESSSLRLTFNFSKQPGNPQTTVIQATFMNLSSNTYTDFVFQAAVPKFLQLHLDPASSNTLPANGSITQSLKITNSQHGKKSLVMRIRIAYKINGKDTLEEGQVNNFPRGL

SEQ ID NO: 3603 - protein, 537 aa, Glycine max
  UNSURE (1)..(537): unsure at all Xaa locations
  Clone ID: PAT_MRT3847_112527C.1.pep
  unsure (1)..(537): unsure at all Xaa locations
MYEKGQSDEKGHFSSIFMGSDKILPSHVVANGHAPLDSGHARLKELGYKQELKRDLSVISNFAFSFSIISVLTGVTTLYNTGLNYGGPVSLVYGWFLASAFTMLVAFSMAEICSSYPTSGGLYYWSAKLAGPRWAPFASWITGWFNIVGQWAVTTSVDYSLAQLIQVIILLSTGGKNGGGYEASKYVVIAFHGGILFLHGIINSLPISLLSFLGQLAAIWNVIGVFVLMIVIPSVATERASAKFVFTHFNTENGEGINSKPYIFLLGLLMSQYTLTGFDASAHMTDDTKDADRNGPKGIISSVGISIVVGWGXILGITFAVTDILYLLSEDNDAGGYAIAQVFXQAFKKRSVHGSGDIINXVIVAVVIFFCGMSYVNRNSNMASAPNRDGCMPLSSLWHKVNKQEVPIYAVWLSVFISFCMALTSLGSIVAFEAMVSIATIGLYIAYAFPIFLRVTLARKHFVSGPFNLGRYGVVVGWVAVLWVLTISVLFSLPVSYPITIKTLNYTPVAVGCLLILVVSYWLISGRRWFKGPITNI

SEQ ID NO: 3604 - protein, 444 aa, Glycine max
  Clone ID: PAT_MRT3847_112528C.1.pep
MATIVSIKARQIFDSRGNPTVEVDLTCSDGTFARAAVPSGASTGIYEALELRDGGSDYLGKGVSKAVDNVNTIIAPALVGKDPTQQTAIDNLMVQQLDGTVNEWGWCKQKLGANAILAVSLAVCKAGAAVLKVPLYKHIANIAGNKKLVLPVPAFNVINGGSHAGNKLAMQEFMVLPVGASSFKEAMKMGVEVYHNLKSVIKKKYGQDAVNVGDEGGFAPNIQENKEGLELLKTAIAKAGYTGKVVIGMDVAASEFYKEDKTYDLNFKEDNNDGSQKISGDALKDLYKSFVTEYPIVSIEDPFDQDDWEHYAKLTAEVGTNVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 3605 - protein, 101 aa, Glycine max
  UNSURE (1)..(101): unsure at all Xaa locations
  Clone ID: PAT_MRT3847_113563C.1.pep
  unsure (1)..(101): unsure at all Xaa locations
RALALSSRSFNRERDTVAAGARTPREEFAYMAKLAEQAERYEEMVEFMEKVSDCAESEELTVEERNLLLVAYKNVIGARRASXRIICCIEQKEESRGIEDH

SEQ ID NO: 3606 - protein, 125 aa, Glycine max
  Clone ID: PAT_MRT3847_114189C.1.pep
MENSTQESHFRSENSVSYESPYPIYGMSFSPSHPHRLALGSFIEEYTNRVDILSFHPDTLSLTPNPSRSFDHPYPPTKLMFHPRKPPSSSSDLLATSGDYLRLWEVRDNFGEAVSLFNNSKTSEF

SEQ ID NO: 3607 - protein, 85 aa, Glycine max
  UNSURE (1)..(85): unsure at all Xaa locations
  Clone ID: PAT_MRT3847_114269C.1.pep
  unsure (1)..(85): unsure at all Xaa locations
SSRFGSRAFDEAIATLDTLDEESYKDXTLIMQLLRDNLTLWTSDMQDDGADEIKEAAPKPDDSKNILLLIRIELLLKIFLKGEVF

SEQ ID NO: 3608 - protein, 283 aa, Glycine max
  UNSURE (1)..(283): unsure at all Xaa locations
  Clone ID: PAT_MRT3847_114296C.1.pep
  unsure (1)..(283): unsure at all Xaa locations
YLEIHLFWAGKGTCCIPTQGTYGPLIQAIHAIPDFIPTVSNKPPSSNNNNIGLIIRLELGVGVVSVLSIFAIFCIIRRRRRRDDEKELLGIDTKPYTFSYSELKNATNDFNLENKLGEGGFGPVYKGTLNDGRVIAVKQLSVGSHQGKSQFITEIATISAVQHRNLVKLYGCCIEGSKRLLVYEYLENKSLDQALFGKCLTLNWSTRYDICLGVARGLTYLHEESRLRIVHRDVKASNILLDYELIPKISDFGLAKLYDDKKTHISTGVAXTIGYLAPEYAMR

SEQ ID NO: 3609 - protein, 124 aa, Glycine max
  Clone ID: PAT_MRT3847_11449C.1.pep
MEDLKEKVNEGEPTQIKYRGVRRRPWGKFAAEIRDSARHGARVWLGTFNTAEEAARAYDRAAFEMRGATAILNFPDEHPPCNVTSLSKKSSSSNTEIGKQVVVFECLDDKLLEELLDCDGENHQ

SEQ ID NO: 3610 - protein, 139 aa, Glycine max
  Clone ID: PAT_MRT3847_114734C.1.pep
VGCSSLDGRNLLESSKIALDKGKLEDAVNYGTKALAKMMAVCGPFHQNTASAYSLLAVVLYHTGDFNQATIYQQKALDINERELGLDHPDTMKSYGDLSVFYYRLQHIELALNYVNRALFLLHFTCGLSHPNTAATYIN

SEQ ID NO: 3611 - protein, 78 aa, Glycine max
  Clone ID: PAT_MRT3847_115437C.1.pep
STMTPSMMPPIMMPSMIPPTMMQSMVSSMIMPNMMTVPQCYSDSISHIIQQQQLPFMFSRTLVAISPMFLQQPFVGAA

SEQ ID NO: 3612 - protein, 65 aa, Glycine max
  Clone ID: PAT_MRT3847_115982C.1.pep
FHDNPTAASRPYDKDRDGFVMGEGAGVVVLEELEHAKARGARIYAEVAGYGLSGDAYHITAPSED

SEQ ID NO: 3613 - protein, 127 aa, Glycine max
  Clone ID: PAT_MRT3847_116452C.1.pep
MSQGRGSASLPIVVTVVSLLCLLVLLERADAATYTVGGPGGWTFNTNAWPKGKRFRAGDILIFNYDSTTHNVVAVDRSGYNSCKTPGGAKVFSSGKDQIKLARGQNYFICNYPGHCESGMKVAINAV

SEQ ID NO: 3614 - protein, 147 aa, Glycine max
  UNSURE (1)..(147): unsure at all Xaa locations
  Clone ID: PAT_MRT3847_116633C.1.pep
  unsure (1)..(147): unsure at all Xaa locations
MIQMNMKQPLVLPAHRGNVIGSRLASSPSPVAAAAAAASRRRGVVSSPRSRLQRHMRLPRISCSATEEASGAVSAVTVEKMLTVTASVQAAPAIGQMYXQRALDDAGDFFGKTLLMELVSSEVDAXTGLEKPPVTAFAHKTLREGHY

SEQ ID NO: 3615 - protein, 352 aa, Glycine max
  Clone ID: PAT_MRT3847_116966C.1.pep
MAPSFDFASSLLCTEDSTVFDESHNNGGTMMTAMGVYEDTRSPRRRHFDEEPDELPLLSDESLVMMVEKECQHWSGLRYLNKFQTGDLDFGARMEAIDWIHKVRSHFGFGPLCGYLSINYLDRFLFAYELPKGRVWTMQLLAVACLSLAAKLDETEVPLSLDLQVGESKFLFEAKTIQRMELLVLSTLKWRMQAITPFTFLDYFLCKINDDQSPLRSSIMRSIQLISSTARGIDFLEFKPSEIAAAVAMYVMGETQTVDTGKAISVLIQHVEKERLLKCVQMIQELSCNSGSAKDSSASVTCLPQSPIGVLDALCFNYKSDDTNASSCVNSSHNSPVAKRRKLNKTCGAEQL

SEQ ID NO: 3616 - protein, 114 aa, Glycine max
  Clone ID: PAT_MRT3847_117245C.1.pep
MPRDGAQAAPPPERGEMDEVVEADPDTEAEDQEERWARLLPELLSDVVRRVEASGGERWPARKDVVSCACVCRRWREAAVSVVRPPAESGKITFPSSLKQVDCMASLIWRHQRF

SEQ ID NO: 3617 - protein, 320 aa, Glycine max
  Clone ID: PAT_MRT3847_117585C.1.pep
MSDHLPREVLTEILSRLPVRSLLRFRSTSKSWKSLIDSQHLNWLHLTRSLTLASNTSLILRVDSDLYQTNFPTLDPPVSLNHPLMCYSNSITLLGSCNGLLCISNVADDIAFWNPSLRQHRILPYLPVPRRRHPDTTLFAARVCGFGFDHKTRDYKLVRISYFVDLHDRSFDSQLKLYTLRANAWKTLPSLPYALCCARTMGVFVGNSLHWVVTRKLEPDQPDLIIAFDLTHDIFRELPLPDTGGVDGGFEIDLALLGGSLCMTVNFHKTRIDVWVMREYNRRDSWCKVFTLDESREMRSWKCVRPLGYSSDGNKVLLEH

SEQ ID NO: 3618 - protein, 45 aa, Glycine max
  UNSURE (1)..(45): unsure at all Xaa locations
  Clone ID: PAT_MRT3847_117614C.1.pep
  unsure (1)..(45): unsure at all Xaa locations
HGSXAISXFPCLSPCLXAKHXXHXPXSYXTNGFXHCXXPLCYXLC

SEQ ID NO: 3619 - protein, 109 aa, Glycine max
  Clone ID: PAT_MRT3847_117866C.1.pep
MAGRGKAGGSAAAKKATSRSSKAGLQFPVGRIARFLKAGKYAERVGAGAPVYLAAVLEYLAAEVLELAGNAARDNKKTRIVPRHIQLAVRNDEELSKLLGMVTIANGGV

SEQ ID NO: 3620 - protein, 55 aa, Glycine max
  UNSURE (1)..(55): unsure at all Xaa locations
  Clone ID: PAT_MRT3847_118323C.1.pep
  unsure (1)..(55): unsure at all Xaa locations
XGHKLRXXXTDTPMRTITTEXGISTQSXIAVSSTRXXAIALXPSFRAAXSDSVSL

SEQ ID NO: 3621 - protein, 64 aa, Glycine max
  Clone ID: PAT_MRT3847_118387C.1.pep
RHYSIRRGYKGLPSIGDYILPPPCECDQRLQNELHNCRGCKLTIHRYILVWLWIRPANIANIQT

SEQ ID NO: 3622 - protein, 73 aa, Glycine max
  UNSURE (1)..(73): unsure at all Xaa locations
  Clone ID: PAT_MRT3847_118549C.1.pep
  unsure (1)..(73): unsure at all Xaa locations
MASXXKHYDDQGRXVDEYXNVXXXTXXYGNPVHAASVTYVXTRXAAGGYXDDINXQHDTXXAXGXDTGRQHSS

SEQ ID NO: 3623 - protein, 142 aa, Glycine max
  Clone ID: PAT_MRT3847_118762C.1.pep
TKLERGSRNHVRYEDENSRYLCIGSVEKVLCLIARWVEDPNSEAYKLHLARIPDYFWLAEDGLKIQSFGCQMWDAAFAIQAILACNVSEEYGPTLRKAHSFVKASQVRENPSGDFKAMYTHISKGSWTFSMHDHGWQVSDCT

SEQ ID NO: 3624 - protein, 503 aa, Glycine max
  Clone ID: PAT_MRT3847_119165C.1.pep
MSSTTQNRRSSFTPSTASSLAKAKRHPSSVSSSSSGKAKVVSTQNLAVKRAPLANLTNQRNAPYSSSSSSLVQGSNKVAKTKKEAPARTSVSKSTISGNKSSQLKSVNSSSVVIPKANSLSQKKDAAPTVATFAVPVRSGIDVSPSKSDGRFVSMDETTSSCDSIKSPDEVEYLDNRDVSDVDSIQKKIISNLNISDTTEPEGNVCSREIIVELEERVDKIVNIDNIYSDTQLCATYVCDIYKHLRESEEKKRPSTDFMDTIQKDINVSMRAILVDWLVEVAEEYRLVPETLYLTVNYLDRYLSGNAMNRQRLQLLGVSCMMIASKYEEICAPQVEEFCYITDNTYLKEEVLQMESAVLNYLKFEMTAPTVKCFLRRFVRAAAHDVQEIPSLQLEYLTNFIAELSLLEYSMLSYPPSLIAASVIFLARFILFPSKKPWNSTLQHYTLYRPSDLCACVKDLHRLCCSSHDSNLPAIRDKYSQHKYKCVAKKHIPPSIPQEVFQS

SEQ ID NO: 3625 - protein, 75 aa, Glycine max
  Clone ID: PAT_MRT3847_119722C.1.pep
MPYISVPKRYYLPTPYAFQKIWRRSSILISKKIFLLDILNRCVYFKFICSIILHVRGPKGEVFTKDSTLIMQLLT

SEQ ID NO: 3626 - protein, 184 aa, Glycine max
  Clone ID: PAT_MRT3847_12032C.1.pep
MTSLNLTLLTSVNPDDFRCPISLELMTDPVTVSTGQTYDRASIQKWLKAGNTKCPKTGEKLTNTDLVPNTTLKRLIQQFCADNGISVANSCNRKTNTVSAGSPAAAHAIQFLAWFLTRRLAFGTQDQKHKAAQEIRFLARTSIFNRACLIEMGTVPPLIELLASASNDNKSTQETTISALLKLS

SEQ ID NO: 3627 - protein, 329 aa, Glycine max
  Clone ID: PAT_MRT3847_120799C.1.pep
MATFEQFWSRKTLLGLALGQFLSLLITSTGFTSSLLAKKGINAPTSQSFLNYVFLAIVYGIIVLYRREALKAKWYYYILLGLVDVEANFLVVKAYQYTSLTSVMLLDCWSIPCVMLFTWIFLKTKYGFKKVTGVVVCIAGLVLVVFSDVHAGDRAGGSNPSIGDILVIAGATLYAVSNVSEEFLVKNADRVELMAMLGLFGGIISAIQISILERNELKSIHWSAGAVLPFVGFAVAMFMFYSLVPVLLKINGSTMLNLSLLTSDMWAVLIRIFAYHEKVDWMYYVAFGAVVVGLIIYSGGDGDENQDPHHVAEDASQRQHDEEATSGKS

SEQ ID NO: 3628 - protein, 159 aa, Glycine max
  UNSURE (1)..(159): unsure at all Xaa locations
  Clone ID: PAT_MRT3847_120904C.1.pep
  unsure (1)..(159): unsure at all Xaa locations
MTAHAGLFEVGSPKKGDTVYDTPASGAVGQLLGQYAKSTGRNVVGSAGRKEKVDLLKNKXXLDESDNYKEEPDLNTPSKRYFPEGIDLNSENVAGKTLDAVLPNMKFHGRIPVCGLISQDNLTQSDGVTNMANLICKRVYMDGLIATDLYHLYPIFLKL

SEQ ID NO: 3629 - protein, 227 aa, Glycine max
  UNSURE (1)..(227): unsure at all Xaa locations
  Clone ID: PAT_MRT3847_121346C.1.pep
  unsure (1)..(227): unsure at all Xaa locations
VRTSRVDPRVRKAPVSGGALGGGRMVEXTHSSVAVLDTAAGVWCDIKSVVTSSRTGRYSADAAGGDAAVELTRRCRHAAAAVGDLIFIYGGLRGGVLLDDLLVAEDLAAAETTAAASHAAAAAAASASNVQAGRLPGRYGFADDRTRETMPEAAADGSVVLGNPVAPPMNGDIYTDISTENAMLQGPRRTAKGVEYLVEASAAEAEAISAALAAAKARQETGEVELP

SEQ ID NO: 3630 - protein, 159 aa, Glycine max
  Clone ID: PAT_MRT3847_121950C.1.pep
ETARTREGAIAKDTTETELTKIPLLRATVETLHPSSKEEDDFMIRRFLRARDLDVEKASAMFLKYLKWRHEFVPNGSVSVSDVPIELAQDKVFMQGRDKIGRPILIVFGRRHFQNKDGLDEFKRFVVYVLDKVCASMPPGQEKFVGIAELKGWGYSNSD

SEQ ID NO: 3631 - protein, 256 aa, Glycine max
  Clone ID: PAT_MRT3847_121951C.1.pep
MEAVRAGREGAIGLGQGDGVAKDSTETELTKIRLLRAIVETRDPSSKEEDDFMIRRFLRARDLDVEKASAMLLKYLKWRNSFVPNGSVSVSDVPNELAQDKVFMQGHDKIGRPILMVFGGRHFQNKDGLDEFKRFVVYVLDKVCASMPPGQEKFVGIAELKGWGYSNSDVRGYLSALSILQDYYPERLGKLFIVNAPYIFMKVWQIVYPFIDNKTKKKIVFVEKNKVKSTLLEEMEESQVPEIFGGSLPLVPIQDS

SEQ ID NO: 3632 - protein, 294 aa, Glycine max
  Clone ID: PAT_MRT3847_12197C.1.pep
MEQYEKVEKIGEGTYGVVYKGRDRVTNETIALKKIRLEQEDEGVPSTAIREISLLKEMQHRNIVRLQDVVHDEKSLYLVFEYLDLDLKKHMDSSPEFAKDPRQVKMFLYQILCGIAYCHSHRVLHRDLKPQNLLIDRSTNALKLADFGLARAFGIPVRTFTHEVVTLWYRAPEILLGSRQYSTPVDIWSVGCIFAEMVNQRPLFPGDSEIDELFKIFRIMGTPNEDTWPGVTSLPDFKSAFPKWQPKDLKIVVPNLKPAGLDLLSSMLYLDPSKRITARSALEHEYFKDIKFVP

SEQ ID NO: 3633 - protein, 420 aa, Glycine max
  Clone ID: PAT_MRT3847_122017C.1.pep
MDKDKSLGLPPPSGRYSGYSSTGSVFNVKSEPSPSSSTTLYPPLAPGTTSSESSHFGHGLSTDSSGFSHDISRMPDNPPRNRGHRRAHSEILTLPDDISFDSDLGVVGGGDGPSFSDDAEEDLLSMYLDMDKFNSSSATSTFQHSQSMDGSTTIKPESPAGAPTSSTENVVIGAIERPRVAHQHMIAIDGANRIWPEMLVAASEDMSAADSKKAMSAAKLAELALIDPKRAKRIWANRQSAARSKERKMRYIAELERKVQTLQTEATSLSAQLTLLQRDTNGLNSENNELKLRLQTMEQQVHLQDALNDALKEEIQHLKILTGQAMPPNGGPMMNFASFGGGQQFYPNNHAMHTLLAAQQFQQLQIHPQKQQQHQFQQLQQQQREQHQQSIDLKMREATPTPCPKDNASSDVNPSGAKDC

SEQ ID NO: 3634 - protein, 244 aa, Glycine max
  Clone ID: PAT_MRT3847_122018C.1.pep
HSQSMDGSTTIKPELLVSGSEDMSAADSKKAISAAKLAELALIDPKRAKRIWANRQSAARSKERKMRYIAELERKVQTLQTEATSLSAQLTLLQRDTNGLNSENSELKLRLQTMEQQVHLQDALNDALKEEIQHLKILTGQVMAPNGGPMMKLASFGGGQQFYPNNHVMHTLLAAQQFQQLQIHPQKQQQQQHQHQFQQFQQQHQHQHQQHQQSSDLKMRETSPTPCPKDNTSSDVNPSGAKDC

SEQ ID NO: 3635 - protein, 476 aa, Glycine max
  Clone ID: PAT_MRT3847_122890C.1.pep
MGGGFRVLHLVRPFLSFLPEVQTADRKVPFREKVIYTVISLFIFLVCSQLPLYGIHSTTGADPFYWMRVILASNRGTVMELGITPIVTSGLVMQLLAGSKIIEVDNNVREDRALLNGAQKLLGILIAVGEAVAYVLSGMYGSVGQLGVGNAILIIIQLCFAGIIVICLDELLQKGYGLGSGISLFIATNICENIIWKAFSPTTINSGRGAEFEGAVIALFHLLITRTDKVRALREAFYRQNLPNVTNLLATVLIFLIVIYFQGFRVVLPVRSKNARGQQGSYPIKLFYTSNMPIILQSALVSNLYFISQLLHRKYSGNFFVDLLGKWKESEYGGGQSVPVGGIAYYITAPSSLADMAANPFHALFYLVFMLSACALFSKTWIEVSGSSAKDVAKQLKEQQMVMPGHRESNLQKELNRYIPTAAAFGGICIGALTVLADFMGAIGSGTGILLAVTIIYQYFETFEKERASELGFFGF

SEQ ID NO: 3636 - protein, 39 aa, Glycine max
  Clone ID: PAT_MRT3847_123247C.1.pep
SPLIMQLFCDNLTLWASDMQEDGANEIKKAAPKGGGGQN

SEQ ID NO: 3637 - protein, 167 aa, Glycine max
  Clone ID: PAT_MRT3847_123814C.1.pep
MVLSKTTSESDVSVHSTFASRYVRTSLPRFKMPEESIPKEAAYQIINDELMLDGNPRLNLASFVTTWMEPECDKLIMAAINKNYVDMDEYPVTTELQNRCVNMIAHLFNAPLEETETAVGVGTVGSSEAIMLAGLAFKRRWQNRRKLEGKPYDNPNIVTGANVQVCW

SEQ ID NO: 3638 - protein, 271 aa, Glycine max
  Clone ID: PAT_MRT3847_124335C.1.pep
MANPEGSSRGSRWSLKGTTALVTGGTRGIGHAVVEELAEFGATVYTCSRNEEELNACLKEWKEKGFSVSGLVCDASSPPHRENLIQQVASAFNGKLNILVNNVGTNVRKPTIEYTAEEYSKLMATNLDSTYHLCQLAYPLLKASGNGSIVSISSVASQTSVGSGAIYAATKAAIDQLTKYFACEWAKDNIRSNGVAPWYTITSLVEPLLANKQLVSEIISRTPIKRMAETHEVSSLVTFLCLPAASYITGQIVSVDGGFTANGFQPSMRIS

SEQ ID NO: 3639 - protein, 267 aa, Glycine max
  Clone ID: PAT_MRT3847_124426C.1.pep
MREEGSGYDSTPFLDTQYAECHVERTGTVWTAVAHIVTGVIGSGVLSLAWSIAQLGWIGGPLTIVFFAAITLLSSFLLSNTYRSPDPELGPHRSSSYLDAVNLHKGEGNSRFCAVFVNVSLYGFGIAYVITAAISMRAIQKSNCSQDNGNEVTCGFGDGYFMLIFGAMQVLLSQIPNFHNIQWLSILAAIMSFAYAFIGMGLSVGQVTENGHAEGSIEGIPTSSGIEKLWLVAQALDDIAFSYPFSVILIEIRDTLKCPPPEDVAMK

SEQ ID NO: 3640 - protein, 580 aa, Glycine max
  Clone ID: PAT_MRT3847_124570C.1.pep
MATPNPTRFSLAMERTGQWVFSPEIPTDVIVAVGQTNFSLHKFILAAKSNYVRKVIMESEESDLTRIEISDIPGGSEAFEKAAKFCYGVNFEITVHNVAALHCAAVFLQMTDEYCDGNLAGRTEDFLSQVGLSTLHSAVAVLKSCQKILPFAAEVNVVDRCVEVISCKACNEANFPSQSPPNWWTEELAVLDVDSFAKVITAMKQRGAKYLTVAGALITYTERALRELVRDQTGGGKGIRSPESGDSDSESKRSEQRELLQAIVPLFPTEKAAFPINFLCCLLRCAIYLRASSACKRELEKRVTEILEHVTVDDLLVLTFSYDGERLLDLDSVRRIISGFVEREKGTTVFNAGVNFNEDFSAAMQRVAKTVDSYLAEIAAYAELSISKFNGIAILIPKGARKSDDDLYRAVDIYLKVHPNLDEIEKEKVCSVLDTLKLSYEARVHASKNKRLPLQIVLHALYYDQLQIRSGTAADKQAVVAAAEKKQLQADVSLVRENEELRSELMKMKMFISDLQKNVHGTSSSGRENIGPTKKPTFFSSMSKKLSKLNPFKNGSKDTSHIDDAPVDLTKPRKRRFSIS

SEQ ID NO: 3641 - protein, 213 aa, Glycine max
  Clone ID: PAT_MRT3847_124754C.1.pep
LSKVPEGVDNNRGNVYIGSTSPTNVARAYYEQFQRDFSLFLKCRAEELVKGGRMVLTFLGRRSDDPSSKDGGYVWELMATALNDMVLQGIIKEEQLDTFNIPLYTPSPSEVKLEVLKEGSFASNRLEVSEVNWNAFDDWNALEFESERSDTLSDGGYNVAQCMRAVAEPMLVSHFGEAIIEEVFSRYQQILTDRMSKEQTKFINVTVLLTRKA

SEQ ID NO: 3642 - protein, 623 aa, Glycine max
  Clone ID: PAT_MRT3847_124919C.1.pep
MPAVYGARLTTFEDSEKESEYGYVRKVSGPVVVADGMAGAAMYELVRVGHDNLIGEIIRLEGNSATIQVYEETAGLMVNDPVLRTHKPLSVELGPGILGNIFDGIQRPLKTIAKRSGDVYIPRGVSVPALDKDTLWEFQPKKIGEGDLLTGGDLYATVFENSLMQHHIALPPDNMGKITYIAPPGQYSIKDTVLELEFQGVKKKFTMLQTWPVRTPRPVASKLAADTPLLTGQRVLDALFPSVLGGTCAIPGAFGCGKTVISQALSKYSNSDAVVYVGCGERGNEMAEVLMDFPQLTMTLPDGREESVMKRTTLVANTSNMPVAAREASIYTGITLAEYFRDMGYNVSMMADSTSRWAEALREISGRLAEMPADSGYPAYLAARLASFYERAGKVKCLGGPERTGSVTIVGAVSPPGGDFSDPVTSATLSIVQVFWGLDKKLAQRKHFPSVNWLISYSKYSTALETFYEQFDPDFINIRTKAREVLQREDDLNEIVQLVGKDALAEGDKITLETAKLLREDYLAQNAFTPYDKFCPFYKSVWMMRNIIHFYNLANQAVERGAGSDGQKISYTLIKHRMGDLFYRLVSQKFEDPAEGEAALVAKFQKLHEDLTNGFRNLEDETR

SEQ ID NO: 3643 - protein, 85 aa, Glycine max
  UNSURE (1)..(85): unsure at all Xaa locations
  Clone ID: PAT_MRT3847_125358C.1.pep
  unsure (1)..(85): unsure at all Xaa locations
AIRREHKHSDDQGRKVDKYDNITKQANEYGNPIHPASVTXMYPTKPPTGSYSDDINKQHDTTNAYDVDTRKQHSSGSYDGDTNKH

SEQ ID NO: 3644 - protein, 39 aa, Glycine max
  Clone ID: PAT_MRT3847_125661C.1.pep
LDTLGKESTKDTLLIMHLLCYTLTLWTSEMQDDGADEIK

SEQ ID NO: 3645 - protein, 299 aa, Glycine max
  UNSURE (1)..(299): unsure at all Xaa locations
  Clone ID: PAT_MRT3847_125727C.1.pep
  unsure (1)..(299): unsure at all Xaa locations
MNRGIEVLSPASYLQNSNWLFQESKEARWTAEENKLFENALAYYDKDTPDRWMRVAAMIPGKTVGDVIKQYRELEEDVSVIEAGLIPVPGYTTASSFTLEWVNNQGYDEFKQFCNVGAKRGASTRPTEQERKKGVPWTEEEHRQFLLGLKKYGKGDWRNISRNFVTTRTPTQVASHAQKYFIRQLTGGKDKRRSSIHDITMVNLQETKSPSSDTTKPSSPLQNQALSSMVKEEYEWKLPCEGMPIVFNSTSGNMFMSAPLHGISSYESRPQEQNLLRXLHGCQFSPCDAILQMQLMRHR

SEQ ID NO: 3646 - protein, 305 aa, Glycine max
  Clone ID: PAT_MRT3847_126514C.1.pep
PRVRDKKDEEGKVEDVDEKEEKEKKKKKIKEVSHEWQLVNKQKPIWMRKPEDITKEEYAAFYKSLTNDWEEHLAVKHFSVEGQLEFKAVLFVPKRAPFDLFDTRKKPNNIKLYVRRVFIMDNCEELIPEWLSFVKGIVDSEDLPLNISREMLQQNKILKVIRKNLVKKCIEMFFEIAENKEDYNKFYEAFSKNLKLGIHEDSQNKTKLAELLRYHSTKSGDEMTSLKDYVTRMKEGQNDIYYITGESKKAVENSPFLEKLKKKGFEVLYMVDAIDEYAVGQLKEFEGKKLVSATKEGLKLDESEA

SEQ ID NO: 3647 - protein, 627 aa, Glycine max
  Clone ID: PAT_MRT3847_126516C.1.pep
MASETETFAFQAEINQLLSLIINTFYSNKEIFLRELISNASDALDKIRFESLTDKSKLDAQPELFIHIIPDKTNNTLSIIDSGIGMTKADLVNNLGTIARSGTKEFMEALAAGADVSMIGQFGVGFYSAYLVADKVIVTTKHNDDEQYVWESHAGGSFTVTRDTSGENLGRGTKITLFLKEDQLEYLEERRLKDLIKKHSEFISYPISLWIEKTTEKEISDDEDEEEKKDEEGKVEDVDEDKEKEEKKKKTIKEVSHEWSLVNKQKPIWMRKPEEITKEEYAAFYKSLTNDWEEHLAVKHFSVEGQLEFKAVLFIPKRAPFDLFDTKKKPNNIKLYVRRVFIMDNCEELMPEYLSFVKGIVDSEDLPLNISREMLQQNKILKVIRKNLVKKCIEMFFEIAENKEDYNKFYEAFSKNLKLGIHEDSQNKTKLAELLRYHSTKSGDEMTSLKDYVTRMKEGQNDIYYITGESKKAVENSPFLEKLKKKGFEVLYMVDAIDEYAVGQLKEFEGKKLVSATKEGLKLDESEDEKKKKEELKEKFEGLCHVIKDVLGDKVEKVVVSDRVVDSPCCLVTGEYGWTANMERIMKAQALRDSSMAGYMSSQKTMEINPENPIMDDLMKRADADKK

SEQ ID NO: 3648 - protein, 665 aa, Glycine max
  Clone ID: PAT_MRT3847_126518C.1.pep
MASETETFAFQAEINQLLSLIINTFYSNKEIFLRELISNASDALDKIRFESLTDKSKLDAQPELFIHIIPDKTNNTLSIIDSGIGMTKADLVNNLGTIARSGTKEFMEALAAGADVSMIGQFGVGFYSAYLVADKVIVTTKHNDDEQYVWESHAGGSFTVTRDTSGENLGRGTKITLFLKEDQLEYLEERRLKDLIKKHSEFISYPISLWIEKTTEKEISDDEDEEEKKDEEGKVEDVDEDKEKEEKKKKTIKEVSHEWSLVNKQKPIWMRKPEEITKEEYAAFYKSLTNDWEEHLAVKHFSVEGQLEFKAVLFIPKRAPFDLFDTRKKPNNIKLYVRRVFIMDNCEELMPEYLSFVKGIVDSEDLPLNISREMLQQNKILKVIRKNLVKKCIEMFFEIAENKEDYNKFYEAFSKNLKLGIHEDSQNKTKLAELLRYHSTKSGDEMTSLKDYVTRMKEGQNDIYYITGESKKAVENSPFLEKLKKKGYEVLYMVDAIDEYAVGQLKEFEGKKLVSATKEGLKLDESEDEKKKQEELKDKFEGLCHVIKDVLGDKVEKVVVSDRVVDSPCCLVTGEYGWTANMERIMKAQALRDSSMAGYMSSKKTMEINPENPIMEELRKRADADKNDKSVKDLVLLLFETALLTSGFSLDDPNTFGYRIHRMLK

SEQ ID NO: 3649 - protein, 511 aa, Glycine max
  Clone ID: PAT_MRT3847_126530C.1.pep
MEAPSLTKPNDPTKPSNTSSTLSLEGGPGEASPLRKMFAVASIAAGIQFGWALQLSLLTPYVQLLGVPHAAASFIWLCGPISGLVVQPIVGYYSDHCTSRFGRRRPFILGGALAVAIAVFLIGYAADIGHSAGDDITKKTRPRAVGVFVIGFWILDVANNMLQGPCRAFLADLAAGDQQKTRIANGFFSFFMAVGNVLGYAAGSYSGLHKIFPFTETKACDVFCANLKSCFFFSILLLLFLATVALLYVKDKQVEAIPLDDATQPSCFFQLFGALKELKRPMWMLMLVTAVNWVGWFPYFFFDTDWMGREVYGGQVGEDAYANGVRVGSLGLMVNAVVLGFMSLAVEPLGKMVGGVKRLWAIVNFILAIGFGMTVVITKVAEHQRKMNPAAVGHPSEGVVVGSMVFFGVLGVPLAITFSVPFALASIYCSASGAGQGLSLGVLNLAIVVPQMVVSALSGPWDSLFGGGNLPAFMVGAAAAALSAIMAIVLLPTPKPADEAKASSMMAGGFH

SEQ ID NO: 3650 - protein, 636 aa, Glycine max
  Clone ID: PAT_MRT3847_127203C.1.pep
MMESCDCIDTQYPPDELLVKYQYISDVLIALAYFSIPVELIYFVQKSAFFPYRWVLMQFGAFIVLCGATHFINLWTFSPHSKSVAVVMTIAKVSCAIVSCATALMLVHIIPDLLSVKRRESILKNKAEELDREMGLILTQEETGRHVRMLTHEIRSTLDRHTILKTTLVELGRTLGLEECALWMPSRSGLNLQLSHTLTYHVQVGSTVQTNNPIVNEVFNSPQAMRIPPTCPLARIRPLVGRYVPPEVVAVRVPLLNLSNFQINDWPDISAKSYAIMVLILPTDSVRKWRDHELELVDVVADQVAVALSHAAILEESMRARDQFMEQNVALDLARREAEMAIHARNDFLAVMNHEMRTPMHAIIALSSLLLETELTPEQRVMIETVLKSSNVLATLINDVLDLSRLEDGSLELEMGKFNLHGVLGEIVELIKPIASVKKLPITLILSPDLPTHAIGDEKRLTQTLLNVVGNAVKFTKEGYVSVRVSVAKPESSQDWRPPEFYPASSDGHFYIRVQVKDSGCGILPQDIPHLFTKFAQSRSGPARPSSGAGLGLAICKRFVNLMGGHIWIESEGLDKGSTATFIVKLGICGNPDPSDHQAANRSQAYSGSGGLARFKPFITDENDTGFSTRRNQRSF

SEQ ID NO: 3651 - protein, 173 aa, Glycine max
  Clone ID: PAT_MRT3847_127234C.1.pep
MKVAQVLHMNGGVGHASYANNSLLQQKVICLTKPIREEAITSLYCNTVPRSLAVADLGCSSGPNTLLVVSEFIKIVEKLCRELNHKSPEYKVFLNDLPGNDFNNIFKSLDSFKKKLCDEMESGIGPCYFSGVPGSFYGRVFPNQSLHFVHSSYSLHWLSKVPEGVDNNRAMLH

SEQ ID NO: 3652 - protein, 67 aa, Glycine max
  UNSURE (1)..(67): unsure at all Xaa locations
  Clone ID: PAT_MRT3847_127507C.1.pep
  unsure (1)..(67): unsure at all Xaa locations
MAXAXXXXEXFVYMAXXAXXAERXXEMVXFMXKVXASAESEEXTVEEXNXLXVAYXNXIGXRXASWR

SEQ ID NO: 3653 - protein, 279 aa, Glycine max
  Clone ID: PAT_MRT3847_127582C.1.pep
MRVGSTANCCYLQLEAPQQNNVTESSSDMSDRMIKIQIANHPLYPDLLSAYIECQKVGAPPELACLLEEIGRESHRMNARREIVEGPELDHFMETFCEVLHRYKEELSRPFNEATLFLGDMESQLSNLCNGTLTKSSDNNNRSDEVASGASEEELSCGEMEAFEDHVSSSVTCPSDQRLKEMLLRKYSGHFSGLRKEFLKRRKKGKLPKDARIALMDWWNTHYRWPYPTEEEKVKLSEITGLDQKQINNWFINQRKRHWKPTDDMRSAVMDGIRGPMLF

SEQ ID NO: 3654 - protein, 311 aa, Glycine max
  Clone ID: PAT_MRT3847_127587C.1.pep
MEAVYRLKPLLDVVRVGNATTSEMRLDSTANCYLQLEAPQPQENNNVTDSSSDMSDRIIKIQIANHPLYPDLLSAYIECQKVGAPPELACLLEEIGRESHRMNARREIGEGPELDHFMETFCQVLHRYKEELSRPFNEATLFLGDMESQLSNLCNETLTKSSDNNNRSDEVASGASEEELSCGEMEAFEDNVSSVTCPSDQRLKEMLLRKYSGHFSGLRKEFLKRRKKGKLPKDARMALMGWWNTHHRWPYPTEEEKVKLSEITGLDQKQINNWFINQRKRHWKPTEDMRFAVMDGLRGGGGGGIGGPMLF

SEQ ID NO: 3655 - protein, 80 aa, Glycine max
  Clone ID: PAT_MRT3847_127714C.1.pep
PLERPPFYFFFFFFFFWSHTSHRSHLLLNTIIHACRENEASTGTRLSRRSPTPTTSSPSVSHSHSPQASSYQGPERDSLL

SEQ ID NO: 3656 - protein, 512 aa, Glycine max
  Clone ID: PAT_MRT3847_127767C.1.pep
MAPFPLMCFVILLLSSTVSVTATATQTTLTVGKLDQVPHIMCKECELPPPPPKECPPPPIPLAPPPPLPPSPSPPLPPSPPPPLPPSPSATLPAPIPLTHSLPKLIQVANPSSFNSSLATTAVLPLAAFFKSDFRELAMGIERGGFKGFRSAWSVPPKPCDSCKLASAALFCRPDSAFLCIACDSNIHCSNKLASRHERVWMCEVCEQAPAAVTCKADAAALCVTCDSDIHSANPLAQRHERVPVEPFFDSAESIVKASAAATFGFIVPSDDGGASDAFAPDDSDAAAWLIPNPNFGSKLMDAPEIKSKEIFFSEMDPFLDFDYSNSFQNHNSAGNDSVVPVQKPSLAPPLINNHHHHQSETCFDVDFCRSKLSSFNYPSNSLSQSVSSSSLDVGVVPDGNTVSDMSYSFGRNSSDSSGIVVVSGNSVGQGATQLCGMDREARVLRYREKRKNRKFEKTIRYASRKAYAETRPRIKGRFAKRTEIDSDVERLYSPGPAVLMLDTPYGVVPSF

SEQ ID NO: 3657 - protein, 203 aa, Glycine max
  UNSURE (1)..(203): unsure at all Xaa locations
  Clone ID: PAT_MRT3847_128170C.1.pep
  unsure (1)..(203): unsure at all Xaa locations
KMNTIKLYVRRVFIMDNCEELIPEYXLGFVKGVVDSDDLPLNISRELLQQNKILKVIRKNLVKKCIEMFNEIAENKEDYNKFYDAFSKNLKLGIHEDSQNRSKLADLLRYHSTKSGDELTSLKDYVTRMKEGQKDIYYITGESKKAVENSPFLERLKKKGYEVLFMVDAIDEYAVGQLKEYDGKKLVSATKEGLKLDDETEEE

SEQ ID NO: 3658 - protein, 86 aa, Glycine max
  Clone ID: PAT_MRT3847_128189C.1.pep
ETLGGIFTRLINRNTTIPTKKSQVFSTAADNQTQVGIKVLQGEREMAVDNKSLGEFELVGIPPAPRGMPQIEVTFDIDANGIVTVS

SEQ ID NO: 3659 - protein, 145 aa, Glycine max
  Clone ID: PAT_MRT3847_12866C.1.pep
MPVPLAPYPTPPAPYTPPANGVQSQLVCSGCRNLLVFPVGATSVCCAVCNAVTAVPPPGTEMAQLVCGGCHTLLMYIRGATSVQCSCCHTVNLALEANQVAHVNCGNCRMLLAYQYGARSVKCAVCNFVTSVGATASTTEQKFST

SEQ ID NO: 3660 - protein, 96 aa, Glycine max
  UNSURE (1)..(96): unsure at all Xaa locations
  Clone ID: PAT_MRT3847_128763C.1.pep
  unsure (1)..(96): unsure at all Xaa locations
ASSHHLPLPSAPSKSQFFGLSLSHSSLSILPASSSSLMCAIFAIVPKGSEPPNFTLIAXNGKSVSLANFSSTPVCVYFYPADETPGCSIQACAFRD

SEQ ID NO: 3661 - protein, 90 aa, Glycine max
  UNSURE (1)..(90): unsure at all Xaa locations
  Clone ID: PAT_MRT3847_129210C.1.pep
  unsure (1)..(90): unsure at all Xaa locations
DXXGNPVHAAXVTXXATRTAAGGXSDDIXXQHXTTNAYGVDTGRXXSSGGYDGDTXXXXGTXGGXXDDXXRHXGTTGVYGXDTDRQXRGT

SEQ ID NO: 3662 - protein, 203 aa, Glycine max
  Clone ID: PAT_MRT3847_129723C.1.pep
LQTVNLRSSEILDHPHTQICNEGRQNALSEILEILTVVCETHNLPLAQTWIPCKHRSVLAQGGGVKKSCSSFDGRCMGKVCMSTTDIAFYIIDAHLWGFREACVEHHLQQGQGVAGRAFLSHGMCFCSNITQFYKTDYPLVHYALMFGLTTCFAICLRSSHTGNDDYVLEFFLPPRITHIHEQKTLLGSILAIMTQHFQSLHI

SEQ ID NO: 3663 - protein, 132 aa, Glycine max
  UNSURE (1)..(132): unsure at all Xaa locations
  Clone ID: PAT_MRT3847_1298C.1.pep
  unsure (1)..(132): unsure at all Xaa locations
IPTKPVQEVIAEMPNGGVDRAXECTGSIQASISAFECTHDGWGTAVLVSVPKKDAEFKTHPMKFMEGRTLKGTFYGHYRPRTDIPGVVEKYLNKELELDKFITHSVPFSEINTAFDLMLKGEGIRCLICMEE

SEQ ID NO: 3664 - protein, 379 aa, Glycine max
  Clone ID: PAT_MRT3847_1301C.1.pep
MSTAGQVIKCRAAVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 3665 - protein, 343 aa, Glycine max
  Clone ID: PAT_MRT3847_13029C.1.pep
MAEVRNKQVVLRDYVSGFPKESDMNIVEGTTILKLPQGSNDVLLKNLYLSCDPYMRMLMTKVEGLDVFGTYTPGSPLTGYGVSKVLESGHPDYKKGDLVWGSTKWEEFSLVSPTQILFKIEHTDVPLSYYTGILGMPGMTAYAGFFEVGSPKKGENVFVSAASGAVGQLVGQFAKLTDCYVVGSAGSKEKVDLLKNKLGFDEAFNYKEESDLNATLKRYFPEGIDIYFENVGGKTLDAVLPNMKFHGRIPVCGMISQYNLTQFDGVTNLANLIFKRVKMEGFIATDFYHLYPKFLEFVLPHIRKGKVVYVEDIAEGLEKGPAALVGLYTGRNVGKQVVVVTHE

SEQ ID NO: 3666 - protein, 40 aa, Glycine max
  Clone ID: PAT_MRT3847_130881C.1.pep
GFLGKLNFSLKPKSAFSTVISSKTGRLSYEGDVERYCKKS

SEQ ID NO: 3667 - protein, 620 aa, Glycine max
  Clone ID: PAT_MRT3847_131458C.1.pep
MAVTKEKEDVRNTGKRLKCMRNEEEEVYEEEESELPLKPGFFFYPTTPTSFVVSDALEPDFPIIYVNKVFEISTGYRADEALGRNCRFLQYRDPRAQRRHPLVDPVVVSEIRRCLEEGVEFQGELLNFRKDGTPLVNRLRLAPIHDDDGTVTHVIGIQLFSEANIDLNRVSYPVFKETCNQDFDKTGKYNPKSGQSLYSQHQEMCGILQLSDEVLAHNILSRLTPRDVASIGSVCRRIRQLTKNEHVRKMVCQNAWGKEVTGTLELMTKKLGWGRLTRELTTLEAVCWRKLTVGGAVEPSRCNFSACAAGNRLVLFGGEGVDMQPMDDTFVLNLDAKNPEWRRVSVKSSPPGRWGHTLSCLNGSWLVVFGGCGRQGLLNDVFVLDLDAQQPTWREVCGGTPPLPRSWHSSCTIEGSKLVVSGGCTDAGVLLSDTYLLDLTTDNPTWREIPTSWAPPSRLGHSLSVYGRTKILMFGGLAKSGHLRLRSGEAYTIDLEDEQPQWRQLEYSAFTGLASQSAVVPPPRLDHVAVSMPCGRIIIFGGSIAGLHSPSQLFLLDPSEEKPSWRILNVPGQPPKFAWGHSTCVVGGTRVLVLGGHTGEEWILNELHELCLASRQDSDL

SEQ ID NO: 3668 - protein, 509 aa, Glycine max
  Clone ID: PAT_MRT3847_131774C.1.pep
MCSKPSFFPAMTKIVGTLGPKSRSVDVISQCLEAGMSVARFDFSWGDPEYHQETLENLRAAIKSTKKLCAVMLDTVGPELQVVNKTEHPISLQADTLVVLTPDQNKEATSNLLPVNFSGLSKAVKNGDTIFIGQYLFTGSETTSVWLEVSEVNGDDVTCVIKNSATLAGSLYTLHVSQIHIDLPTLDNKDKEVISTWGAQNNIDFLSLSYTRHAEDVRHAREFLSKLGNLKQTQIFAKIENIEGLTHFDEILREADGIILSRGNLGIDLPPEKVFLFQKAAIYKCNMAGKPAVVTRVVDTMTDNLRPTRAEATDVANAVLDGSDAIVLGAETLRGLYPVETISTVGKICAEAEKVYNQDLYFKKAVKFVGEPMTHLESIASSAVRAAIKVKASVIICFTSSGRAARLIAKYRPTMPVISVVIPQLKTNQLRWTFTGAFEARQSLIVRGLFPMLADPRHPAESKSATNESILKVALDHGKAFGIIKAHDRVVVCQKVGDSSVVKIIELDE

SEQ ID NO: 3669 - protein, 55 aa, Glycine max
  UNSURE (1)..(55): unsure at all Xaa locations
  Clone ID: PAT_MRT3847_131964C.1.pep
  unsure (1)..(55): unsure at all Xaa locations
MASSAPTPGEEFVYMAXLSKQASRYAEMVEFLETVSASAETEDLTVEKRNFLSVA

SEQ ID NO: 3670 - protein, 309 aa, Glycine max
  Clone ID: PAT_MRT3847_13199C.1.pep
MAITLNNGFKMPIIGLGVWRMEGNEIRDLILNSIKIGYRHFDCAADYKNEAEVGDALKEAFDSGLVKREDLFITTKLWNSDQGHVLEACKDSLKKLQLTYLDLYLVHFPVAVRHTGVGNTSSPLGDDGVLDIDTTISLETTWHAMEDLVSSGLVRSIGISNYDIFLTRDCLAYSKIKPAVNQIETHPYFQRDSLVKFCQKHGICVTAHTPLGGAAANAEWFGTVSCLDDQVLKGLAEKYKKTAAQISLRWGIQRNTVVIPKSSKLERLKENFQVFDFELSKEDMELIGSIDRKYRTNQPAVFWGIDLYA

SEQ ID NO: 3671 - protein, 454 aa, Glycine max
  Clone ID: PAT_MRT3847_132102C.1.pep
MASSRPANVGILAMDIYFPPTCVTQDALEGHDGVSKGKYTIGLGQDCMAFCSEVEDVISMSLTVVTSLLEKFNVDPKQIGHLAVGSETVIDKSKSIKTFLMQVFEASGNTDIEGVDSTNACYGGTAALFNCVNWVESSSWDGRYGLVVCTDTAVYAEGPARPTGGAAAIAMLVGPDAPIAFESKLRGSHMSHAYDFYKPNLASEYPIVDGKLSQTCYLMALDSCYRLYCEKFEKLEGRPFSMSDSDYFVFHSPYNKLVQKSFGRLYFNDFLRNASFVDEVARETLAPYASLSGDESYQSRDLEKANQQAAKHLYDAKVQPSTLIPKQVGNMYTASLYAAFASLLHNKNSSLVGKRVVMFSYGSGLTATMFSFQLQEGQHPFNLSNIVTVMNVSDKLKQRVEIPPEKFVETLKIMEHRYGGKDFVTSKDCSYLTPGTFYLTNVDSMYRRFYAKKD

SEQ ID NO: 3672 - protein, 36 aa, Glycine max
  Clone ID: PAT_MRT3847_132766C.1.pep
LVEAMSTTGQGIKCRTAVALEAGKPLSIGTIEVAPP

SEQ ID NO: 3673 - protein, 563 aa, Glycine max
  Clone ID: PAT_MRT3847_133042C.1.pep
MGQSVSSAAVASRRERDQGHRSVNSSKTRFTASVSPMAGYSSGAAEEGENHRVEAVADESTDYISDLPNECLASVFQFLSSADRSRCSLVCRRWLQIEGQSRHRLSLNAELDLFPAIPSLFSRFDSVTKLALKCDRRSVSIRDDALVLISQRCPNLTRLKLRACRELTDAGMEAFAKNCKGLKKLSCGSCTFGSKGMNAVLDNCAALEELSVKRLRGIADTAAAEPIGPGVAAASLKIVCLKELYNGQCFGTLILGAKNLKTLKLFRCSGDWDRLFQLMADRVTNMVEVHLERLQISDVGLQAIANFSSLEILHLVKTPECSDIGLVAIADRCKLLRKLHIDGWKANRIGDEGLIAVAKGCPNLLELVLIGVNPTKASLEMLASNCQNLERLALCGSDSVGDPEISCIAAKCVALKKLCIKSCPVSDQGMEALGNGCPNLVKVKVKKCKGVTPEGGDWLRRTRGSVAVNLDTGEAELQEASASDGGAQDNGVEFPQMPAQIAAASSSTRSSSSRFALMSARISAAALRSTRSGSSRLGLLPTRISAASTFRRWSGGSTSARHG

SEQ ID NO: 3674 - protein, 409 aa, Glycine max
  Clone ID: PAT_MRT3847_13379C.1.pep
MDWGLAISSHPKPYSVTTGGNLWRSKHTTKNIYFASSWISKASRHKRETQIEHNVLRFQQPSLDHHYKCIRGGSTYQECNRKFVVKAISKQPLGFEAHASNPKNILDSVKNVLSAFYWFSYPYTMIGITLCAFSSSLLAVEKLSDISLSFLIGVLQGVLPQLFIEIYLCGVNQLYDLEIDKINKPHLPMASGQFSFKTGVIISAAFLALSFGFTWITGSWPLICNLVVIASSWTAYSIDVPLLRWKRYPFVAAMCMISTWALALPISYFHHMQTVVLKRPIGFPRSLGFLVAFMTFYSLGLALSKDIPDVEGDKEHGIDSFAVRLGQKRAFWICVSFFEMAFGVGILAGASCSHFWTKIFTGMGNAVLASILWYQAKSVDLSDKASTGSFYMFIWKLLYAGFFLMALIR

SEQ ID NO: 3675 - protein, 692 aa, Glycine max
  Clone ID: PAT_MRT3847_134145C.1.pep
LWVEPALSSLVRSVCSHAPGVSPSPRYQHAAVFVNARLHVSGGALGGGRMVEDSSSVAVLDTAAGVWCDTKSVVTSPRTGRYSADAAGGDAAVELTRRCRHAAAAIGDLIFIYGGLRGGVLLDDLLVAEDLAAAETTAASHAAAAAAASNVQAGRLPGRYGFIDDRTRQTMPETDPDGSVVLGNPVAPPVNGDMYTDISTENALLPGSRRTSKGVEYLVEASAAEAEAISATLAAAKARQVNGEVELPDRDRGAEATPSGKQISSLIKPDSAGSNSIPPGGVRLHHRAVVVAAETGGALGGMVRQLSIDQFENEGRRVSYGTPESTTAARKLLDRQMSINSVPKKVVAHLLKPRGWKPPVRRQFFLDCNEIADLCDSAERIFSSEPSVLQLRAPIKIFGDLHGQFGDLMRLFDEYGAPSTAGDIAYIDYLFLGDYVDRGQHSLETITLLLALKVEYPNNVHLIRGNHEAADINALFGFRIECIERMGERDGIWTWHRINRLFNWLPLAALIEKKIICMHGGIGRSINHVEQIENIQRPITMEAGSIVLMDLLWSDPTENDSVEGLRPNARGPGLVTFGPDRVMEFCNNNDLQLIVRAHECVMDGFERFAQGHLITLFSATNYCGTANNAGAILVLGRDLVVVPKLIHPLPPAISSPETSPERHIEDTWMQELNANRPPTPTRGRPQVTNDRA

SEQ ID NO: 3676 - protein, 343 aa, Glycine max
  UNSURE (1)..(343): unsure at all Xaa locations
  Clone ID: PAT_MRT3847_134494C.1.pep
  unsure (1)..(343): unsure at all Xaa locations
MASVMLSGTEKLTLRTLTGNGLGFTGSDLHGKNFPRVSFVATTSAKVPNFRSLVVPKCSVSASRPSSQPRFIQHKKEAFWFYRFLSIVYDHVINPGHWTEDMRDDALEPADLNDRNMIVVDVGGXGSDTTRLVPIHMWMQESILSQRSPHQLAKAKQXKEPLKECKIIEGDAEDLPFRTDYADRYVSAGSIEYWPDPQRGIKEAYRVLKLGAKACLIGPVYPTFWLSRFFADVWMLFPKEEEYIEWFQKAGFKDVQLKRIGPKWYRGVRRHGLIMGCSVTGVKPASGDSPLQLGPKEEDVEKPVNPFVFALRFVLGALAATWFVLVPIYMWLKDQVVPKGQPI

SEQ ID NO: 3677 - protein, 352 aa, Glycine max
  UNSURE (1)..(352): unsure at all Xaa locations
  Clone ID: PAT_MRT3847_134495C.1.pep
  unsure (1)..(352): unsure at all Xaa locations
MASVMLSGTEKLTLRTLTGNGLGFTGSDLHGKNFPRVSFVATTSAKVPNFRSLVVPKCSVSASRPTSQPRFIQHKKEAFWFYRFLPRVNDMVIIPHVLGPMARVNDMVIHNXRDDALEPADLNDRNMIVVDVGGGTGFTTLGIVKHVDAKNVTILDQSPHQLAKAKQKEPLKECKIIEGDAEDLPFRTDYADRYVSAGSIEYWPDPQRGIKEAYRVLKLGGKACLIGPVYPTFWLSRFFADVWMLFPKEEEYIEWFQKAGFKDVQLKRIGPKWYRGVRRHGLIMGCSVTGVKPASGDSPLQLGPKEEDVEKSVNPFVFALRFVLGALAATWFVLVPIYMWLKDQVVPKGQPI

SEQ ID NO: 3678 - protein, 214 aa, Glycine max
  Clone ID: PAT_MRT3847_135197C.1.pep
MYTLNHSSYLYHVSPELSSSLDSSSPASEGSRGVAFSDEEVRLAVRHPKKRAGRKKFRETRHPVYRGVRRRNTDKWVSEVREPNKKTRIWLGTFPTPEMAARAHDVAAMALRGRYACLNFADSTWRLPIPATANAKDIQKAAAEAAEAFRPSQTLENTNTKQECVKVVTTTTITEQKRGMFYTEEEEQVLDMPELLRNMVLMSPTHCIGYEYED

SEQ ID NO: 3679 - protein, 796 aa, Glycine max
  Clone ID: PAT_MRT3847_135935C.1.pep
MAFSISLFLLVLLFSFQSSSSSLLSLNKGSSLSVEKHAEDVIVSPNQMFCAGFFQVGENAFSFAIWFNDPHTHNNNHTVVWMANRETPVNGRLSKLSLLNSGNMVLVGAGQITTWSSNTASDAPVKLHLQDDGNLVLLDLQGTILWQSFDTPTDTLLPGQLLTRYTQLVSSRSQTNHSPGFYKMLFDDDNVLRLIYDGPDVSSTYWPPPWLLSWQAGRFNYNSSRVAVLNSIGNFTSSDNYDFSTDDHGTVMPRRLKLDSDGNARVYSRNEALKKWYVSWQFIFDACTSHGICGANSTCSYDPKRGRRCSCLPGYRVKNHSDWSYGCEPMFDLTCSRNESIFLEIQGVELYGYDHNFVQNSTYINCVNLCLQDCNCKGFQYRYDGNQIFSCFTKSQLLNGRRSPSFNGAIYLRLPITNNFSKEESVSADDHVCSVKLRKDYVRKPENRLVRFFLWLATAVGALEVIFFFLIWGFLIWNLKTSSADQQGYHLAAVGFRKYSYLELKKATKGFSQEIGRGAGGIVYKGILSDQRHVAIKRLYDAKQGEGEFLAEVSIIGRLNHMNLIEMWGYCAEGKHRLLVYEYMENGSLAQNLSSNTLDWSKRYSIALGTARVLAYLHEECLEWILHCDIKPQNILLDASYQPKVADFGLSKLLNRNNLNNSSFSMIRGTRGYMAPEWVLNLAITSKVDVYSYGIVLLEMITGKSPTTTGVQNIDGEEPYNGRLVTWVREKRSATSWLEHIIDPAIKTNYDECKMNLLATVALDCVEEDKDVRPTMSHVVEMLQSHESDPRNIINA

SEQ ID NO: 3680 - protein, 218 aa, Glycine max
  Clone ID: PAT_MRT3847_136001C.1.pep
MADAETFAFQAEINQLLSLIINTFYSNASDALDKIRFESLTDKSKLDAQPELFIRLVPDKDNKTLSIIDSGIGMTKADLVNNLGTIARSGTKEFMEALQAGADVSMIGQFGVGFYSAYLVAEKVIVTTKHNDDEQYIWESQAGGSFTVTRDTDGEQLGRGTKITLFLKEDQLEYLEERRIKDLVKKHSEFISYPIYLWTEKTTEKEISDDEDDEPKRR

SEQ ID NO: 3681 - protein, 356 aa, Glycine max
  Clone ID: PAT_MRT3847_136003C.1.pep
MADAETFAFQAEINQLLSLIINTFYSNKEIFLRELISNASDALDKIRFESLTDKSKLDAQPELFIRLVPDKDNKTLSIIDSGIGMTKADLVNNLGTIARSGTKEFMEALQAGADVSMIGQFGVGFYSAYLVAEKVIVTTKHNDDEQYIWESQAGGSFTVTRDTDGEQLGRGTKITLFLKEDQLEYLEERRIKDLVKKHSEFISYPIYLWTEKTTEKEISDDEDDEPKKEEEGDIEDVDEEKEKDSKKKKKIKEVSHEWQLINKQKPIWLRKPEEITKDEYASFYKSLTNDWEEHLAVKHFSVEGQLEFKAILFVPKRAPFDLFDTRKKMNNIKLYVRRVFIMDNCEELIPEYLGFV

SEQ ID NO: 3682 - protein, 349 aa, Glycine max
  Clone ID: PAT_MRT3847_136440C.1.pep
MVSSLNSIKPLNMSSATKGDRKTALDVASWMFNIVTSVGIILVNKALMATYGFSFATTLTGLHFATTTLLTVFLKWLGYVQTSHLPLPDLIKFVLFANFSIVGMNVSLMWNSVGFYQIAKLSMIPVSCFLEVILDNVRYSRDTKLSISLVLLGVAVCTVTDVSVNAKGFIAAAVAVWSTSLQQYYVHFLQRKYSLGSFNLLGHTAPVQAASLLLVGPFLDYWLTNKRVDAYNYGFTSTLFIIISCTIAVGTNLSQFICIGRFTAVSFQVLGHMKTILVLALGFVFFGKEGLNLQVILGMTIAIAGMIWYGNASSKPGGKERLSLPINHTTNKTQEYNVLPVSSETDQEI

SEQ ID NO: 3683 - protein, 337 aa, Glycine max
  Clone ID: PAT_MRT3847_136906C.1.pep
MEFETSYPTCFMSNSSWFSQESQFTEWTREENKKFESALAIYDKDTPDRWLRVAAMLPGKTVYDVIKQYRELEEDVCEIEAGRIPVPGYPTSSLTLKMVDNQCYDACRKKPATLRSSDQERKKGVPWTEEEHRRFLMGLLKYGKGDWRNISRNFVVTKTPTQVASHAQKYYIRQKLSGGKDNKRRPSIHDITIVNLTSDQEKPLLLNDESHMTFEQQKLTSMPKVQLEWINHHDNGSRMVVNPNYDMFMSPSSGISSKTLKLQGQDFYECAFHETYAKLKNSGFRTTSRDFNKEVRQLFNMSISLYRLNLHHRMRHSGILSLGQRDNIQYSCTLILL

SEQ ID NO: 3684 - protein, 321 aa, Glycine max
  Clone ID: PAT_MRT3847_136907C.1.pep
MEFETSYPTCFMSNSSWFSQESHYTEWTREENKKFESALAIYDKDTPDRWLRVAAMLPGKTVYDVIKQYRELEEDVCEIEAGRIPVPGYPTSSFTLKMVDNQCYDACRKKPATLRSSDQERKKGVPWTEEEHRRFLMGLLKYGKGDWRNISRNFVVTKTPTQVASHAQKYYIRQKLSGGKDNKRRPSIHDITIVNLTSDQEKPLLLNDESHMTFEQQKLTSMPKVQLEWINHHDNGSRMVVNPNYDMFMSPSSGISSKTLKLQGQDFYECAFHETYAKLKNSGFRTTSRDFNKEDSICITGCAIQVANSLADVADSHEHLN

SEQ ID NO: 3685 - protein, 364 aa, Glycine max
  Clone ID: PAT_MRT3847_136948C.1.pep
MVKSNENGSGSVSVPPFLKKCYDMVEDRNTDSIIRWSDGGDSFVISDITQFSVTLLPTYFKHNNFSSFIRQLNIYGFRKIDTDSWEFANENFVRGQKHLLKNIHRRKHPHSADQQKALPQQDNCDEPSQEAPNHGLWKEVENLKLDKNSLTQELVKLRQHQESAESKLLLLSDRLQGMEKHQQQMLSFLVMVVQSPGFMVQLLHPKENNWRLAESWNRLDQDKQDDKPVASDGMIIKYKPPVGEKLKPVVPLSPGFENQPEPELSADGLKDLCISSEFLKVLLDEKLSPLENHSPFLLPDLPDDGSWEQLFLGSPFLGNIQDSKNESEGHTNSGMEMEPTISETPNENSRTFESMIVEMEKTRE

SEQ ID NO: 3686 - protein, 742 aa, Glycine max
  Clone ID: PAT_MRT3847_137166C.1.pep
MATGAAVPTTFSTLKTWDSSLGFAKNIDFVRVSDMKSMKSSARKRVSIIRNSNPGQDIAELQPASPGSPLLVPRQKYCESLHKPIRRKTSTVMVGNVAIGSEHPIRIQTMTTTDTKDVAGTVEQVMRIADKGADIVRITVQGKKEADACFEIKNTLVQKNYNIPLVADIHFAPSVALRVAECFDKIRVNPGNFADRRAQFETLEYTEEDYQKELEHIEKVFTPLVEKCKKYGRAMRIGTNHGSLSDRIMSYYGDSPRGMVESAFEFARICRKLDYHNFVFSMKASNPVIMVQAYRLLVAEMYVQGWDYPLHLGVTEAGEGEDGRMKSAIGIGTLLQDGLGDTIRVSLTEPPEEEIDPCRRLANLGMRASELQKGVEPFEEKHRHYFDFQRRSGQLPVQKEGEEVDYRGALHRDGSVLMSVSLDQLKMPEVLYKSLAAKLIVGMPFKDLATVDSILLRELPPVDDADARLALKRLIDISMGVITPLTEQLTKPLPNAMVLVNLKEISTGAYKLLPQGTRLVVSVRGDEPYEELDILKGVDATMLLHDLPYTEDRISRVHAARRLFEYLSDNSLNFPVIHHIQFPNGIHRDDLVIGAGSDAGALLVDGLGDGLLLEAPDKDFEFIRNTSFNLLQGCRMRNTKTEYVSCPSCGRTLFDLQEVSAQIREKTSHLPGVSIAIMGCIVNGPGEMADADFGYVGGTPGKIDLYVGKTVVKRGIAMEHATNALIDLIKEHGRWVDPPAEE

SEQ ID NO: 3687 - protein, 498 aa, Glycine max
  Clone ID: PAT_MRT3847_137229C.1.pep
KWSNLVRQQKMASDKVVETVIAGNYVEMETEGKPKDVKTKLSSLLWHGGSVYDAWFSCASNQVAQVLLTLPYSFSQLGMLSGILFQIFYGLLGSWTAYLISILYVEYRTRKEREKVNFRNHVIQWFEVLDGLLGKHWRNVGLAFNCTFLLFGSVIQLIACAGNIYYINDHLDKRTWTYIFGACCATTVFIPSFHNYRIWSFLGLLMTTYTAWYLTVASLLHGQMEGVKHSGPTKLVLYFTGATNILYTFGGHAVTVEIMHAMWKPQKFKALYLLATLYVLTLTLPSAAAVYWAFGDMLLNHSNAFALLPKSPFRDMAVILMLIHQFITFGFACTPLYFVWEKAIGMHECKSLCKRALVRLPVVIPIWFLAIIFPFFGPINSTVGSLLVSFTVYIIPALAHIFTFRSPSSRQNAVEQPPKFVGRWVGTFIINTFVVVWVLVVGFGFGGWASMVNFIRQIDTFGLFTKCYQCPPPLLPPMPPHQLNATAPSPLHHPHHAH

SEQ ID NO: 3688 - protein, 348 aa, Glycine max
  Clone ID: PAT_MRT3847_137321C.1.pep
QFYRSVNKTDYLTLRNGFITVHLAPGSKYNFQKFIKRSLEDDFKVVVGVSPILWASVVVYLLININGWRTTIWAALIPVVLILAVGTKLQAILAKMALEITERHAVVQGMPLVQGSDKYFWFGQPQLVLHVIHFALFQNAFQITYILWIWYSFGVRNCFRTDYKLAALKVAIGISMLCLCSYITLPLYALVTQMGSRMKTAVFEEQTNKALKKWHMDAKKKKKKHVGTVTLGKSSARIMDGSPIGNSSTVHSSSVPTLHRFKTTGHSTRSSSKEYEDHDHDHEYESDDVELFPVSSQTTSFIVRVDRGDQQQQAEEEHRQHSEGETNSSSEGEFSFAKPDPVEIRTTT

SEQ ID NO: 3689 - protein, 84 aa, Glycine max
  Clone ID: PAT_MRT3847_137585C.1.pep
LDLGVEGAVLQVDEVRDADELVVGTCMVEAEAVDAGGEESGVGVEAAAGEGQRGKNTVLAEGGVPKGDVVGDVGYTEESVAGTE

SEQ ID NO: 3690 - protein, 346 aa, Glycine max
  Clone ID: PAT_MRT3847_138356C.1.pep
MGKGGSLSDGVVKKIVLSYSYVAIWIFLSFTVIVYNKYILDKKMYNWPFPISLTMIHMSFCATLALLLVRVLRLVEPVSMSRDVYLSSVVPIGALYSLSLWLSNSAYIYLSVSFIQMLKALMPVAVYSIGVMLRKESYKNDTMLNMLSISLGVGVAAYGEARFDAWGVLLQLGAVAFEATRLVMIQILLTSKGISLNPITSLYYVAPCCLVFLSIPWIFVEYPVLRDTSSFHFDFVIGWTNSFCAFALNLAVFLLVGKTSALTMNVAGVVKDWLLIAFSWSVIKDTVTPINLFGYGLAFLGVAYYNHSKLQALKAKEAQKKTAQADEEEGRLLEDRDDNKRNEQQT

SEQ ID NO: 3691 - protein, 662 aa, Glycine max
  Clone ID: PAT_MRT3847_139152C.1.pep
MEGENASNKVIELMNEIASISDYRPPVKKQYCNLARRLKLLIPMFEEIRDMNKDALPDNTSNAVLAFKEALESAMELLRFGSEGSKLYLVLERDEIMNKFYKVTAQLEQSLGGISYDKLDISDEVKEQVELVLAQFRRAKGRVDEPDVRLYEDMLSVYNNSSDAATDPSVLSQLAEKLKLMGIADLTQESLALHEMVASSGGDPGARIEKMSMLLKKIKDFVQIENLVKDDNLGGKGIFSKVYGLGTNEKSHQAPVIPDDFRCPISLELMKDPVIVSTGQTYERTCIEKWLQAGHGTCPKTQKTLTSTVLTPNYVLRSLIAHWCEANGIEPPKRPSDSQPSKSASAYSPAEQSKIESLLQKLTSVSPEDQRSAAGEIRLLAKRNADNRVAIAEAGAIPLLVGLLSVPDSRTQEHAVTALLNLSIYENNKGSIVSSGAVPGIVHVLKKGSMEARENAAATLFSLSVIDENKVTIGSLGAIPPLVTLLSEGNQRGKKDAATALFNLCIYQGNKGKAVRAGVIPTLMRLLTEPSGGMVDEALAILAILASHPEGKATIRASEAVPVLVEFIGNGSPRNKENAAAVLVHLCSGDQQYLAQAQELGVMGPLLELAQNGTDRGKRKAGQLLERMSRLVEQQQEVPIQTETQAQNEDTQPPLITNPDDS

SEQ ID NO: 3692 - protein, 411 aa, Glycine max
  Clone ID: PAT_MRT3847_139372C.1.pep
MMLRRRGSVTSFYSKFIDSHNLNCGRSSSNPHRVAASATSFDISSASASKATTDFVSLTRHYGRCYWELSKARLSMLVVATSGTGFVLGSGSAVDLSALSCTCLGTMMVAASANSLNQVFEINNDAKMKRTSRRPLPSGRITIPHAVGWASSVGLAGTALLATQTNMLAAGLAASNLILYAFVYTPLKQIHPINTWVGAVVGAIPPLLGWAAASNDISLNGMILPAALYFWQIPHFMALAYLCRDDYAAGGFKMYSLADASGHRTALVALRNSIYLIPLGFLAYDWGLTSGWFCLESAALTLAISAAAFSFYRNRTKEKARRMFHASLLYLPVFMSGLLIHRRSENEQFLEDKAKGFVKSASSTESSELDDDNGDQNIKARRPYRTEARPPVSYASVAPFPFLPAPSYNFP

SEQ ID NO: 3693 - protein, 148 aa, Glycine max
  Clone ID: PAT_MRT3847_139958C.1.pep
IRLELRAESARVREDDRRGKYSEDDAKAVMVQILNVVAFCHLQGVVHRDLKPENFLYAKKDESSELKAIDFGLSDFVRPDERLNDIVGSAYYVAPEALHRSYSTEADVWSIGVIAYILLCGSRPFWARTESGIFRAVLKADPSFDETP

SEQ ID NO: 3694 - protein, 421 aa, Glycine max
  Clone ID: PAT_MRT3847_140022C.1.pep
MTSHSHYPPDLDADSVTSSPRSDHFHDAPPRIRFMCSFGGKILPRPHDNQLRYVGGDTRIVAVNRSITFSALILKLSKLSGMSNITAKYQLPNEDLDALISVTTDEDVENMMDEYDRVAHNQNPRSARLRLFLFPEGEDSRASSISSLLNGSAKRENWFLDALNGGVSGLERGRSEASSMVSEVPDYLFGLDNSEEITNHQRDPRPKPGPIIQDNVSVSDPGSPAPVVSSPYCSTSSAPPVPSLPNLPYVKTKPLNLNPVPDTDSKENQTEPETEPHPNLNLNQNPNMYSNNPVVHYPPEAAYSAHSVNPVPVYYVSGPVRPGSVPVPMQTPYHYVQQSYHAVVPPQVPIGYHPLVPGSGQVYGAGVRHMTPLQPYSPSTTAVVHDGLKQHVYHAVPNSGPVPVHPVIPMTGLDEPQRGGA

SEQ ID NO: 3695 - protein, 69 aa, Glycine max
  UNSURE (1)..(69): unsure at all Xaa locations
  Clone ID: PAT_MRT3847_140192C.1.pep
  unsure (1)..(69): unsure at all Xaa locations
MAASAPTPREDFVYMAXLAEKAERYEEMVDFMEKVSASAESEELTVEERNLLSVAXKNVMGARRASWRI

SEQ ID NO: 3696 - protein, 331 aa, Glycine max
  Clone ID: PAT_MRT3847_140374C.1.pep
MASSTNALPPTGNGLIVSFGEMLIDFVPTVSGVSLAEAPGFLKAPGGAPANVAIAVARLGGKAAFVGKLGDDEFGHMLAGILKENDVRSDGINFDQGARTALAFVTLRADGEREFMFYRNPSADMLLTPEDLNLELIRSAKVFHYGSISLIVEPCRSAHLKAMEVAREAGCLLSYDPNLRLPLWPSAEEARQQILSIWDKADVIKVSDVELEFLTGSDKIDDASALSLWHPNLKLLLVTLGEHGSRYYTKNFHGSVEAFHVSTVDTTGAGDSFVGALLSKIVDDQSVLEDEARLREVLKFANACGAITTTKKGAIPALPTEADALNLIKEA

SEQ ID NO: 3697 - protein, 330 aa, Glycine max
  Clone ID: PAT_MRT3847_140375C.1.pep
MASTNALPPTGNGLIVSFGEMLIDFVPTVSGVSLAEAPGFLKAPGGAPANVAIAVARLGGKAAFVGKLGDDEFGHMLAGILKENDVRSDGINFEKGARTALAFVTLRADGEREFMFYRNPSADMLLTPEDLNLELIRSAKVFHYGSISLIVEPCRSAHLKAMEVAREAGCLLSYDPNLRLPLWPSAEEARQQILSIWDKADVIKVSDVELEFLTGSDKIDDASALSLWHPNLKLLLVTLGEHGSRYYTKNFRGSVEAFHVNTVDTTGAGDSFVGALLSKIVDDQSILEDEARLREVLKFTNACGAITTTKKGAIPALPTEADALKLIKEA

SEQ ID NO: 3698 - protein, 261 aa, Glycine max
  Clone ID: PAT_MRT3847_140671C.1.pep
MTASKDRENFVYIAKLAEQAERYEEMVESMKNVANLDVELTVEERNLLSVGYKNVIGARRASWRILSSIEQKEETKGNELNAKRIKEYRQKVELELSNICNDVMRVIDEHLIPSAAAGESTVFYYNMKGDYYRYLAEFKSRNEKNEAADQSMKAYESATAAADADLPSTHAIRLGLALNFSVFYYEILNSPERACHLAKQAFDEAISELDTLNEESYKDSTLIMQLLRDNLTLWTSDIPEDGEDAQKVNGTAKLGGGEDAE

SEQ ID NO: 3699 - protein, 261 aa, Glycine max
  Clone ID: PAT_MRT3847_140672C.1.pep
MAASKDRENFVYIAKLAEQAERYEEMVESMKNVANLDVELTVEERNLLSVGYKNVIGARRASWRILSSIEQKEETKGNELNAKRIKEYRQKVELELSNICNDVMTVIDEHLIPSAAAGESTVFYYKMKGDYYRYLAEFKAGNEKKEAADQSMKAYESATTAAEADLPPTHPIRLGLALNFSVFYYEILNSPERACHLAKQAFDEAISELDTLNEESYKDSTLIMQLLRDNLTLWTSDIPEDGEDAQKVNGTAKLGGGEEAE

SEQ ID NO: 3700 - protein, 267 aa, Glycine max
  Clone ID: PAT_MRT3847_141088C.1.pep
MDPKLKEVSQLFDRFKASFLRNDFDNCSNLLSQLKVLLTGFRSLPPLFADTPNAVHELTIARDIYEHAVVLSVKIEDQDAFERDFFQLKPYYTDACNRLPPSPQEYPILGLNLLRLLVQNRIAEFHTELELLSSAALENPCIKHAVELEQSFMEGAYNRVLSARQTVPHDTYVYFMDLLAKTVRDEIAGCSEKAYDYLSIKDAKQMLLFSSDQELLEYIKEEHPEWEIKNDSVFFQKAKESAPCKEIPSLQLINQTLSYARELERIV

SEQ ID NO: 3701 - protein, 267 aa, Glycine max
  Clone ID: PAT_MRT3847_141090C.1.pep
MDPKLKEVSQLFDRFKASFIRNDFDTCSNLLSQLKVLLTGFRSLPPLFADTPNAVHELTIARDIYEHAVVLSVKNEDQDAFERDFFQLKPYYTDACNRLPPSPQEYPILGLNLLRLLVQNRIAEFHTELELLSSAALENPCIKHAVELEQSFMEGAYNRVLSARQTVPHDTYVYFMDLLAKTVRDEIAGCSEKAYDYLSIKDAKQMLLFSSDQELLEYIKEEHPEWEIKNGSVFFQKAKESAPCKEIPSLQLINQTLSYARELERIV

SEQ ID NO: 3702 - protein, 63 aa, Glycine max
  Clone ID: PAT_MRT3847_141452C.1.pep
MATLLASFIQCFNLQVLGPQEQILKGGAPKVSMKKKPALLVPRAQNFVFVPLPRMGVAFKPLF

SEQ ID NO: 3703 - protein, 68 aa, Glycine max
  Clone ID: PAT_MRT3847_141685C.1.pep
CNFRSYIFRSIKTTFGFCTSFLYPSNRCTYIVCLFLILQLKKHVVQMCVPYSITVYALSPSLYDVNAV

SEQ ID NO: 3704 - protein, 161 aa, Glycine max
  Clone ID: PAT_MRT3847_14188C.1.pep
VTCGKKLHRQGKNNTEPKQVPIYTKLAYILGLRVSPHHRRMGIGMKLVKKMEEWFRDNGAEYAYMATEKDNVASVKLFTDKCGYSKFRTPCILANPVFSHPARISHKVTIIELSPSDAEILYRSKFSTTEFFPRDVDSVLRNKLSLGTFLAVPKGLYRADT

SEQ ID NO: 3705 - protein, 145 aa, Glycine max
  Clone ID: PAT_MRT3847_141898C.1.pep
MEVAKVLHMNGGVGDASYANNSFVQQKLICLTKPLREEAIKSLYCGTLPRRLAMADLGCSSGQHALIVVSDFIKTVEKLCLELNHKSPEYKVFFNDLPGNDFNNIFKSLDSFKQKLCEEMESGIGPCYFFGAPGSFYGRIFSNQS

SEQ ID NO: 3706 - protein, 68 aa, Glycine max
  Clone ID: PAT_MRT3847_141941C.1.pep
MFGTTNSCVSVMDGIYPKVFENSDGARTSPSVVAFYQKGELLVGSPAKRQAVTNPTNTLFGTKRLIGR

SEQ ID NO: 3707 - protein, 173 aa, Glycine max
  Clone ID: PAT_MRT3847_142333C.1.pep
PRVRPRVRNDAALRPLAKCSELLVLKLGLCSSISDKGLAFISSSCGKLIELDLYRCNSITDDGLAALANGCKKIKMLNLCYCNKITDTGLGHLGSLEELTNLELRCLVRITGIGISSVAIGCKNLIEIDLKRCYSVDDAGLWALARYALNLRQLTISYCQVTGLGLCHLLSSL

SEQ ID NO: 3708 - protein, 196 aa, Glycine max
  UNSURE (1)..(196): unsure at all Xaa locations
  Clone ID: PAT_MRT3847_142358C.1.pep
  unsure (1)..(196): unsure at all Xaa locations
PRVRASCRMALLLGLLLLVVASPAIADDDSGIYYQLALMWPGAYCEQTSAGCCKPTTGVSPARDFYITGFTVLNATTDAAVTGCSNKVPYDPNLITGIQGLNQYWSNIRCPSNNGQSSWKNAWKKAGACSGLSEKDYFETALSFRSRINPLVRLKAKGIEPDFGLYGLKAITKVFKSGINATPVIQCSXGPFDKYM

SEQ ID NO: 3709 - protein, 145 aa, Glycine max
  Clone ID: PAT_MRT3847_142490C.1.pep
MEVAQVLHMNGGVGDASYANNSFVQQKAICLSKPIREEAITGLYCNTVPRSLAIADLGCSYGPNTLSVVSEFIKTVEKLCRKLNHKSPEYKVFLNDLPGNDFNNIFMSLDNFKEKLCDEIETGVGPCYFFGVPGSFYSRVFPNQS

SEQ ID NO: 3710 - protein, 103 aa, Glycine max; identical to SEQ ID NO: 3555
  Clone ID: PAT_MRT3847_142514C.1.pep

SEQ ID NO: 3711 - protein, 160 aa, Glycine max
  Clone ID: PAT_MRT3847_14254C.1.pep
MTQVRNKQVVLRDYVTGFPKESDMNIVEGTIILKVPEGSNDVLLKNLYLSCDPYMRLLMAKDRSFGDGSFTLASPLKGYGVSQVLESGRPDYKKGDLVWGITKWEEYSLVPSSLIHFKIEHTDVPLSYYTGILGMPGMTAYAGFFEVGSPKKRDTVFVSA

SEQ ID NO: 3712 - protein, 309 aa, Glycine max
  Clone ID: PAT_MRT3847_142712C.1.pep
MNRGIEVLSPASYLRSSNWLFQESLGTRWTPQENKLFENALAVFDKDTPDRWLKVAALIPGKTVGDVIKQYRELEEDVSVIESGFIPLPGYTAADSFTLEWVNNQGFDGLRQFYGVTGKRGASTRPSEQERKKGVPWTKEEHRQFLMGLKKYGKGDWRNISRNFVTTRTPTQVASHAQKYFIRQLSGGKDKKRSSIHDITMVNLPEAKSPSSESNNRPYSPDHSVKDVNPPSQNQRLSTTMVIKQEHDWKLPCETVPMLFNSTNGNMFMTPLCGISSYGSKPLQEQYFLSGCQFGPYDTIMQMPSMQNQ

SEQ ID NO: 3713 - protein, 272 aa, Glycine max
  Clone ID: PAT_MRT3847_142931C.1.pep
RAESARAQLGMVSGILLQIFYGLIGSWTAYLVSVLYIEYGSRKEKENVSFKNHVIQWFEVLDGLLGRYWKAVGLAFNCTFLLFGSVIQLIACASNIYYINDKLYKRTWTYIFGACCAFTVFIPSFHNYRIWSFLGLGMTTYTAWYLAIAAILHGQVENVTHSGPTKLILYFTGATNILYTFGGHAVTVEIMHAMWQPRKFKSIYFLATLYVFTLTIPSAVAVYWSFGDQLLDHSNAFSLLPKNVFRDAAVILMLIHQFITFGFACTPLYFCV

SEQ ID NO: 3714 - protein, 54 aa, Glycine max
  Clone ID: PAT_MRT3847_143114C.1.pep
AGRLSEPYKGIGDCFGRTTKDEGLVSLWRGNTANVIRYFPTQALNFAFKTNLRK

SEQ ID NO: 3715 - protein, 371 aa, Glycine max
  Clone ID: PAT_MRT3847_143255C.1.pep
MMEGVSREAQMSIAASSMFPGFRFCPTDEELISYYLRKKLEGHEESVQVISEVELCKYEPWDLPAKSFIQSDNEWFFFSPRGRKYPNGSQSKRATECGYWKATGKERNVKSGSNIIGTKRTLVFHLGRAPKGERTEWIMHEYCINDKSQESLVICRLKRNTEFRLSDASNRASSSQRHPVNSHESGCAISGGGIDQRDACEQDKEVGCSSKRDSSSYGSPSMEQIDSVSESNQRPVNEATFTESSGQPKEGYEEDCYAEILKDDIIKLDESSVLVESHTRPQDPTQMQPAPQGTAQRRIRLRVGNSKHSRAVVRFPSTMHSSKNTFFARTTNSLVVLAFFVFTLMVLYFLSLVRGQKQDKYCGEFSGVNHD

SEQ ID NO: 3716 - protein, 47 aa, Glycine max
  UNSURE (1)..(47): unsure at all Xaa locations
  Clone ID: PAT_MRT3847_14659C.1.pep
  unsure (1)..(47): unsure at all Xaa locations
MGLGSKXKKKKKKKKKKKKKKKKKKKKKKKKKKKKKKKGGGVLKDQS

SEQ ID NO: 3717 - protein, 49 aa, Glycine max
  UNSURE (1)..(49): unsure at all Xaa locations
  Clone ID: PAT_MRT3847_14773C.1.pep
  unsure (1)..(49): unsure at all Xaa locations
TTRAATRTLTPNYVLRSLRAEWCEANGIXPPKRPNDSQPNKITSSYSSG

SEQ ID NO: 3718 - protein, 46 aa, Glycine max
  Clone ID: PAT_MRT3847_14878C.1.pep
FQNPMNLSFRGRHHCGGSVLSVLAFKMVRAWLGCFSVVHIQASKAI

SEQ ID NO: 3719 - protein, 102 aa, Glycine max
  UNSURE (1)..(102): unsure at all Xaa locations
  Clone ID: PAT_MRT3847_1499C.1.pep
  unsure (1)..(102): unsure at all Xaa locations
KTAQDIWNAELPPXTHPNRVGPAFNFFGFYYEILNFPDWACNLAKQGFDEAIAELDTLGEESFKDSPLVMQLLCDNLPLWAFAMQGDGADXIKKAAPKPDGQ

SEQ ID NO: 3720 - protein, 154 aa, Glycine max
  UNSURE (1)..(154): unsure at all Xaa locations
  Clone ID: PAT_MRT3847_15347C.1.pep
  unsure (1)..(154): unsure at all Xaa locations
SILTVVCETHSLPLAQTWVPCKHRSVLAHGGGHKKSCSSFDGCCMGQVCMSITEVAFYVIDAHTWGFHEACVEHHLQQGQGVAGRAFLSHNMCFCGNIAQFCKTEYPLVHYALMFGLTSCFAXCLQSSHTGKDDYVLEFFLPPGITDFNEQIDC

SEQ ID NO: 3721 - protein, 164 aa, Glycine max
  Clone ID: PAT_MRT3847_15380C.1.pep
RRVVSLLINRNQHGISDRSISYANDLKHNQIWLSEIEEEAKKGIPLDMYLILGVEHSVSSSEIKKAYHKAALRHHPDKAGQSLARSDNGDDQIWKDIVEEISKDADRLFKIIGEAYAVLSDTAKRSQYDSEEEMRNSQKKRHGNSINRNNVIDQTDNRRHWKEV

SEQ ID NO: 3722 - protein, 607 aa, Glycine max
  Clone ID: PAT_MRT3847_15714C.1.pep
MDTNIGSLSLDACKPANNDVGCPPNGAVSAIKPSVPATTMTSSDATLGRHLARRLVQVGVTDVFSVPGDFNLTLLDHLIAEPQLKNIGCCNELNAGYAADGYARCRGVGACVVTFTVGGLSVINAIAGAYSENLPLICIVGGPNTNDFGTNRILHHTIGLSDFSQELRCFQTVTCYQAVVNNIEDAHELIDTAISTCLKESKPVYISISCNLPGIPHPTFSREPVPFSLSPRLSNKMGLEAAVEAAAEFLNKAVKPVMVGGPKLRVANACDAFVELADACGYPFAVMPSAKGLVPEHKPHFIGTFWGAVSTAFCAEIVESADAYLFAGPIFNDYSSVGYSLLLKKEKAIIVQPERVVISNGPAFGCVLMKDFLRELAKRLKHNNTAYENYSRIFVPEGKPVKAEPREPLRVNVLFKHIQDMLSGETAVIAETGDSWFNCQKLKLPKGCGYEFQMQYGSIGWSVGATLGYAQAVPEKRVISCIGDGSFQVTAQDVSTMLRNEQKTIIFLINNGGYTIEVEIHDGPYNVIKNWNYTGLVDAIHNGEGKCWTTKVTCEEELVEAIQTATGDKKDCLCFIEVIVHKDDTSKELLEWGSRVCAANGRPPNPQ

SEQ ID NO: 3723 - protein, 60 aa, Glycine max
  Clone ID: PAT_MRT3847_15851C.1.pep
MASYQKHYDDQGRKVDEYGNPEKHTREYGNPVHAGSGTYVAPITGAGGFRGDIYKPPDSP

SEQ ID NO: 3724 - protein, 126 aa, Glycine max
  Clone ID: PAT_MRT3847_15920C.1.pep
DHNTNTDFDSIRFDSVEVLSSSKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 3725 - protein, 411 aa, Glycine max
  Clone ID: PAT_MRT3847_16358C.1.pep
MDVDSSMVPETDHDPAVQNHAADDPAPDAAEGEQLGEPPSSGGGSPEQTQPAPASAPQSPVVGPRLAPSYTVVNAILEKKEDGPGPRCGHTLTAVAAVGEEGTPGYIGPRLILFGGATALEGNSAATGTPSSAGNAGIRLACATADVHWYARVRNKWSRITPIGEPPTPRAAHVATAVGTMVVIQGGIGPAGLSAEDLHVLDLTQQRPRWHRVGVPGPGPGPRYGHVMALVGQRYLMAIGGNDGKRPLADVWALDTAAKPYEWRKLEPEGEGPPPCMYATASARSDGLLLLCGGRDANSVPLSSAYGLAKHRDGRWEWAIAPGVSPSPRYQHAAVFVNARLHVSGGALGGGRMVEDSSSVAVLDTAAGVWCDTKSVVTSPRTGRYSADAAGGDAAVELTRRCRHAAAAIGD

SEQ ID NO: 3726 - protein, 80 aa, Glycine max
  UNSURE (1)..(80): unsure at all Xaa locations
  Clone ID: PAT_MRT3847_16403C.1.pep
  unsure (1)..(80): unsure at all Xaa locations
PVHAPSVTYVATRTAARGYSDDINKQHDTTNAYGVDTVRXHFYGGFDGDTNKPHGITGGYNDDSXRPYGTPGVFCINPDR

SEQ ID NO: 3727 - protein, 113 aa, Glycine max
  Clone ID: PAT_MRT3847_16414C.1.pep
STRVGRAQRKQEEELSLWRKKLVLQSNRVDVFMGYSENPINPPQGKEMGGFLRRAAPSGGPADRPGAELQLELLRRGLTRRDRPMMDAAASVFLFPSFLYLSGVSFGRIRTRG

SEQ ID NO: 3728 - protein, 453 aa, Glycine max
  Clone ID: PAT_MRT3847_16575C.1.pep
MATWILSECGLKPLAPVIPRPRTGAALSSTSRVEFLDTNKVVAGPKFQPLRCNLRERNWGLKVSAPLRVASIEEEQKSVDLTNGTNGVEHEKLPEFDPGAPPPFNLADIRAAIPKHCWVKDPWRSMSYVVRDVIAVFGLAAAAAYLNNWLVWPLYWAAQGTMFWALFVLGHDCGHGSFSNNSKLNSVVGHLLHSSILVPYHGWRISHRTHHQHHGHAENDESWHPLPEKLFRSLDTVTRMLRFTAPFPLLAFPVYLFSRSPGKTGSHFDPSSDLFVPNERKDVITSTACWAAMLGLLVGLGFVMGPIQLLKLYGVPYVIFVMWLDLVTYLHHHGHEDKLPWYRGKEWSYLRGGLTTLDRDYGWINNIHHDIGTHVIHHLFPQIPHYHLVEATEAAKPVFGKYYREPKKSAAPLPFHLIGEIIRSFKTDHFVSDTGDVVYYQTDSKINGSSKLE

SEQ ID NO: 3729 - protein, 453 aa, Glycine max
  Clone ID: PAT_MRT3847_16577C.1.pep
MATWVLSECSLKPLAPVIPRPRTGAVLSSTSKVGFLETNKVLEGSKFQPLRCNLRERNWGLKVSVPLRIASIEEEEQKSVDVINGSNGVEHEKLPEFDPGAPPPFNLADIRAAIPKHCWVKDPLKSMSYVVRDVIAVFGLASAAAYLNNWLVWPLYWAAQGTMFWALFVLGHDCGHGSFSNNPKLNSVVGHLLHSSILVPYHGWRISHRTHHQHHGHVENDESWHPLPEKLFRSLDTVTRMLRFTAPFPLLAYPVYLWGRSPGKTGSHFDPSSDLFVPNERKDVITSTACWAAMLGLLVGLGFVMGPIQLLKLYGVPYVIFVMWLDLVTYLHHHGHEDKLPWYRGKEWSYLRGGLTTLDRDYGLINNIHHDIGTHVIHHLFPQIPHYHLVEATEAAKPVFGKYYREPKKSSPLPFHLIGELIKSFKTDHFVSDKGDVVYYQTDSEINGSSKSE

SEQ ID NO: 3730 - protein, 375 aa, Glycine max
  Clone ID: PAT_MRT3847_16889C.1.pep
MGSKGKRKEQESIITRVMAHGGRYVQYNVYGNLFEVSSKYVPPIRPVGRGAYGIVCAAVNCDTHEEVAIKKIGNAFDNIIDAKRTLREIKLLRHMDHENIIAIRDIIRPPRKDAFNDVYIVYELMDTDLHQIIRSDQPLNDDHCQYFLYQLLRGLKYVHSANILHRDLKPSNLLLNSNCDLKIADFGLARTTSETDFMTEYVVTRWYRAPELLLNCSEYTSAIDVWSVGCIFGEIMTREPLFPGKDYVHQLRLITELLGSPDDASLGFLRSGNAKRYVRQLPQYRKQNFSARFPNMSPEALDLLEKMLIFDPNKRITVDEALCHPYLSSLHDINDEPVGPGQFNFDFEQPTCTEEHIKELIWRESVKYNPDPPSQ

SEQ ID NO: 3731 - protein, 89 aa, Glycine max
  Clone ID: PAT_MRT3847_16934C.1.pep
TRPPTRPRTRGRTRGRAGWGVMASHRSGETEDTFIADLSVGLSTGQIKTGAPCRSERLAKYNQLLRIEEELGDAAVYAGAKFRAPVEPY

SEQ ID NO: 3732 - protein, 392 aa, Glycine max
  Clone ID: PAT_MRT3847_17090C.1.pep
MEGGGAAPPADTVMSDAAPPPQQPPVAMGIENIPATLSHGGRFIQYNIFGNIFEVTAKYKPPIMPIGKGAYGIVCSVLNSETNEHVAIKKIANAFDNKIDAKRTLREIKLLRHMDHENVVAIRDIVPPPQREIFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEADLGFLNENAKRYIRQLPLYRRQSFQEKFPHVHPEAIDLVEKMLTFDPRKRITVEDALAHPYLTSLHDISDEPVCLTPFSFDFEQHALTEEQMKELIYREALAFNLEYQQ

SEQ ID NO: 3733 - protein, 485 aa, Glycine max
  Clone ID: PAT_MRT3847_17186C.1.pep
MALLVEKTSSGREYKVKDMTQADFGRLEIELAEVEMPGLMSSRTEFGPSQPFKGARITGSLHMTIQTAVLIETLTALGAEVRWCSCNIFSTQDHAAAAIARDSASVFAWKGETLQEYWWCTERALDWGPGGGPDLIVDDGGDTTLLIHEGVKAEEIFEKTGQFPDPASSDNAEFQIVLSIIRDGLKTDPKRYHKMKDRIVGVSEETTTGVKRLYQMQANGSLLFPAINVNDSVTKSKFDNLYGCRHSLPDGLMRATDVMIAGKVAVVCGYGDVGKGCASAMKQAGARVIVTEIDPICALQALMEGLQVLTLEDVVSEADIFVTTTGNKDIIMLDHMKKMKNNAIVCNIGHFDNEIDMLGLETCPGVKRINIKPQTDRWVFPDTKRGIIVLAEGRLMNLGCATGHPSFVMSCSFTNQVIAQLELWKEKGSGKYEKKVYVLPKHLDEKVASLHLGQLGARLTKLSKDQADYISVPVEGPYKPAHYRY

SEQ ID NO: 3734 - protein, 457 aa, Glycine max
  Clone ID: PAT_MRT3847_17304C.1.pep
MVSSVSWVRGKCVGKGAFGVVNVAVSKRDNRVFAVKSVDCGRGLSGQVEALENEIGILKRVTSPHVVAYIGDDVTCEGTASFRNLHLEYMPGGTVADLDRADVDERLVRRYAWCLATALRDVHAQGFVHCDVKGRNVLLSGDGEMAKLADFGAAVEIESSPAMLLFPRGSPMWMAPEVVRRERQGPESDVWSLGCTVIEIAIGKPAWEDRGVDTLSRIGYSDELPEFPIQLSELGKDFLEKCLRREPSERWSCDQLLQHPYLLPYYALVESSPRCVLDRVDSELNSESDYNDRDHQEDVFIKFTNSEEKSVIKNRISKFATESRVNWETQGWIVVREIESNGKPTTTGTETEIEEGACTCECDGVGSSKEGVNWEFHNVAGTGMEYSDSVGVNRGIGKLGGSNTAGGGGGWSCRYGCGWEKLGRNRGIFSIYSLYCKNFMLCNLIFLMYINIYYAFG

SEQ ID NO: 3735 - protein, 164 aa, Glycine max
  Clone ID: PAT_MRT3847_17306C.1.pep
MVSWVRGKCVGNGAFGVVNVAISKRDNRVFAVKSVDCGRGLSGHQVEALENEIGILKRVASPHVVAYLGDDVTCEGTASFRNLHLEYMPGGTVADLDRADVDERLVRRFAWCLVSALRDVHAQGFVHCDVKGRNVLLSGDGEIVKLADFGTAVEIESSPAEMLL

SEQ ID NO: 3736 - protein, 465 aa, Glycine max
  Clone ID: PAT_MRT3847_17614C.1.pep
MVGSIMGVVHNAYTNGSVGVQNCNGVEEKLDCLRRLIGKGDGDPLRIVSVGAGAWGSVFAALLQDTYGQFRDKIQIRIWRRAGRAVDRATAEHLFEVINSREDVLRRLIRRCAYLKYVEARLGDRTLFADEILKDGFCLNMIDTPLCPLKVVTNLQEAVWDADIVVNGLPSTETREIFEEISKYWKERITVPIIISLSKGIEAALEPVPHIITPTKMINQATRVPMENILYLGGPNIASEIYNKEYANARICGAEKWRKALAKFLRQPHFIVWDNSDLVTHEIMGGLKNVYAIGAGMVAALTNESATSKSVYFAHCTSEMIFITHLLAEEPEKLAGPLLADTYVTLLKGRNAWYGQMLAKGELSPDMGDSISGKGMIQGVSAVEAFFELLSHSSLNVLHPEENKPVAPVELCPILKTLYKILISREQSSEAILQALRDENLNDPRERIEIAQSHAFYMPSLLGQP

SEQ ID NO: 3737 - protein, 160 aa, Glycine max
  UNSURE (1)..(160): unsure at all Xaa locations
  Clone ID: PAT_MRT3847_17878C.1.pep
  unsure (1)..(160): unsure at all Xaa locations
TMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDESSRLQIFKACLRKSPISKDVDLSALARFTHGFSGADITEICQRACKYAIXEDIEKGIE

SEQ ID NO: 3738 - protein, 53 aa, Glycine max
  UNSURE (1)..(53): unsure at all Xaa locations
  Clone ID: PAT_MRT3847_18209C.1.pep
  unsure (1)..(53): unsure at all Xaa locations
YAVVVVLIICIYISPFAXSWGRQGWLVPHEIVHLAIRTAAQSIDVSVNMVFTF

SEQ ID NO: 3739 - protein, 209 aa, Glycine max
  Clone ID: PAT_MRT3847_1894C.1.pep
LEARQVAAATIFYLSSVKEFRKLIGENPDVIPALVELVKEGTTCGRKNAVVAIFGLLLLPRNHQRVIAAGAVPALLDIIASSNKDELVTESLAVLAALAENVDGAREILQGSALRLIVGMLRSATSREGKEHSASILLSLCVNVGAEVVAVLAKEPSLMPLLYSLLTDGTCHAAKKARFLIKVIQDFHETRSAGLKGSSLPQERSLHVW

SEQ ID NO: 3740 - protein, 411 aa, Glycine max
  Clone ID: PAT_MRT3847_19228C.1.pep
EDRSAPRQVNSRSSTIENSSPCRPNPTSSFSLQYLYPNPPFLNKNKKIKKNPSISWTSMTSLSTHHTYSRKQKSLGLLCTNFLSLYNKEGVRLVGLDDAASRLGVERRRIYDIVNVLESVGVLTRKAKNQYTWKGFCAIPAALQELKDEGLKENPGSFDDSNDNAKVSDDEEEEEETFPNINIGSQSEKENPDYTATVKSSKNENRREKSLALLTQNFVKLFVCSNFEMISLDEAAKLLLGNANNRTKVRRLYDIANVLSSMNLIEKTHTTNTRKPAFRWLGVRGKTWGGSVDLAQNSNVKESRKRMFGTDIGNISFKRNKVDLSMDGQNSKMQNQHENISPRAQLEKIIIKKDAKQTSESYQFGPLAPAYVPKVGTHENNSLKQVHDFENLSYHHSPQYQNQGSNVEKSI

SEQ ID NO: 3741 - protein, 429 aa, Glycine max
  Clone ID: PAT_MRT3847_19229C.1.pep
RSSTIENSSPCRPNPTSSFSLQYLYPNPPFLNKNKKIKKNPSISWTSMTSLSTHHTYSRKQKSLGLLCTNFLSLYNKEGVRLVGLDDAASRLGVERRRIYDIVNVLESVGVLTRKAKNQYTWKGFCAIPAALQELKDEGLKENPGSFDDSNDNAKVSDDEEEEEETFPNINIGSQSEKENPDYTATVKSSKNENRREKSLALLTQNFVKLFVCSNFEMISLDEAAKLLLGNANNRTKVRRLYDIANVLSSMNLIEKTHTTNTRKPAFRWLGVRGKTWGGSVDLAQNSNVKESRKRMFGTDIGNISFKRNKVDFLFMNPIQKINYRIYKINTKNISPRAQLEKIIIKKDAKQTSESYQFGPFAPAYVPKVGTSENNSVKKVHDWDSLAQEHRPQYQNQGVTPLKDLFSHYMEAWKSWYSEAAGKKSTKTL

SEQ ID NO: 3742 - protein, 580 aa, Glycine max
  Clone ID: PAT_MRT3847_19587C.1.pep
MEGGGVEVDASAFRECLSLSWKNPYVLRLAFSAGIGGLLFGYDTGVISGAILYIRDDFKAVDRKTWLQEAIVSMALAGAIVGAAVGGWINDRFGRRKAILLADTLFFIGSAVMAAATNPSILIVGRVFVGLGVGMASMASPLYISEASPTRVRGALVSLNGFLITGGQFLSYLINLAFTKAPGTWRWMLGAAVVPALIQIVLMMMLPESPRWLFRKGREEEGKEILRKIYPPQEVEAEINTLRESVEIEIKEAEATDNISIVKMLKTKTVRRGLYAGMGLQIFQQFVGINTVMYYSPTIVQLAGFASNRTALLLSLVTSGLNAFGSILSIYFIDRTGRKKLVLFSLCGVVFSLVVLTVVFHQSTTHSPMVSALETSHFNNTCPDYHSAANPGGWDCMKCLKASPNCGFCASGANKLLPGACLISNDTTKDQCHEEDRLWYTVGCPSKFGWLAIVGLALYIIFFSPGMGTVPWVVNSEIYPLRYRGICGGMASTSNWVSNLIVAQSFLSLTQAIGTSWTFMIFIFITIAAIIFVIIFVPETKGLPMEEVEKMLEGRDLNFKFWQRSSHCGEEVPPQKTQSN

SEQ ID NO: 3743 - protein, 416 aa, Glycine max
  Clone ID: PAT_MRT3847_19765C.1.pep
LCRIRPTRPPFHFNSFSRDRLLFLLCSSLSHSSFPSPLRSPNFPQTFSLRRFAAAPLARPPPPPPPLDAMAQKIGKSTRRPGASSKARVYADVNVVRPKEYWDYESLNVQWGEQDDYEVVRKVGRGKYSEVFEGVHCTDGEKCVIKILKPVKKKKIKREIKILQNLCGGPNIVQLLDIVRDQQSKTPSLIFEYVNNTDFKVLYPTLSDYEIRYYIYELLKALDYCHSQGIMHRDVKPHNVMIDHEQRKLRLIDWGLAEFYHPGKEYNVRVASRYFKGPELLVDLQDYDYSLDLWSLGCMFAGMIFRKEPFFYGHDNYDQLVKIAKVLGTDGLSAYLDKYRIELDPHLAALIGRHSRKPWAKFINVENHHMAVPEAVDFVDKLLRYDHQERPTAKEAMAHPYFNPVRNAESSRTRAH

SEQ ID NO: 3744 - protein, 103 aa, Glycine max
  Clone ID: PAT_MRT3847_20044C.1.pep
MSGGGCSSIVWFRRDLRIEDNPALTAGVRAGAVVAVFIWAPEEEGQYYPGRVSRWWLKNSLAHLDSSLRNLGTPLITKRSTDTLSSLFEVVKSTGATQLFFNH

SEQ ID NO: 3745 - protein, 307 aa, Glycine max
  UNSURE (1)..(307): unsure at all Xaa locations
  Clone ID: PAT_MRT3847_20045C.1.pep
  unsure (1)..(307): unsure at all Xaa locations
MSGGGCSSIVWFRRDLRIEDNPALTAGVRAGAVVAVFIWAPEEEGQYYPGRVSRWWLKNSLAHLDSSLRNLGTPLITKRSTDTLSSLFEVVKSTGATQLFFNHLYDPLSLVRDHRAKEVLTAQGITVRSFNADLLYEPWDVNDAHGRPFTTFAAFWERCLSMPYDPESPLLPPKRIIPGDASRCPSDTLLFEDELEKASNALLARAWSPGWSNANKALTTFINGPLIEYSKNRRKADSATTSLLSPHLHFGELSVKKVFHLVRIKQVLWANEGNKAXGEESVNLFLKSIGLREYSRYISFNPPYTHE

SEQ ID NO: 3746 - protein, 136 aa, Glycine max
  UNSURE (1)..(136): unsure at all Xaa locations
  Clone ID: PAT_MRT3847_20986C.1.pep
  unsure (1)..(136): unsure at all Xaa locations
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGRSGGYXGGGGYCGGGG

SEQ ID NO: 3747 - protein, 362 aa, Glycine max
  Clone ID: PAT_MRT3847_21549C.1.pep
MEVMCGAKVGNMVHKAKPYVLTVGLQFGMAGTYLFTMASLNHGMSRLVFIVYRNAIAALALAPFALIFERKVRPKMTWTVFIQILVLGFLEPVVDQGFTFLGMQYTSASFASAVMNAVPSVTFVLAVIFRLEHIKIRELRSQAKVIGTLVTFAGALLMTLYKGPQFDLFHHSNTTHQQGGSHTQNHSHWVAGTLFICLGCLAWSSFYILQSITVKRYPAELSLSSLICLAGALQSAVVALIADHNPRAWAIGFDYSLYGPLYTGIMSSGIAYYIQGLVMQSRGPVFVTSFNPLCMIIVTALGSFLLGEHLYLGSIIGGIIIAVGLYSVVWGKGKDYKDDTSSPATTKETETMQLPITLPNNK

SEQ ID NO: 3748 - protein, 59 aa, Glycine max
  UNSURE (1)..(59): unsure at all Xaa locations
  Clone ID: PAT_MRT3847_21599C.1.pep
  unsure (1)..(59): unsure at all Xaa locations
NSSDLRGGEITTMTNQKRXEKAKSKYWRGDTLNNWDSSQEQRKYMYIYAIGLLVLESXA

SEQ ID NO: 3749 - protein, 484 aa, Glycine max
  Clone ID: PAT_MRT3847_22087C.1.pep
MSTQNRRSSFSSSTTSSLAKRHASASTTSSSAAAPTNMAKKRPPLSNLTNTVAHRNSSSSVPCAAKFAKTKKEVVPACSGNKRPTLANVKPASAVIFPKANSFPVRDEAPPTPPPPVATVTVPAPVVDVSPSKSDTMSVSMDESMSSCDSFKSPDIEYVDNIDVAAVDSIERKTFSNLNISDSTEGNICSRDILVELEKGDKFVNVDNNYADPQLCATFACDIYKHLRASEAKKRPSTDFMEKIQKEINSSMRAILIDWLVEVAEEYRLVPDTLYLTVNYIDRYLSGNVMNRQRLQLLGVASMMIASKYEEICAPQVEEFCYITDNTYFKEEVLQMESAVLNFLKFEMTAPTVKCFLRRFVRAAQGVDEVPSLQLECLTNYIAELSLMEYSMLGYAPSLVAASAIFLAKFILFPSKKPWNSTLQHYTLYQPSDLCVCVKDLHRLCCNSPNSNLPAIREKYSQHKYKYVAKKYCPPSIPPEFFQN

SEQ ID NO: 3750 - protein, 483 aa, Glycine max
  Clone ID: PAT_MRT3847_22149C.1.pep
MVVDALNEDLRINGAVEPLPEDFDATAVIIDPVPLAVVDNGIVKEEAQIIKGKEKREIVLGRNIHTSCLEVTEPEADDEVTGDREAHMASVLARYKRALTERTKHHLGYPYNLDFDYGALTQLQHFSINNLGDPFIESNYGVHSRQFEVGVLDWFARLWELEKNEYWGYITNCGTEGNLHGILVGREVFPDGILYASRESHYSVFKAARMYRMECEKVDTLWSGEIDCDDFKAKLLSHQDKPAIINVNIGTTVKGAVDDLDLVIKKLEEAGFSHDRFYIHCDGALFGLMMPFVKRAPKVTFKKPVGSVSVSGHKFVGCPMPCGVQITRLEYVNALARDVEYLASRDATIMGSRNGHAPIFLWYTLNRKGYRGFQKEVQKCLRNAHYFKGRLVEAGIGAMLNELSSTVVFERPHDEEFIRKWQLACKGNIAHVVVMPNITIEKLDDFLNELLEKRATWFQDGKDQPYCISSDVGEKNCLCALHK

SEQ ID NO: 3751 - protein, 333 aa, Glycine max
  Clone ID: PAT_MRT3847_2249C.1.pep
MVVLSQPALNQFFLLKTCKPTPLFAGIPVVDLTDPDAKTHIVNACRDFGFFKLVNHGVPLQFMANLENETLGFFKKPQSEKDRAGPPDPFGYGSKRIGPNGDVGWVEYLLLNTNPDVISPKSQFIFREGPQNFRAVVEEYIRAVKNMCYEVLELMAEGLGITQRNVLSRLLKDEKSDSCFRLNHYPPCPEVQALNGRNLVGFGEHTDPQIISVLRSNSTSGLQICLTDGTWVSVPPDQTSFFINVGDTLQVMTNGRFKSVKHRVLADPTKSRLSMIYFGGPPLCEKIAPLPSLMLKGEESFYKEFTWWEYKKAAYASRLADNRLGPFEKSAAD

SEQ ID NO: 3752 - protein, 317 aa, Glycine max
  Clone ID: PAT_MRT3847_22514C.1.pep
HDLFQWATKRARREEMSVEQKAAGKEEEGKLQKGIAEFYDESSGIWENIWGDHMHHGFYDPDSTVSVSDHRAAQIRMIQESLRFASLLSENPSKWPKSIVDVGCGIGGSSRYLAKKFGATSVGITLSPVQAQRANSLAAAQGLADKVSFEVADALKQPFPDGQFDLVWSMESGEHMPDKAKFVGELARVAAPGATIIIVTWCHRDLGPDEQSLHPWEQDLLKKICDAYYLPAWCSTSDYVKLLQSLSLQDIKSEDWSRFVAPFWPAVIRSAFTWKGLTSLLSSGQKTIKGALAMPLMIEGYKKDLIKFAIITCRKPE

SEQ ID NO: 3753 - protein, 350 aa, Glycine max
  Clone ID: PAT_MRT3847_22518C.1.pep
MATVVRIPTISCIHIHTFRSQSPRTFARIRVGPRSWAPIRASAASSERGEIVLEQKPKKDDKKKLQKGIAEFYDESSGLWENIWGDHMHHGFYDSDSTVSLSDHRPAQIRMIQESLRFASVSEERSKWPKSIVDVGCGIGGSSRYLAKKFGATSVGITLSPVQAQRANALAAAQGLADKVSFQVADALQQPFSDGQFDLVWSMESGEHMPDKAKFVGELARVAAPGATIIIVTWCHRDLGPDEQSLHPWEQDLLKKICDAYYLPAWCSTSDYVKLLQSLSLQDIKSEDWSRFVAPFWPAVIRSAFTWKGLTSLLSSGQKTIKGALAMPLMIEGYKKDLIKFAIITCRKPE

SEQ ID NO: 3754 - protein, 56 aa, Glycine max
  Clone ID: PAT_MRT3847_22786C.1.pep
VSHREARVRQAEGRVGTGLSWRERPGLGDKRGVGFAQKRGPARPEHAIGVGGRWVD

SEQ ID NO: 3755 - protein, 209 aa, Glycine max
  Clone ID: PAT_MRT3847_23153C.1.pep
MTQRDRRTLSFPAVHPCEAISPPTLVTSLITLSQSICNFQPQSFPTQRRNARETIRQISIVLMFLQEIRLIPNSTILSLAELHFTLQKIHFLLQDCTLQGSRLLLLAKSQHVASLFPALLRSVATSLDVLPLHQLHLCPEVRELADLVTKQASKAKFQLDPSDARATKTLHTLLRQFSMGTEPDLTSMQGILHYLQIRTWTDCNTEIKF

SEQ ID NO: 3756 - protein, 589 aa, Glycine max
  Clone ID: PAT_MRT3847_23468C.1.pep
MESATQVGAAAQPSSASASVIPSAFDGTLGRHLARRLAETGVRDVFSVPGDFNLTLLDHLIAEPSLNLVGCCNELNAGYAADGYARAKGVGACVVTFTVGGLSVLNAIAGAYSENLPVICIVGGPNSNDYGTNRILHHTIGLPDFTQELRCFQAITCFQAVVNNLDDAHELIDTAISTALKESKPVYISISCNLPGIPHPTFARDPVPFFLAPKVSNQEGLEAAVEATAALLNNAVKPVIVGGPKLRVAKAQKAFLEFAEASGYPIAVMPSGKGLVPEHHPHFIGTYWGAVSSSFCGEIVESADAYVFVGPIFNDYSSVGYSLLIKKEKAIIVQPNRVTIGNGPSLGWVFMADFLTALAKKVKTNTAAVENYRRIYVPPGIPLRREKDEPLRVNVLFKHIQELLSGDTAVIAETGDSWFNCQKLHLPENCGYEFQMQYGSIGWSVGATLGYAQAATDKRVIACIGDGSFQVTAQDISTMIRCGQKTIIFLINNGGYTIEVEIHDGPYNVIKNWDYTRFVDAIHNGQGKCWTAKVRTEDDLTEAIAKATGPQKDSLCFIEVFVHKDDTSKELLEWGSRVAAANSRPPNPQ

SEQ ID NO: 3757 - protein, 80 aa, Glycine max
  Clone ID: PAT_MRT3847_23929C.1.pep
VKQLNDLLTEKNKDTGWDVPIHVDAAIGGFIAPFLYPELEWDFRLPLVKSINVSGHKYGLVYPGVGWVIWRSKDDLPEEL

SEQ ID NO: 3758 - protein, 64 aa, Glycine max
  Clone ID: PAT_MRT3847_24039C.1.pep
APPIYNPALNPLMARPLIWPAAPAQAWYPQQAAYPQQSAVSVPPIVAGLHHNSHYSQFRMCLLL

SEQ ID NO: 3759 - protein, 251 aa, Glycine max
  Clone ID: PAT_MRT3847_24409C.1.pep
MYGRSDSYESDLALLDSIRRHLLGESELIFGAPNFGSGRSSSFSSLDSCLSDDWGELPFKEDDSEDMVLYGVLRDAVNVGWVPSLDAGSPESVSSGFPAVKLEPDVMPALINPCPPPAPAVEEKKVVPPKGKHYRGVRQRPWGKFAAEIRDPAKNGARVWLGTFETAEDAALAYDRAAYRMRGSRALLNFPLRVNSGEPDPVRVKSKRSSSPESTAALPAKRKKVVVVGTVQEQVGSQVAECTRGEQLLVS

SEQ ID NO: 3760 - protein, 197 aa, Glycine max
  Clone ID: PAT_MRT3847_247C.1.pep
AIYTFISMWFVGGLTAFHLYLISTNQTTYENFRYRYDRRANPYNTGVFNNFLEIFCTSIPQSKNNFRAKVPMEPVLPARSVGGGFMSPSMGKAVDDIEMGRKTVWADMGTALDPSEGQLNDRVAVKDGEFGELSPEIRTTVDETSHRAGMHPRRSSWGRKSGSWEMSPEVLALAAKVGESNRMGGGSSSLTTENRHT

SEQ ID NO: 3761 - protein, 401 aa, Glycine max
  Clone ID: PAT_MRT3847_25106C.1.pep
EPPSRFFPLLCFFTGQSVLHSHSLIAKSRRKEKKDEVERRWEWQREDYKEMGRWVNCRGNIFPFLGMVMAMLAQSGSMVVIKVAMTDGINKYVMVVYSLALSTILLLPFALFLHRSERPPLTFSALCSFFLLAFFGSSGQIMAYVGIDLSSPTLASAMLNLIPAFTFILALIFRMEEVHWRHSSSQAKFLGTIVSIAGAFVVILYKGPPIFKTHSSNSSNKFLFSQQLNWILGGMFCAGDSIVCSLWYIYQASVAYKYPAVTTIVFFQLLFSTIQCGVFALIVVQDQTEWELKLDIGLIGIVYQAIAATLIRYILCTWCVLKAGPLFCSMFKPVAIIFSVFMGAIFLGDDLSLGSLIGAVIIVIGFYAVLWGKSIEDNKIEKGVENLESSCHNVPLLQNRT

SEQ ID NO: 3762 - protein, 92 aa, Glycine max
  Clone ID: PAT_MRT3847_25202C.1.pep
KMLEKFHLVGIPPAPRGLPQIEVTFDIHANGIVTVSPKDKSTGKEQQITIRSSGGLSDDEIEKMVKEAELHAQKDQERKALIDIINSADTTI

SEQ ID NO: 3763 - protein, 175 aa, Glycine max
  Clone ID: PAT_MRT3847_25688C.1.pep
MLTVLLLFSLLLTTSTSHNIISYPHFQQLNVKQILTETKLNPTNTYKHLQHQKLNIATEASSPAKYKLKLVHRDKVPTFNTSHDHRTRFNARMQRDTKRVAALRRHLAAGKPTYAAEAFGSDVVSGMEQGSGEYFVRIGVGSPPRNQYVVMDSGSDIIWVQCEPCTQCFHQSDPV

SEQ ID NO: 3764 - protein, 194 aa, Glycine max
  UNSURE (1)..(194): unsure at all Xaa locations
  Clone ID: PAT_MRT3847_25700C.1.pep
  unsure (1)..(194): unsure at all Xaa locations
MATWVNGWGKLLPFLGMLMAMLTQSGSMVVIKFAMTDGMNKYVMVVYSMALSSSILLPFVLFLHRSELPLLTVPALGSFFLLALFASSAHIMAYVGIELSSPTLASAILNVIPAFTFVLALIFRMEEVHWRYFSSQAKVLGTIVSIGGAFVVILYKGPPIFRTHSSYTSNKLXFSGHPNWILGGIFLVADSFLS

SEQ ID NO: 3765 - protein, 461 aa, Glycine max
  Clone ID: PAT_MRT3847_25891C.1.pep
MGEEEIDDSPLIQGFPSGDVPFRRTGNVERAVAHIITGVIGAGVLSLAWSVAQLGWIAGPFIIIVFAGTTFLSANLLSDCYRFPHPLYGNIRCPSYIDAVKVYLGDSRQKVCGVLVHASLYGATTAYVITSATSIRAILKSNCYHKEGHQAPCKYGDAVYMMLFGLVQIIMSFIPDLHNMAWVSIVAAIMSFTYSSIGLGLGITTVIENGRIMGSLTGVPASNIADKLWLVFQGIGDIAFAYPYTVILLEIQDTLESPPPENKTMKKASMIAILITTFFYLCCGCFGYAAFGNQTPGNLLTGFGFYEPYWLIDFANACIVLHLVGGYQIYSQPIYGAVDRWCSKRYPNSGFVNNFYQLKLPRLPAFQLNMFRICFRTAYVVSTTGLAILFPYFNQVIGVLGALGFWPLAIYFPVEMYFVQRKVEAWSRKWIVLRTFSFICFLVSLLGLIGSLEGIISEKLS

SEQ ID NO: 3766 - protein, 461 aa, Glycine max
  Clone ID: PAT_MRT3847_26125C.1.pep
MDGKNSLQITRSGIGAYDDDGHAKRTGNLQSAVAHIITAVIGSGVLSLAWSTSQLGWIGGPFSLLCCAIVTYISSFLLSDCYRTPDPVTGKRNYSYMDAVRVYLGYKRTCVAGFLQFLTLYGTSIAYVLTTATSLSAILRSNCYHKKGHEAPCKYGGNLYMALFGLVQIVMSFIPDLHNMAWVSVVAALMSFTYSFIGLGLGIATVIKNGRIMGSLTGIPTDKIADKFWLVFQALGDIAFAYPYSILLLEIQDTLESPPPENQTMKKASMIAIFITTFFYLCCGCFGYAAFGNDTPGNLLTGFGFFEPFWLIDLANACIILHLVGGYQIYSQPIYSTVDRWASRKFPNSGFVNNFYRVKLPLLPGFQLNLFRFCFRTTYVISTIGLAIFFPYFNQILGVLGAINFWPLAIYFPVEMYFVQQKIAAWSSKWIVLRTFSFACFLVTVMGLVGSLEGIVSAKLK

SEQ ID NO: 3767 - protein, 461 aa, Glycine max
  Clone ID: PAT_MRT3847_26127C.1.pep
MDGKKSLQITRSGTGAYDDDGHAKRTGNLQSAVAHIITAVIGSGVLSLAWSTSQLGWIGGPVALLCCAIVTYISSFLLSDCYRTPDPVTGKRNYSYMDAVRVYLGYKRTCVAGFLQFLTLYGTSIAYVLTTATSLSAILRSNCYHKKGHEAPCKYGGNLYMALFGLVQIVMSFIPDLHNMAWVSVVAALMSFTYSFIGLGLGIATVIKNGRIMGSLTGIPTDKIADKFWLVFQALGDIAFAYPYSILLLEIQDTLESPPPENQTMKKASMVAIFITTFFYLCCGCFGYAAFGNDTPGNLLTGFGFFEPFWLIDLANACIILHLVGGYQIYSQPIYSTVDRWASRKFPNSGFVNNFYKVKLPLLPGFQLNLFRFCFRTTYVISTTGLAIFFPYFNQILGVLGAINFWPLAIYFPVEMYFVQNKIAAWSSKWIVLRTFSFACFLVTGMGLVGSLEGIVSAKLK

SEQ ID NO: 3768 - protein, 215 aa, Glycine max
  Clone ID: PAT_MRT3847_26404C.1.pep
MPGKIPIELGNLISLALLNMAYNYFEGKIPIEIGSLQKLQYFYVAKNNLTGEVPPSIGNLSSLIELSVGLNNLEGKIPQEVCSLKNLSLMSVPVNKLSGTIPSEVFSLSSLTNLLDLSQNSLSGSLPNVVSKLKNLEKMDVSENHLSGDIPGSIGDCTSLEYLYLQGNSFHGIIPTTMASLKGLRRLDMSRNHLSGSIPKGLQNISFLAYFNASF

SEQ ID NO: 3769 - protein, 326 aa, Glycine max
  Clone ID: PAT_MRT3847_26633C.1.pep
MERSGGMVTGSHERNELVRVRHGSDSGSKPLKNLNGQICQICGDTIGLTATGDLFVACHECGFPLCHSCYEYELKNVSQSCPQCKTTFTSRQEGAEVEGDDDDEDDADDLDNGINYGQGNNSKSGMLWEEDADLSSSSGHDSHIPNPHLVNGQPMSGEFPCATSDAQSMQTTSDPMGQSEKVHSLPYADPKQPGPESDEEIRRVPEIGGESAGTSASRPDAGSNAGTERAQGTGDSQKKRGRSPADKESKRLKRLLRNRVSAQQARERKKAYLIDLETRVKDLEKKNSELKERLSTLQNENQMLRQILKNTTASRRGSNSGTNNAV

SEQ ID NO: 3770 - protein, 321 aa, Glycine max
  Clone ID: PAT_MRT3847_26634C.1.pep
MERSGGMVTGSHERNELVRVRHGSDSRSKPLKNLNGQSCQICGDTIGLTATGDVFVACHECGFPLCHSCYEYELKHMSQSCPQCKTAFTSHQEGAEVEGDDDDEDDADDLDNEINYGQGNSSKAGMLWEEDADLSSSSGHDSQIPNPHLANGQPMSGEFPCATSDAQSMQTTSIGQSEKVHSLSYADPKQPGPESDEEIRRVPEIGGESAGTSASQPDAGSNAGTERVQGTGEGQKKRGRSPADKESKRLKRLLRNRVSAQQARERKKAYLIDLETRVKDLEKKNSELKERLSTLQNENQMLRQVHSCYHCHHHNVIYTCL

SEQ ID NO: 3771 - protein, 127 aa, Glycine max
  UNSURE (1)..(127): unsure at all Xaa locations
  Clone ID: PAT_MRT3847_26863C.1.pep
  unsure (1)..(127): unsure at all Xaa locations
PLHHAAAPLARIAGAAVAGRVQAEGGPPXRASSGRLRSHHRTALPDPPPPRALHAGEHPGHEDHPRSTPPVVVLSRPLLCHTGPPRASKAAIDDAPGGGACAYVSDEPAGPTGAPNYRGRVSVPRIQ

SEQ ID NO: 3772 - protein, 67 aa, Glycine max
  Clone ID: PAT_MRT3847_27175C.1.pep
KSEAVLSYVCDGILKLLDTRLVPSAASGDSKVFYLKMKGDYHRYLAELKTGADRKEGVVITLSDLQS

SEQ ID NO: 3773 - protein, 115 aa, Glycine max
  Clone ID: PAT_MRT3847_27189C.1.pep
IFYSLGMALSKDISDVKGDKAYGIDTLAIRLGQKWVFWICIILFEMAFGVALLAGATSSYLWIKIVTGLGHAILASILLYQAKSIYLSNKVSTISFYMLIWKLLYAAYFLMALIR

SEQ ID NO: 3774 - protein, 62 aa, Glycine max
  Clone ID: PAT_MRT3847_27885C.1.pep
APPAPPPHEPSLPPRVNKESSCLLRGQTPLGVKIGGQNFLGFFYLGPQPQNMVFQMPRSSPP

SEQ ID NO: 3775 - protein, 371 aa, Glycine max
  Clone ID: PAT_MRT3847_28411C.1.pep
MATPVEPPNGIRTEGKHYYSMWQTLFEIDSKYVPIKPIGRGAYGIVCSSVNREINEKVAIKKIQNAFENRVDALRTLRELKLLRHLHHENVIALKDIMMPVHRNSFKDVYLVYELMDTDLHQIIKSSQALSNDHCQYFLFQLLRGLKYLHSANILHRDLKPGNLLINANCDLKICDFGLARTNCSKNQFMTEYVVTRWYRAPELLLCCDNYGTSIDVWSVGCIFAELLGRKPIFPGSECLNQLKLIINILGSQREEDIEFIDNPKAKKYIKSLPYSPGTPLSQLYPNAHPLAIDLLAKMLVFDPTKRISVTQALQHPYMAPLYDPNCDPPAVIPIDLDIDEDLGEEMIRDMMWKEMLHYHPESAMESAGLC

SEQ ID NO: 3776 - protein, 122 aa, Glycine max
  UNSURE (1)..(122): unsure at all Xaa locations
  Clone ID: PAT_MRT3847_28504C.1.pep
  unsure (1)..(122): unsure at all Xaa locations
NMKLAEDVDLEKIAKDTHGYVGADLAALCTEAALQCIREKMDVIDLEDETIDAEILNSMAVTNEHFQTALGSSNPSALRETVVEVPNVSWEDIGGXENVKRELQETVQYPVEHPEKFENLEC

SEQ ID NO: 3777 - protein, 702 aa, Glycine max
  Clone ID: PAT_MRT3847_29389C.1.pep
MAETETFAFQAEINQLLSLIINTFYSNKEIFLRELISNASDALDKIRFESLTDKSKLDAQPELFIHIIPDKTNNSLTIVDSGIGMTKADLVNNLGTIARSGTKEFMEALAAGADVSMIGQFGVGFYSAYLVAEKVIVTSKHNDDEQYVWESQAGGSFTVTRDTSGEVLGRGTKITLFLKEDQLEYLEERRLKDLIKKHSEFISYPISLWVEKTTEKEISDDEDEEEKKDEEGKVEDVDEEKEKEEKKKKKIKEVSHEWSLVNKQKPIWMRKPEEITKEEYSAFYKSLTNDWEEHLAVKHFSVEGQLEFKAILFVPKRAPFDLFDTRKKPNNIKLYVRRVFIMDNCEELIPEYLGFVKGIVDSEDLPLNISREMLQQNKILKVIRKNLVKKCLELFFEIAENKEDYNKFYEAFSKNLKLGIHEDSQNKGKIAELLRYHSTKSGDELTSLKDYVTRMKEGQSDIYYITGESKKAVENSPFLEKLKKKGYEVLFMVDAIDEYAVGQLKEFEGKKLVSATKEGLKLDESEDEKKKQEELKEKFDNLCKVIKDVLGDKVEKVVVSDRVVDSPCCLVTGEYGWTANMERIMKAQALRDNSMAGYMSSKKTMEINPENPIMEELRKRADADKNDKSVKDLVLLLFETALLTSGFSLDEPNTFGNRIHRMLKLGLSIDEDAAEADADADMPPLEEEAEADAEGSKMEEVD

SEQ ID NO: 3778 - protein, 699 aa, Glycine max
  Clone ID: PAT_MRT3847_29390C.1.pep
MAETETFAFQAEINQLLSLIINTFYSNKEIFLRELISNASDALDKIRFESLTDKSKLDAQPELFIHIIPDKTNNTLTIVDSGIGMTKADLVNNLGTIARSGTKEFMEALAAGADVSMIGQFGVGFYSAYLVAEKVIVTTKHNDDEQYVWESQAGGSFTVTRDNTGEVLGRGTKITLYLKEDQLEYLEERRLKDLIKKHSEFISYPISLWIEKTTEKEISDDEDEEEKKDEEGKVEDVDEEKEKEEKKKKKIKEVSHEWSLVNKQKPIWMRKPEEITKEEYSAFYKSLTNDWEEHLAVKHFSVEGQLEFKAILFVPKRAPFDLFDTRKKPNNIKLYVRRVFIMDNCEELIPEYLGFVKGIVDSEDLPLNISREMLQQNKILKVIRKNLVKKCLELFFEIAENKEDYNKFYEAFSKNLKLGIHEDSQNKGKIAELLRYHSTKSGDEMTSLKDYVTRMKEGQSDIYYITGESKKAVENSPFLEKLKKKGYEVLYMVDAIDEYAVGQLKEFEGKKLVSATKEGLKLDESEDEKKKQEELKEKFDNLCKVIKDVLGDKVEKVVVSDRVVDSPCCLVTGEYGWTANMERIMKAQALRDNSMAGYMSSKKTMEINPENPIMEELRKRADADKNDKSVKDLVLLLFETALLTSGFSLDEPNTFGNRIHRMLKLGLSIDEDAGEADAEMPPLEEAEADAEGSKMEEVD

SEQ ID NO: 3779 - protein, 107 aa, Glycine max
  Clone ID: PAT_MRT3847_29691C.1.pep
ASYKNQYYYHGLIVNDYGNLEKKTDKYGNPVHAARVTYVSTITADGGYNDDINKQHDSTTAYGVYTGRQHSSVGSDGDTDKYYGTTGGYNDDSNLRHETTGVYSLHT

SEQ ID NO: 3780 - protein, 555 aa, Glycine max
  Clone ID: PAT_MRT3847_30033C.1.pep
LSTRPPTRPPTRPVHWFEKFNWFISSENYLVISGRDAQQNEMIVKRYMSKGDLYIHADLHGASSTVIKNHKPAQPVPPLTLNQAGCFTVCHSQAWDSKIVTSAWWVYPHQVSKTAPTGEYLTVGSFMIRGKKNFLPPHPLIMGFGLLFRLDESSLGSHLNERRVRGEEEAADDYEETGPLEDKSDSESEKDVTDIEPATDLERNGNLSADSHKPLPEDFPADPSQTSLATTDAETAISQDFPAKETSTLNMVDREILSGAGGNGLASVTPQLEELLDQVLELGPIAKSNKKYGIEKSQIDLDTEQYLEQSKTAVRDKPYISKAERRKLKKEQKHGEEDLNVEHGKYESKLKDISANLQAKEDQNLKKGGGQKISRGQKGKLKKIKEKYADQDEEERSIRMALLASSGKSIKKEETSSENDTLDQGKKPGSGPSDAPKVPSDAPKICYKCKKAGRTYLGIVRSNQMVFCIGMQLVKLKKIPNRLLLTLPKQIGWQWKKMILMTTWVDASSTTLVLFCASDLERNNNGEVYKLSPASVSTSLCSKLFFNNPSFDLCK

SEQ ID NO: 3781 - protein, 205 aa, Glycine max
  Clone ID: PAT_MRT3847_30133C.1.pep
MTRKRIQIKKIDNISSRQVTFSKRRKGLFKKAQELSTLCDADIALIVFSATSKLFEYASSSMHQVIERRDSHSAMNRLDRPSIELQIENDSNEILRKKVEDKNRELRQMNGEDLQGLTLQELHKLEEHLKRGLINVSKVKDEKLMQEISTLKRKGVELMEENQRLKQVVPSLIHVHRQSSESILSNSSNLPEDGGSDTSLKLGLP

SEQ ID NO: 3782 - protein, 206 aa, Glycine max
  Clone ID: PAT_MRT3847_30135C.1.pep
MTRKRIQIKKIDNISSRQVTFSKRRKGLFKKAQELSTLCDADIALIVFSATSKLFEYASSSMHQVIERHDRYSAIHRLDRPSIELQIESDSNNILRKKVEDKTRELRQMNGEDLQGLTLQELQKLEEHLKRSLTNVSKVKDAKFMQEISTFKRKGVELMEENQRLKQVPSLIHAHSYRQSSESILSNSSNLPEDGGSNTSLKLGLP

SEQ ID NO: 3783 - protein, 84 aa, Glycine max
  UNSURE (1)..(84): unsure at all Xaa locations
  Clone ID: PAT_MRT3847_30144C.1.pep
  unsure (1)..(84): unsure at all Xaa locations
TGPTRGPTGGLGYAGTGGPVYVPKGGPGYLTGTGYGVNTGGAHTAAGYSKELRQHDPSHGDQNEKKGXIMANIKDKLPVGPSYK

SEQ ID NO: 3784 - protein, 135 aa, Glycine max
  UNSURE (1)..(135): unsure at all Xaa locations
  Clone ID: PAT_MRT3847_30158C.1.pep
  unsure (1)..(135): unsure at all Xaa locations
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATIASGGVMPNXHQHXLPKKAGSSKASHADDDDN

SEQ ID NO: 3785 - protein, 78 aa, Glycine max
  UNSURE (1)..(78): unsure at all Xaa locations
  Clone ID: PAT_MRT3847_3026C.1.pep
  unsure (1)..(78): unsure at all Xaa locations
NDEELTVEERNLLSVAYKNVIGARRASWRIISSIEQKEESRGGXDHVFVIRDYRSKIEYELFYLCYGVLKLLGTGVIA

SEQ ID NO: 3786 - protein, 339 aa, Glycine max
  Clone ID: PAT_MRT3847_30912C.1.pep
PFCKKFSIEPRAPEFYFSQKIDYLKDKVQPSFVKERRAMKREYEEFKVRVNALVAKAQKTPDEGWTMQDGTSWPGNNSRDHPGMIQVFLGHSGAHDIEGNELPRLVYVSREKRPGYQHHKKAGAENALVRVSAVLTNAPFILNLDCDHYVNNSKAVREAMCFLMDPVVGRDLCYVQFPQRFDGIDRSDRYANRNTVFFDVNMKGLDGIQGPMYVGTGCVFNRQALYGYSPPSMPKLPKSSSCCCCPSKKQTKDVSELYRDAKREELDAAIFNLREIDNYDEYERSMLISQMSFEKTFGLSTVFIESTLMENGGLPESADPSMLIKEAIHVSSPIYDMPR

SEQ ID NO: 3787 - protein, 86 aa, Glycine max
  Clone ID: PAT_MRT3847_3128C.1.pep
LSNLKSLFFFPYYLKCLFASKLKHFINYTRGLKSIILRQHRKTNQNQRWGLGCLPLLSRSSYLLKKQMYVPSFKFIITNQQSRVFT

SEQ ID NO: 3788 - protein, 56 aa, Glycine max
  Clone ID: PAT_MRT3847_31418C.1.pep
FNTVHTSTPQVSGAAKLEKNIQFQGPPWGGKKNDMQKPKGALMKLHIQNPKGKAPL

SEQ ID NO: 3789 - protein, 88 aa, Glycine max
  Clone ID: PAT_MRT3847_3144C.1.pep
FPGRPTRPSCSSGACLRLPPRWQPDCLLLVDVVINSIITEPCYVNITSSSAHKSYNPISLFFSSHVKLPNCSMVQNSVLQYIINYRLY

SEQ ID NO: 3790 - protein, 100 aa, Glycine max
  Clone ID: PAT_MRT3847_32234C.1.pep
DDQGPKVDEYGNDDNQTDEYSNRARADSVTYVATTTAAGGYRDDINKQHDTTNAYSEHTGRQHSSGGSDSDTNKHEGTTDGCNDDTNKHNRTGSVYGIDA

SEQ ID NO: 3791 - protein, 225 aa, Glycine max
  UNSURE (1)..(225): unsure at all Xaa locations
  Clone ID: PAT_MRT3847_32783C.1.pep
  unsure (1)..(225): unsure at all Xaa locations
EAYDVXXIKFRXXXAVTNFDISXYXXXXIXXSSNLLXGELARRKKDNDPRNKDIDYNKSVVTSVNNEETVQVQAGNNNNENDSEWKMVLFNHPSQQQQAKGNGSDQKIMNCGNYRNSAFSMALQDLIGIDSVGSGQHNMLDESSKIGTHFSNTSSLVTSLSSSREASPEKRGPSLLFPMPPMETKIVNPIGTSVTSWLPSPTVQMRPSPAISLSHLPVFASWTDT

SEQ ID NO: 3792 - protein, 134 aa, Glycine max
  Clone ID: PAT_MRT3847_33044C.1.pep
MSGKGAKGLITGKTSAANKDKDKKKPISRSSRAGLQFPVGRIHRLLKSRTTANGRVGATAAVYSAAILEYLTAEVLELAGNASKDLKVKRITPRHLQLAIRGDEELDTLIKGTIAGGGVIPHIHKSLINKSSKE

SEQ ID NO: 3793 - protein, 135 aa, Glycine max
  Clone ID: PAT_MRT3847_33047C.1.pep
MSGKGAKGLITGKTSAANNKDKDKKKPISRSSRAGLQFPVGRIHRLLKSRTTANGRVGATAAVYSAAILEYLTAEVLELAGNASKDLKVKRITPRHLQLAIRGDEELDTLIKGTIAGGGVIPHIHKSLINKSSKE

SEQ ID NO: 3794 - protein, 619 aa, Glycine max
  Clone ID: PAT_MRT3847_33935C.1.pep
FLFSFWVLHFPSSSASAFRRFSSRRKMDVRRRPIPPSGDRRQTQKLKNTATTDSQTLLPLYLTNALFFAVFFSVAYFLLHRWREKIRTATPLHAVTPAETAAIVSLVASAVYLLGFFGVASRASLDELSDDEIILKEDSRAPGPCAAALSDSCSLPNNKIQDQFPLPPRAVHSLAKEKQHIPSPPQVDSPVSVSVSVSSSSDDEDEEIVQAVVSGSIPSYSLESRLGDTRRAATIRHEVVQRLTSRSLSGLPLEGFNYDSILGQCCEMPIGFVQIPVGVAGPLLLDGKEFTVPMATTEGCLVASTNRGCKAIYVSGGASSVLLRDGMTRAPVVRFPSAQRAAQLKFFLEDPLNFDSLAVVFNKSSRFARLQNIQCAIAGKNLYMRFRCSTGDAMGMNMVSKGVQNVLDFLQSDFPDMDVIGISGNFCSDKKAAAVNWIEGRGKSVVCEAIIKEDVVKKVLKTSVEAMVKLNMLKNLTGSAMAGALGGFNAHASNIVSAIYIATGQDPAQNVESSHCITMMEAINDGKDLHVSVTMPSIEVGTVGGGTQLASQSACLNLLGVKGANKESPGANSRLLATIVAGSVLAGELSLMSAIAAGQLVKSHMKYNRSSRDISTIVQ

SEQ ID NO: 3795 - protein, 177 aa, Glycine max
  UNSURE (1)..(177): unsure at all Xaa locations
  Clone ID: PAT_MRT3847_33965C.1.pep
  unsure (1)..(177): unsure at all Xaa locations
MNSIAFLVMGVAVNENEDDDEVGADQPAQQLKRKKLWGLLVCHHESPRYVPLPLLYACFFLAHVLAVHVNKEFELQRQVREKSILRMQTMLSDMLVRESSPLSIVXGTTNIMDLEKCDGAALLYGGKVWRLQNAPTESHIRDIAFWLSDVHRDSTGLSTDSLHDAGYTGAAALGDMI

SEQ ID NO: 3796 - protein, 410 aa, Glycine max
  Clone ID: PAT_MRT3847_34828C.1.pep
MVAMAAATASTQLIFSKPRSPSRLCPFQLCVFDTKQVLSSSSGRRRHVGGSGVRCMAVGEAATTGTKKRSGYELQTLTNWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDPTLDTTEQRCVVNVCQPGSNLLAAGYCMYSSSIIFVLTLGNGVFVFTLDPMYGEFVLTQENLQIPRAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 3797 - protein, 46 aa, Glycine max
  UNSURE (1)..(46): unsure at all Xaa locations
  Clone ID: PAT_MRT3847_34899C.1.pep
  unsure (1)..(46): unsure at all Xaa locations
MADSFREENVWILEFSEHAVRYXEMVVFMENVAKTVDVEELTVVER

SEQ ID NO: 3798 - protein, 766 aa, Glycine max
  Clone ID: PAT_MRT3847_35003C.1.pep
MGAVILPDLGTEILIPVCAIIGIAFALFQWVLVSKVKLSAARDASSNAGGGKNGYNDYLIEEEEGLNDHNVVLKCAEIQNAISEGATSFLFTEYKYVGIFMVAFAILIFLFLGSVEGFSTSYQPCTYDQTKMCKPALATAVFSTISFLLGGVTSLISGFLGMKIATYANARTTLEARKGVGKAFITAFRSGAVMGFLLAANGLLVLYIAINLFKIYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGVNHELTAMLYPLIISSVGILVCLLTTLFATDFFEIKAVKEIEPALKKQLIISTALMTIGIAIVSWIALPTSFTIFNFGVQKDVKNWQLFLCVAVGLWAGLIIGFVTEYYTSNAYSPVQDVADSCRTGAATNVIFGLALGYKSVIIPIFAIAISIFVSFTFAAMYGIAVAALGMLSTIATGLAIDAYGPISDNAGGIAEMAGMSHRIRERTDALDAAGNTTAAIGKGFAIGSAALVSLALFGAFVSRAAITTVDVLTPKVFIGLIVGAMLPYWFSAMTMKSVGSAALKMVEEVRRQFNTIPGLMEGTAKPDYATCVKISTDASIKEMIPPGALVMLTPLVVGILFGVETLSGVLAGSLVSGVQIAISASNTGGAWDNAKKSIEAGASEHARSLGPKGSDCHKAAVIGDTIGDPLKDTSGPSLNILIKLMAVESLVFAPFFATHGGLLFKI

SEQ ID NO: 3799 - protein, 432 aa, Glycine max
  Clone ID: PAT_MRT3847_35116C.1.pep
APFFSTDAFIGVNIGSDISDMPGPTEIVALLKAQSIQHVRLYDADQALLLALANTGIRVTVSVPNDQLLGIGQSNATAANWVTRNVIAHVPATNITAICVGSEVLTTLPNAAPILVSAINFIHSALVAANLDRQIKVSSPHSSSIILDSFPPSQAFFNRTWNPVMVPMFKFLQSTGSCLMLNVYPYYDYQQSNGVIPLDYALFRPLPPNKEAVDSNTLLHYTNVFDAVVDAAYFAMSDLNFTNIPIMVTESGWPSKGDSSESDATVDNANTYNSNLIRHVLNNTGTPKHPGIAVSTYIYELYNEDLRSGPVSEKNWGLFYANGEPVYTLHLTGAGIIFANDTTNQTFCVTKSNADPKMLQAALDWACGPGKVDCSPLLQGQPCYEPDNVVAHSTYAFNAYYQKMDKSPGSCDFKGVATVTTTDPSMAIHTPT

SEQ ID NO: 3800 - protein, 96 aa, Glycine max
  Clone ID: PAT_MRT3847_3536C.1.pep
MPRKRFQEPQPKTGLQHTQDFLRKIGLGKENYYFWKQIGKALLCTYAVIGAVWVYNETSPLGWWTLKPKPKEELELAHLYERRQFPYPGDEEAMQE

SEQ ID NO: 3801 - protein, 287 aa, Glycine max
  Clone ID: PAT_MRT3847_35389C.1.pep
MAIQDQNGFFRSQGGPPEGAGVSLSSGHSVTHIQLNDQFSCGNDYALKVRKPYTITKQRERWTDEEHKKFLEALKLYGRAWRRIEEHVGTKTAVQIRSHAQKFFSKVLHDPTGNNTNTVESIEIPPPRPKRKPMHPYPRKLVETPNKEISIPEQPMKSNSLKSSDFDQENQSPKSVLSGVGSDSIGSSDSDKPNGSLSPMSSISGFHTSSFTRAKPKTTTSEEEAGMDTDSTHDEKPLMKFKLPPNGCVSIKEDNTAEESSGRTFKLFGMTLFVTDTCKPSPTIEEC

SEQ ID NO: 3802 - protein, 89 aa, Glycine max
  UNSURE (1)..(89): unsure at all Xaa locations
  Clone ID: PAT_MRT3847_35541C.1.pep
  unsure (1)..(89): unsure at all Xaa locations
YSQQQQFLPFNXLANIDSAAYLQQQLPFRQLAVVYPQQFLPFKQLASLNSAAYLQQQQLSPFNQLADVSPADFXHNNSCWSFYLHAAPN

SEQ ID NO: 3803 - protein, 125 aa, Glycine max
  UNSURE (1)..(125): unsure at all Xaa locations
  Clone ID: PAT_MRT3847_36480C.1.pep
  unsure (1)..(125): unsure at all Xaa locations
MPPKTQKQKEQKEEEEHGAVFSVSGPVIVAENMIGVAMYELVRVGHENLVGEVIRIDADKATIQVYEETAGVTVGDPVFRSGQPLSVELGPGLMETIYDGIQRPSKGIADDSNSIYIXRGIDLPA

SEQ ID NO: 3804 - protein, 99 aa, Glycine max
  UNSURE (1)..(99): unsure at all Xaa locations
  Clone ID: PAT_MRT3847_36525C.1.pep
  unsure (1)..(99): unsure at all Xaa locations
MAHYQKHXDDHGHNVDXYGNVEKQTDEYGKSVHAATSSYVPTRTAAGGYSEDINRQHESTNAYXVDTGRQHSSGGYDGGTNKHQGTTGGYAADTNRHHG

SEQ ID NO: 3805 - protein, 213 aa, Glycine max
  UNSURE (1)..(213): unsure at all Xaa locations
  Clone ID: PAT_MRT3847_36598C.1.pep
  unsure (1)..(213): unsure at all Xaa locations
MAVLMIFHMFAAISLPAYGDAFIGVNIGTDATNMPSPTEVVALLKAQGIQHVRLYDADRAMLRTLANTGIRVIVSVPNDQILGIGQSNATAANWVARNVIAHVPATNITAIAVGSEVLTSLPNAAPVLVSALKFIQAALVAANLDQQIKVSTPHSSSVILDSFPPSQAFFNKTWDPVMVPLLNFLQSTGSYLMLNVYPYYDYMQTNGVXPLDY

SEQ ID NO: 3806 - protein, 234 aa, Glycine max
  Clone ID: PAT_MRT3847_36609C.1.pep
MDTRIGSLDAAKPACNDVVSCNHTTSAAIQPCVPATVINGAGGDSTLGGHLARRLVEIGVTDVFSVPGDFNLTLLDHLIAEPALNLVGCCNELNAGYAADGYARARGVGACVVTFTVGGLSVLNAIAGAYSENLPLICIVGGPNSNDYGTSRILHHTIGLPDFSQELRCFQTITCFQAVVNNLEDAHELIDTAISTALKESKPVYISISCNLPGIPHPTFSRDPVRFPCLKMSN

SEQ ID NO: 3807 - protein, 608 aa, Glycine max
  Clone ID: PAT_MRT3847_36610C.1.pep
MDTKIGSLDAPKPNSNDVVSCNLTSSAAIQPCLPATVINGAGCSDSTLGGHLARRLVEIGVTDVFSVPGDFNLTLLDHLIAEPALHLVGCCNELNAGYAADGYARARGVGACVVTFTVGGLSVLNAIAGAYSENLPLICIVGGPNSNDYGTSRILHHTIGLPDFSQELRCFQTITCFQAVVNNLEDAHELIDTAISTALKESKPVYISISCNLPGIPHPTFSRDPVRFSLSPRLSNKMGLEAAVEAAAEFLNKAVKPVLVGGPKLRVATASDAFVELADACGYALAVMPSAKGQVPEHHPHFIGTYWGAVSTAFCAEIVESADAYLFAGPIFNDYSSVGYSLLLKKEKAIIVQPDRVVIANGPAFGCVLMKDFLKALAKRLKHNNTAYENYHRIFVPDGHPLKAAPREPLRVNVLFQHIQNMLSGETAVIAETGDSWFNCQKLKLPKACGYEFQMQYGSIGWSVGATLGYAQAVPEKRVIACIGDGSFQLTAQDVSTMLRCGQKTIIFLINNGGYTIEVEIHDGPYNVIKNWNYTGLIDAIHNGEGKCWTAKVFCEEELVEAIATATGPKKDSLCFIEVIVHKDDTSKELLEWGSRVSAANSRPPNPQ

SEQ ID NO: 3808 - protein, 99 aa, Glycine max
  Clone ID: PAT_MRT3847_3683C.1.pep
MSGRGKGGKGLGKGGAKRHRKVLRDNIHGITKPAIRRLARRGGVKRINGLIYEETRGVLKIFLENVIRDAVTYTEHARRKTVTAMDVVYALKRQGRTLY

SEQ ID NO: 3809 - protein, 103 aa, Glycine max; identical to SEQ ID NO: 3555
  Clone ID: PAT_MRT3847_3684C.1.pep

SEQ ID NO: 3810 - protein, 103 aa, Glycine max; identical to SEQ ID NO: 3555
  Clone ID: PAT_MRT3847_3685C.1.pep

SEQ ID NO: 3811 - protein, 430 aa, Glycine max
  Clone ID: PAT_MRT3847_37654C.1.pep
VGTATTHYYASEEFKIKQHKTKSFTCSPQEVISGGDYKQSTYCHLLLGLYFSDQVEFITSAFIYSMVQAFTTFEELWREICNDIRDGTLSSRIKSSKMRKAALDIISPSPNLASKLEDSCKELEGVDWFGLIPKLWPNAKYVYSIMTGSMQPYLKKLMHYANGLPLVSAEYGSTESWIGVNVDPSLPPEDVTFAVVPTFSYFEFIPLHRNEKNFSSGGDDFIEDKPIPLSQIKVGQEYEVVLTTFTGLYRCRLGDVVEVAGFHNGTPKLNFVCRRKLILTINIDKNTEKDLQLVVERGSHILNMTSRGELVDFTSYADVSKQPGHYVIYWEIKGEVEDKILGACCNEMDKSFADHGYVVSRKTNSIGPLELCVLESGTFKKILDSFIANGAALSQFKTPRCTNNHVLLKILNTCTTKKFRSTAYNSSMEQ

SEQ ID NO: 3812 - protein, 102 aa, Glycine max
  Clone ID: PAT_MRT3847_38272C.1.pep
MDLGQMQRQWIDYTKSLFHEGIMDGQFLQLQQHQDENNPDIVVDIVSHFLADSDRLLKDLTFAINDNRVDFIQVDDHVHQLTGNTSCTSAHRVNTARIAFRN

SEQ ID NO: 3813 - protein, 73 aa, Glycine max
  Clone ID: PAT_MRT3847_38797C.1.pep
DGLVRTLKDLANSPYSPEYDIAGITDPFLHIRLLKLLRVLGEGNADASDTMNDILAQVATKTESNKVAGNAIL

SEQ ID NO: 3814 - protein, 244 aa, Glycine max
  Clone ID: PAT_MRT3847_38946C.1.pep
MGRGRVQLKRIENKINRQVTFSKRRSGLLKKAHEISVLCDAEVALIVFSTKGKLFEYSSDPCMEKILERYERYSYAERQLVASDQPLTENWTLEHAKLKARLEVLQKNQRNFMGQDLEGLSIKELQNLEHQLDSALKHIRSRKNQIMHESISELHKKDKVLQEQNNTLAKKIKEKEKALAQHAQMEQRGDEMDLTSSALVPHPLETSNIRESSQIRGEGDNEGTPTPTRANAILPSWMLRPSNE

SEQ ID NO: 3815 - protein, 244 aa, Glycine max
  Clone ID: PAT_MRT3847_38947C.1.pep
MGRGRVQLKRIENKINRQVTFSKRRSGLLKKAHEISVHCDAEVALIVFSTKGKLFEYSSDPCMEKILERYERYSYAERQLVASDQPLTENWTLEHAKLKARLEVLQKNQRNFMGQDLEGLSIKELQNLEHQLESALKHIRSRKNQLMYESISELHKKDKALQEQNNTLAKKIKEKEKALAQQAQLERLGDEVDLTSSALVPQPLVTSNIRTSSQIRGEGDNEGTPTPTQANAILPPWMLRPTNE

SEQ ID NO: 3816 - protein, 463 aa, Glycine max
  Clone ID: PAT_MRT3847_39240C.1.pep
PRVRESQANGVHSSKHDDDGRLKRRGTWLTATSHIVTAVIGSGVLSLAWAVAQLGWIAGPAILTIFSVITVFTSSLLSDCYRYPDSVHGTRNHNYREMVKNILGGRKYLFCGLAQFANLIGTGIGYTVTASISMVAVIRSNCFHKYGHEAKCHTSNYPYMTIFAVIQILLSQIPDFQELSGLSIIAAVMSFGYSSIGIGLSIAKIAGGNDAKTSLTGLIVGEDVTSQEKLWNTFQAIGNIAFAYAFSQVLVEIQDTLKSSPPENQAMKKATLAGCSITSLFYMLCGLLGYAAFGNKAPGNFLTGFGFYEPYWLVDIGNVFVFVHLVGAYQVFTQPVFQLVETWVAKRWPESNFMGKEYRVGKFRFNGFRMIWRTVYVIFTAVVAMILPFFNSIVGLLGAISFFPLTVYFPTEMYLVQAKVPKFSLVWIGVKILSGFCLIVTLVAAAGSIQGIIADLRIYEPFK

SEQ ID NO: 3817 - protein, 36 aa, Glycine max
  Clone ID: PAT_MRT3847_39392C.1.pep
QFVQENPNKVGPVGGKPGEKSMKPDPKLSKNYFAGG

SEQ ID NO: 3818 - protein, 767 aa, Glycine max
  UNSURE (1)..(767): unsure at all Xaa locations
  Clone ID: PAT_MRT3847_40132C.1.pep
  unsure (1)..(767): unsure at all Xaa locations
MSEMASPDPEGLDGVRMTWNVWPRTKVESSKCVIPLAATVALIRPHPDIPRLQYAPLRCKTCSSALNPFSRVDFTAKIWICPFCYQRNHFPPHYHAISETNFPGELYPQYTTVEYLLPLSNSLNPSPVFLFLLDTCLIDEEIHFLKSALRRAIGLLPDNALVGFVSFGTQVQVYELGFSDMSKVXVFRGSKEIPXNKILDQLGLSAAGRRPQKGAAPGVAGAGGFPNSGITRFLLPASECEYTLNALLDELQTDQWPVPPGRRPARCTGVALSVAAGLLSACNPGTGARIIALVGGPCTEGPGAIVSKDLSDPVRSHKDLDKDAAPFFKKAVKFYEGLAKQLVGQGHVLDIFASALDQVGVAEMKVAVERTGGLVVLSESFGHSVFKDSFKRVFEDGEQSLGLCFNGTLEINCSKEIKIQGIIGPCTSLEKKGPSVADTVIGEGNTTAWKMCGLDKSTCLTVMFDLSSSDRSNTPGAVNPQLYLQFLTSYQDPSGQSVLRVTTVTRRWVDSSVSSEELVQGFDQETAAVVMARFASLKMESEETFDATRWLDRFLIRLCSKFGDYRKDDPSSFTLNPSFSLFPQFMFNLRRSQFVQVFNNSPDETAYFRMLLDRENISNAAVMIQPSLISYSFNALPAPALLDVASIAADKILLLDSYFSVVIFHGMTIAQWRNLGYQNQQEHQAFAQLLRAPHDDAQMIIRERFPVPRLVVCDQHGSQARFLLAKLNPSATYNNAHEMAAGSDVIFTDDVSLQVFFEHLQRLAVQS

SEQ ID NO: 3819 - protein, 93 aa, Glycine max
  Clone ID: PAT_MRT3847_40249C.1.pep
SVSFDELIALYAVSDVCLVSSTRDGMNLVSYEYIATQQKRHGVMILSEFAGAAQSLNGSIIVNPWNTEELADAIHDAVTMGAEQRALNYQKLA

SEQ ID NO: 3820 - protein, 197 aa, Glycine max
  UNSURE (1)..(197): unsure at all Xaa locations
  Clone ID: PAT_MRT3847_40255C.1.pep
  unsure (1)..(197): unsure at all Xaa locations
ARDAILYECVQTIMSVEDNGGLRVLAINILGRFLSHKDNNIRYVGLNMLMKAVTVDAQAVQRHRATILEWLKDSDASIQKRALELVCILVNETNVNALTKELVEYLEVSDPDFRADLTAKICSIVSKFSPEKIWYIDQMLNVLSEAGNFVKDEVWHAXIVVISNASELHGYTVRALYKAFKMAGEQETLVRLTVWGI

SEQ ID NO: 3821 - protein, 261 aa, Glycine max
  Clone ID: PAT_MRT3847_40335C.1.pep
LPLRYLYELDQHLDRFLRSASMSKIDPPFDRGSIRRILIQTVSASKSRKGSLRYWLSAGPGDFQLSPSCCHRSSLYAIVIQDLSPSSPNFRGVKVVTSSIPIKHPKFAITKSVNYLPNVLSKVEAEEAGAFVGIWLDGEGFVAEGPNMNVAFVTKDKELIMPHFDKILSGCTAKRVLTLAESLLREGKLKGIRVKTVTVEEGKQADEMMLLGSGVLVCPVVQWDEQVIGDGKEGPITQALLNLIVEDMKSGPSTVRIPVPY

SEQ ID NO: 3822 - protein, 100 aa, Glycine max
  Clone ID: PAT_MRT3847_40690C.1.pep
ESNALALPLVVKKLLRVSPLASSFAVSILRKICDKREEGVLVEALQVGVFQKLLVMLQVGCDESTKENATRLLKLLNGYRNKAECTDSSSLDFKHLKKPF

SEQ ID NO: 3823 - protein, 431 aa, Glycine max
  UNSURE (1)..(431): unsure at all Xaa locations
  Clone ID: PAT_MRT3847_40691C.1.pep
  unsure (1)..(431): unsure at all Xaa locations
MVLSWTRRNVFRRAKKEKEQSQLEVEVVIPNHFRCPVSLELMTDPVTLSTGITYDRVSIEKWIEGGNRTCPVTNQVLTTFDLIPNHAIRMMIQDWCVXNSSYGIERIPTPRIPISAYEVSDTCTRILSACQRGDDKRCQELVGKIKVWSRESERNKRCIVGAGAGAVLAYAFDCFSSNSIEKHVVVLEEVLEVMTWMIPFGEEGVSKLSSGASLNSLVWFLEGKDLASRQSAALLLKEVCVQELAKVGEVVEALVKMVREPIGSTSTKACLATIFNLVSLAANREGIDQRFVELGLVSLLLEAIVDGEKGVCEKALGVLDCICDCEKGKEVVKSNALALPLVVRKLLRVSPLASGFAVSILRKICDKREEGILIEALQVGLFQKLLVLLQVGCDESTKENATGLLKLLNGYRNKAECTDSSLNFEHLKKPF

SEQ ID NO: 3824 - protein, 491 aa, Glycine max
  Clone ID: PAT_MRT3847_40848C.1.pep
MAGIAGTCPLGALLRNSVSENNGKISVVHYEGLRLQQRMQMPSPSQYISASSSAPRCRTIKAMASPTVGAPKREKDPKKRVVITGMGLVSVFGSDVDAFYNKLLEGESGISLIDRFDASNFSVRFGGQIRDFSSEGYIDGKNDRRLDNCWRYCIVAGKRALDDANLGKQVLDTMDKTRIGVLVGSGMGGITAFSNGVEALVQKGYKKITPFFIPYSITNMGSALLAIDTGLMGPNYSISTACATANYCFCAAANHIRKGEADIMVVGGTEAAIMPSGLGGFIACRALSHRNEDPKKASRPWDKDRDGFVMGEGSGVLVMESLESATKRGAKIIAEYLGGAITCDAHHMTDPRADGLGVSSCISKSLEDAGVSPEEVNYVNAHATSTLAGDLAEVNAIKKVFKDTSELKMNATKSMIGHGLGAAGGLEAIATIKAITTGWLHPSINLDNLEASVTIDTVPNVKKKHEVNVGISNSFGFGGHNSVVVFAPFRP

SEQ ID NO: 3825 - protein, 279 aa, Glycine max
  Clone ID: PAT_MRT3847_40928C.1.pep
LSLGVAKVAENKSFKGSLMGISIGTVTQAGTVTSTQKIWRSLQALGAMAFAYSFSIILIEIQDTIKSPPAEHKTMRKATTLSIAVTTVFYLLCGCMGYAAFGDNAPGNLLTGFGFYNPYWLLDIANLAIVIHLVGAYQVFSQPLFAFVEKWSARKWPKSNFVTAEYDIPIPCFGVYQLNFFRLVWRTIFVLLTTLIAMLMPFFNDVVGILGAFGFWPLTVYFPIDMYISQKKIGRWTSRWLGLQLLSASCLIISLLAAVGSMAGVVLDLKTYKPFKTSY

SEQ ID NO: 3826 - protein, 513 aa, Glycine max
  Clone ID: PAT_MRT3847_40929C.1.pep
MLPRSRTLPSRIHQGIIEERHDVRPYVQVEVRPNNIQTETQAMNIQSNYSKCFDDDGRLKRTGTFWTATAHIITAVIGSGVLSLAWAVAQLGWVAGPVVMFLFAVVNLYTSNLLTQCYRTGDSVNGHRNYTYMEAVKSILGGKKVKLCGLIQYINLFGVAIGYTIAASVSMMAIKRSNCYHSSHGKDPCHMSSNGYMITFGIAEVIFSQIPDFDQVWWLSIVAAIMSFTYSSVGLSLGVAKVAENKTFKGSLMGISIGTVTQAGTVTSTQKIWRSLQALGAMAFAYSFSIILIEIQDTIKSPPAEHKTMRKATTLSIAVTTVFYLLCGCMGYAAFGDNAPGNLLTGFGFYNPYWLLDIANLAIVIHLVGAYQVFSQPLFAFVEKWSVRKWPKSNFVTAEYDIPIPCFGVYQLNFFRLVWRTIFVLLTTLIAMLMPFFNDVVGILGAFGFWPLTVYFPIDMYISQKKIGRWTSRWIGLQLLSVSCLIISLLAAVGSMAGVVLDLKTYKPFKTSY

SEQ ID NO: 3827 - protein, 58 aa, Glycine max
  Clone ID: PAT_MRT3847_41138C.1.pep
MQRLWIDYTKSLFLEGFLDGQLLQLHHLQYDNNLDFGDEVVFLLFEDSERLLIDLTFA

SEQ ID NO: 3828 - protein, 80 aa, Glycine max
  UNSURE (1)..(80): unsure at all Xaa locations
  Clone ID: PAT_MRT3847_41731C.1.pep
  unsure (1)..(80): unsure at all Xaa locations
DSTFHTTTTSTALRSIPTATIPSYQKHYHDQGRKVDXYFYVEKQTDXYCNPVHAASVTYLTTITSSXVYSDYIYNQHYTT

SEQ ID NO: 3829 - protein, 161 aa, Glycine max
  Clone ID: PAT_MRT3847_42207C.1.pep
MTSSSAAARKNLSKIACNRLQKELVEWQVNPPTGFKHKVTDNLQRWVVEVTGAPGTLYANETYQLQVDFPENYPMEAPQVIFLHPAPLHPHIYSNGHICLDILYDSWSPAMTVSSICISILSMLSSSTTKQRPEDNDRYVKNCRNGRSPKETRWWFHDDKV

SEQ ID NO: 3830 - protein, 306 aa, Glycine max
  Clone ID: PAT_MRT3847_4236C.1.pep
MKSSRRLLRIGLVSAWYSSNIGVLLLNKYLLSNYGFKYPIFLTMCHMTACSLFSYVAIAWLKMVPMQTIRSRLQFLKIAALSLIFCFSVVFGNVSLRYLPVSFNQAVGATTPFFTAVFAYVMTFKREAWLTYLTLVPVVTGVVIASGGEPSFHLFGFIVCIAATAARALKSVLQGILLSSEGEKLNSMNLLLYMAPIAVVFLLPATLIMEENVVGITLALARDDVKIIWYLLFNSALAYFVNLTNFLVTKHTSALTLQVLGNAKGAVAVVVSILIFRNPVSVTGMMGYSLTVLGVVLYSQAKKRSK

SEQ ID NO: 3831 - protein, 176 aa, Glycine max
  Clone ID: PAT_MRT3847_42797C.1.pep
MKGRVRWDEANIGEIEANKPVRQKITEPKTPYHPMIDDDSSLSPVRGSFDACIDNENRAEAIWSALNDVASSSRRGTGQSGGWTSSEDEPEAMEQDDDDSETDRNLSFKEHRKAHYDEFLKVKELQETGSLEDESDEDHNSQPSKAEKCESSSLSHSVKEMVIEGKKSSTPPANGS

SEQ ID NO: 3832 - protein, 469 aa, Glycine max
  Clone ID: PAT_MRT3847_43305C.1.pep
MQALHSPTLRASPLDPLRGPNNAAANRRSSSAKRVFFVSATVAPKVSAPQRQKDPKKRVVITGMGLASVFGNDVEGYYEKLLAGESGITAIDRFDASKFPTRFGGQIRGFSAEGYIDGKNDRRLDDCLRYCIVAGKKALENADLAPDNHSKIDKERAGVLVGSGMGGLTVFSDGVQALIEKGHRKITPFFIPYAITNMGSALLGIDLGFMGPNYSISTACATSNYCFYAAANHIRRGEADLMIAGGTEAAIIPIGLGGFVACRALSQRNDDPKTASRPWDKERDGFVMGEGAGVLVMESLEHAMKRGAPIIAEYLGGAVNCDAYHMTDPRSDGLGVSTCIQSSLEDAGVSPEEVNYINAHATSTLAGDLAEINAIKKVFKDTSGIKINATKSMIGHCLGAAGGLEAIATVKAITTGWLHPTINQFNPEPAVDFDTVANVKQQHEINVAISNSFGFGGHNSVVAFSAFKP

SEQ ID NO: 3833 - protein, 32 aa, Glycine max
  Clone ID: PAT_MRT3847_43345C.1.pep
KKKKNLKKFKKKKKKKKKKKKKKKKKKKGRPF

SEQ ID NO: 3834 - protein, 470 aa, Glycine max
  Clone ID: PAT_MRT3847_43486C.1.pep
MGSMHIETPETFADGSKNFDDDGRAKRTGTWITASAHIITAVIGSGVLSLAWAIAQMGWVAGPAVLFVFSLITYFTSTLLADCYRSPDPVHGKRNYTYSEVVKANLGGRKFQLCGLAQYINLVGVTIGYTITASLSMGAVKKSNCLHKHGHQDECKVKDNAFMIAFACIQILLSQIPNFHKLSWLSIVAAVMSFAYSSIGLGLSIAKIIGGGHVRTTLTGVEVSGTEKVWKMFQAIGDIAFAYAFSNVLIEIQDTLKSSPPENKVMKRASLIGIMTTTLFYVLCGCLGYAAFGNDAPSNFLTGFGFYEPFWLIDFANVCIAVHLVGAYQVFVQPIFGFVEKWSKENWTESQFINGEHTLNIPLCGSYNVNFFRVVWRTAYVIITAVVAMLLPFFNDFLALIGALSFWPLTVYFPIEMYIKKSNMQRFSFTWTWLKILSWVCLIISIISLVGSIQGLSVSIKKYKPFQAEQ

SEQ ID NO: 3835 - protein, 395 aa, Glycine max
  UNSURE (1)..(395): unsure at all Xaa locations
  Clone ID: PAT_MRT3847_43512C.1.pep
  unsure (1)..(395): unsure at all Xaa locations
MVKETEYYDVLGVSPTASEAEIKKAYYIKARQVHPDKNPNDPLAAQNFQVLGEAYQVLSDPAQRQAYDAHGKSGISTEAIIDPAAIFAMLFGSELFEEYIGQLAMASMASMDIFTEGEQFDSKKLQEKMRVVQKEREEKLAEILKNRLNQYVQGNKEGFVNDAEAEVARLSNAAYGVDMLNTIGYIYARQAAKELGKKAIYLGVPFIAEWFRNKGHSIKSQVTAATGAIALIQLQEDMKKQLSSEGDYTEEELEEYMQNHKKLMIDSLWKLNVADIEATLSRVCQMVLQDNGAKKEELRARAKGLKTLGKIFQRVKSANGNENESVXNKAVHKLNGSETGNDTSPSTSPKSSSPDFSSQSPYVEAPRFAGMQFDYNFPRPTAPPGAQRPTSTSKD

SEQ ID NO: 3836 - protein, 138 aa, Glycine max
  Clone ID: PAT_MRT3847_43712C.1.pep
MEEESKEKKKDTKEEPRYRGVRRRPWGKFAAEIRDPARHGARVWLGTFLTAEEAARAYDRAAYEMRGALAVLNFPNEYPSCSSMNSSSTLAPSSSSSNSMLKSDHGKQVIEFECLDDKLLEDLLDCDDYAYEKDLPKN

SEQ ID NO: 3837 - protein, 137 aa, Glycine max
  UNSURE (1)..(137): unsure at all Xaa locations
  Clone ID: PAT_MRT3847_44678C.1.pep
  unsure (1)..(137): unsure at all Xaa locations
MAGKGGKGLLAAKTTAANKDKDKDKKRPISRSSRAGIQFPVGRIHRQLKQRVQANGRVGATAAVYLASILEYLTAEVLELAGNASKDLKVKRITPRHLQLAIRGDEELDTLIKGTIAXVRGVIPHIHKSLINKTAKD

SEQ ID NO: 3838 - protein, 262 aa, Glycine max
  Clone ID: PAT_MRT3847_44731C.1.pep
MAASAPTPREEFVYMAKLAEQAERYEEMVEFMEKVSASAESEELTVEERNLLSVAYKNVIGARRASWRIISSIEQKEESRGNEDHVAVIRDYRSKIEAELSNICDGILKLLDTRLVPSAASGDSKVFYLKMKGDYHRYLAEFKTGADRKEAAESTLSAYKAAQDIANTELPPTHPIRLGLALNFSVFYYEILNSPDRACSLAKQAFDEAIAELDTLGEESYKDSTLIMQLLRDNLTLWTSDMQDDGADEIKEAAPKGDGEQN

SEQ ID NO: 3839 - protein, 261 aa, Glycine max
  Clone ID: PAT_MRT3847_44732C.1.pep
MASAPTPREEFVYMAKLAEQAERYEEMVEFMEKVSASAESEELTVEERNLLSVAYKNVIGARRASWRIISSIEQKEESRGNEDHVAVIRDYRSKIEAELSNICDGILKLLDTRLVPSAASGDSKVFYLKMKGDYHRYLAEFKTGADRKEAAESTLSAYKAAQDIANTELPPTHPIRLGLALNFSVFYYEILNSPDRACSLAKQAFDEAIAELDTLGEESYKDSTLIMQLLRDNLTLWTSDMQDDGADEIKEAAPKGDGEQN

SEQ ID NO: 3840 - protein, 258 aa, Glycine max
  Clone ID: PAT_MRT3847_44887C.1.pep
MACSATSASLFSANPTPLFSPKSSLSLPNNSLHLNPLPTRPSLSLTRPSHTRRSFVVKASSSELPLVGNTAPDFEAEAVFDQEFINVKLSDYIGKKYVVLFFYPLDFTFVCPTEITAFSDRHAEFEALNTEILGVSVDSVFSHLAWIQTDRKSGGLGDLNYPLISDVTKSISKSYGVLIPDQGIALRGLFIIDKEGVIQHSTINNLAIGRSVDETKRTLQALQYVQENPDEVCPAGWKPGEKSMKPDPKLSKDYFAAV

SEQ ID NO: 3841 - protein, 48 aa, Glycine max
  Clone ID: PAT_MRT3847_45016C.1.pep
LTRGRTRWKKKKKKKGKNKKKKKKKKKKKKKKKKKKKKKKKKKRGRPF

SEQ ID NO: 3842 - protein, 244 aa, Glycine max
  Clone ID: PAT_MRT3847_45510C.1.pep
MWKLKIAEGGDGLISVNNFIGRQHWEFDPNAGTPQERAQVERVREEYKKNRFCIKQSGDLLMRMQLTKENTCGPILARVNVKDTENVTEEALITTMRKAINFYSSIQAHDGHWPAESAGPLFFLQPLVMALYITGSLNDVLGPEHQKEIIRYLYNHQNEDGGWGLHIESHSTMFGSALSYIALRILGEGPEDGEDRAMARGRKWILDHGGLEAIPSWGKFWVTVLGVYEWSGCNPLPPELLFGY

SEQ ID NO: 3843 - protein, 37 aa, Glycine max
  UNSURE (1)..(37): unsure at all Xaa locations
  Clone ID: PAT_MRT3847_45570C.1.pep
  unsure (1)..(37): unsure at all Xaa locations
LPVSPLYLHQSSVLLQQLPLAHXLAQSIRAQQLHELV

SEQ ID NO: 3844 - protein, 498 aa, Glycine max
  Clone ID: PAT_MRT3847_45795C.1.pep
MALHFLLLLLFAVSVVAADEEPFIGVNIGTDLSDMPHPTQVVALLKAQQIRHVRLYDADQAMLLALAKTGIQVAVTVPNEEILAIGQSNSTAANWVSRNVVAHYPATNITAICVGSEVLTTLPNAAKVLVSAIKYIHSALVASNLDRQVKVSTPLSSSIILDSFPPSQAFFNRSLNPVLVPLLDFLQSTGSYLMLNIYPYYDYMQSNGVIPLDYALFKSLPPNKEAVDSNTLLHYTNVFDAMVDAAYFAMAFLNYTNIPVVVTESGWPSKGGSNEPDATVDNANTYNSNLIKHVFNKTGTPKHPGIDVSTYIYELYNEDMKSGPLSEKNWGLFDANGTPIYILHLTESGAVLANDTSNNTFCIAKDGADPKMLQAALDWACGPGKVECSPLLQGQPCYEPDNVIAHANYAFDTYYHKMGKTPDACDFNGVATISTSDPSHGSCLFPGSVGKNGTLGNFTAPSMNSTNSDSSAYKFSCDLRIRSLLMVTGFLLWGVVLL

SEQ ID NO: 3845 - protein, 81 aa, Glycine max
  UNSURE (1)..(81): unsure at all Xaa locations
  Clone ID: PAT_MRT3847_46662C.1.pep
  unsure (1)..(81): unsure at all Xaa locations
NVVTSVGIRLVNKALMATYGFNFATXLTALHHSTTTLLTLTLKSISYIHTSHLPLSDIIKFVSFAYFFIVVINVILMLNSY

SEQ ID NO: 3846 - protein, 478 aa, Glycine max
  Clone ID: PAT_MRT3847_46694C.1.pep
MENYQYPASYPDSGESSPRSREIDFENPPPWDEQQNQNYKAKFMCSYGGKIQPRTHDNQLSYVGGDTKILAVDRSVKFSAFLSKLSALCDSPPQDLTFKYQLPGEDLDALISVTNDDDLEHMMHEYDRLYRPNLKPVRMRLFLFTLSNSNPNSSFSSERDRFVEALNSGPVPSQPDPIKTPPVTPSNVDYLFGLDKAVAPPNLPPNFAAVKFHDPVPEPVAPTPVEYQSRVSDRVVGSDPNVNSMEIQRQMQQEMQRLQIAENEYRRRSEDGFATGYAAAAGGDYYMQKVQEKVPPQNAAVPPPAAYWSEKQFSGEGYQTTVTTAAPGGGDQPMYVMAAPGTFYHHSPVMRPPAAAQGYYAVQRMGSDGYREQQAVYGGVAAPKAAFSSAGMVKGPAYSEGYSGGVVRPAGLPDNAAYAQVAYDSASGRQVYYTAQGGMVHAPPPPQYQGVPPQELRPGGVSVGQDGKVVNKVNQGSV

SEQ ID NO: 3847 - protein, 42 aa, Glycine max
  UNSURE (1)..(42): unsure at all Xaa locations
  Clone ID: PAT_MRT3847_46867C.1.pep
  unsure (1)..(42): unsure at all Xaa locations
LNPXKPPXXXPIANCXKSTLEKRXLMXGLLLLPARVEGXSSS

SEQ ID NO: 3848 - protein, 368 aa, Glycine max
  Clone ID: PAT_MRT3847_47972C.1.pep
MGEAKGKEEEVLASVHSTVFKESESLDGKCVKIEGYDFNRGVNYPLLLSSMVTTGFQASNLGDAIQVVNQMLDWRLVDEPVAEDCSDQERDLEYRKSVTCKVFLGFTSNLISSGVRDTVRFLLQHRMVDVVVTTTGGIEEDLIKCLAPTYKGDFSLPGAYLRSKGLNRIGNLLVPNDNYCKFEDWIIPIFDQMLGEQNNENALWLREDDISGLGKEIKNESSYLYWAYKNNIPVFCPGLTDGSLGDMLYFHSFRNPGLIVDIVQDIRAMNGEAVHASPRKTGMIILGGGLPKHHICNANMMRNGADYAVFINTAQEYDGSDSGARPDEAVSWGKIRDSAQTVKVHCDATIAFPLLVAETFASRVKPPH

SEQ ID NO: 3849 - protein, 132 aa, Glycine max
  Clone ID: PAT_MRT3847_48100C.1.pep
MVRTLAMIKPDGLSGKYTEAIKEVILDSGFHIVKETEVQLDAERASVFYAEHSQRSFFDSLVKYITSGPVLAMVLERPDAVAQWRTVIGPTDAKKANTSHPNSIRAMCGLDSEKNCVHGSDSPESADREISF

SEQ ID NO: 3850 - protein, 36 aa, Glycine max
  Clone ID: PAT_MRT3847_4964C.1.pep
QETSFVTIGQRILANPLRVRFHYGHPDIFDRLFHTT

SEQ ID NO: 3851 - protein, 41 aa, Glycine max
  Clone ID: PAT_MRT3847_504C.1.pep
LLRTKSRFQNNKFGSPYPCRNLIRSHLGSLNEICLEVVHSR

SEQ ID NO: 3852 - protein, 240 aa, Glycine max
  Clone ID: PAT_MRT3847_50784C.1.pep
MAEDLVLDTAIRDWVLIPLSVVMVLIGVLRYFVSKLMHSSQTPDAKIVKEGQVIVRARNLRAGANFIPSKAFRARKIYFWNEENGLLFLKQGEGLIPQAQMFMDMMKKNHTMIIHHSLTFAWVNFFFSGFVAAKIPFPLTQRFRSMLQNGIDLSTVDVSYVSSRSWYFLNLFGLRGLFSLILGEENAVDDTQRMMQMGGFGFDPSKGLSAEKDNLDITQHDWALPNFEQRAEAVLRKVAS

SEQ ID NO: 3853 - protein, 136 aa, Glycine max
  Clone ID: PAT_MRT3847_50935C.1.pep
MSGKGAKGLITGKTSASAKDKDKDKKKPVSRSSRAGLQFPVGRIHRLLKSRVSANGRVGATAAVYSAAILEYLTAEVLELAGNASKDLKVKRITPRHLQLAIRGDEELDTLIKGTIAGGGVIPHIHKSLINKSSKE

SEQ ID NO: 3854 - protein, 199 aa, Glycine max
  UNSURE (1)..(199): unsure at all Xaa locations
  Clone ID: PAT_MRT3847_51233C.1.pep
  unsure (1)..(199): unsure at all Xaa locations
MPAVGGINTGGGKEYPGSLTLFVTVTCIVAAMGGLIFGYDIGISGGVTSMDPFLLKFFPSVFRKKNSDKTVNQYCQYDSQTLTMFTSSLYLAALLSSLVAATVTRKFGRKLSMLFGGLLFLVGALINGFAQHVWMLIVGRILLGFGIGFANQSVPLYLSEMAPYKYRGALNIGFQLSITVGILVANVLNYFFAKXKGGW

SEQ ID NO: 3855 - protein, 519 aa, Glycine max
  Clone ID: PAT_MRT3847_51235C.1.pep
MPAVGGISNGGGKEYPGSLTPFVTVTCIVAAMGGLIFGYDIGISGGVTSMDPFLLKFFPSVFRKKNSDKTVNQYCQYDSQTLTMFTSSLYLAALLSSLVASTVTRRFGRKLSMLFGGLLFLVGALINGFAQHVWMLIVGRILLGFGIGFANQSVPLYLSEMAPYKYRGALNIGFQLSITVGILVANVLNYFFAKIHGGWGWRLSLGGAMVPALIITIGSLVLPDTPNSMIERGDREKAKAQLRRVRGIDDVEEEFNDLVAASESSRKVEHPWRNLLQRKYRPHLTMAVLIPFFQQLTGINVIMFYAPVLFSSIGFKDDSALMSAVITGVVNVVATCVSIYGVDKWGRRALFLEGGVQMVICQAVVAAAIGAKFGIDGNPGDLPKWYAVVVVLFICIYVSAFAWSWGPLGWLVPSEIFPLEIRSAAQSINVSVNMFFTFLIAQVFLTMLCHMKFGLFIFFAFFVLIMTFFIYFFLPETKGIPIEEMNQVWKAHPFWSRFVENDDYGNGVEMGRGTAIKEV

SEQ ID NO: 3856 - protein, 300 aa, Glycine max
  Clone ID: PAT_MRT3847_5172C.1.pep
MELETLYTPCYMPNSNWFVQESLSTEWTREDNKKFESALAIYDKDTPDRWFKVAAMIPGKTVFDVIKQYRELEEDVSEIEAGHVPIPGYLASSFTFELVDNHNYDGCRRRLAPVRGSDQERKKGVPWTEEEHRRFLMGLLKYGKGDWRNISRNFVVTKTPTQVASHAQKYYIRQKVSGGKDKRRPSIHDITTVNLTETSASDKNKPPVIAPQQKLNSMSKVQLDWTSSHYNDGSLMVFNPNSDDLFVSSSSDVTSMALKMQGQDLYECALREAYAKVKVPGFSMAPRDFNNEAVFGIHAL

SEQ ID NO: 3857 - protein, 307 aa, Glycine max
  Clone ID: PAT_MRT3847_5173C.1.pep
DMELETIYPPCFMPNSNWFVQESHSTEWTREDNKKFESALAIYDNDTPDRWFKVAAMIPGKTVFDVIKQYRELEEDVSEIEAGRVPIPGYLASSFTFELVDNHNYDGCRRRLAPVRGSDQERKKGVPWTEDEHRRFLMGLLKYGKGDWRNISRNFVVTKTPTQVASHAQKYYIRQKVSGGKDKRRPSIHDITTVNLTETSASDKNKPQLFNASPVLAPQQKLNSISKVQLGWTSSHYNDGSFMVFNPNSDALFVSSSPDVTSMALKMQGQDLYDCALHEAYAKVKVPGFSMAPRDFNNEAVFGIHAL

SEQ ID NO: 3858 - protein, 36 aa, Glycine max
  Clone ID: PAT_MRT3847_51785C.1.pep
MSTGGQVVKCKAAVAWEAGKPLSIGTIEVAPPQKSG

SEQ ID NO: 3859 - protein, 136 aa, Glycine max
  Clone ID: PAT_MRT3847_51981C.1.pep
MAGKGGKGLVAGKTTAANKDKDKDKKRPVSRSSRAGIQFPVGRIHRQLKQRVQANGRVGATAAVYLASILEYLTAEVLELAGNASKDLKVKRITPRHLQLAIRGDEELDTLIKGTIAGGGVIPHIHKSLINKAAKE

SEQ ID NO: 3860 - protein, 65 aa, Glycine max
  Clone ID: PAT_MRT3847_51C.1.pep
KKKKKKNKKKKKKKKKKNKKKKKKKKKKKKKKRGGPFKGSNFTSPCLQRNTFFLGPPKLNSRAGV

SEQ ID NO: 3861 - protein, 63 aa, Glycine max
  UNSURE (1)..(63): unsure at all Xaa locations
  Clone ID: PAT_MRT3847_52241C.1.pep
  unsure (1)..(63): unsure at all Xaa locations
LLQKRQTPPITREGGAEGEREVLLEGRRKMTQLRYNXTLCHVHSSYIQRRAPAGRFTRCPDRR

SEQ ID NO: 3862 - protein, 233 aa, Glycine max
  UNSURE (1)..(233): unsure at all Xaa locations
  Clone ID: PAT_MRT3847_52622C.1.pep
  unsure (1)..(233): unsure at all Xaa locations
GIDHASFLLALQMAAEAXNPYFRLGYNSLGAFATINHLHFQAYYLALPFPIEKAPTKKIAKLSGGVKISKLLNYPVRGLVFEGGHSLEGLANVVSEACICLQHNNIPYNILISDCGRQIFLLPQCYAEKQALGEVSAELLETQVNPAVWEISGHLVLKRKKDYEEASEANACRLLAEVSLSEERFQEVTALVFQAIASVEMNVKPQLLEEVDAVSPSTQRAMVAGSHECLVLQ

SEQ ID NO: 3863 - protein, 435 aa, Glycine max
  Clone ID: PAT_MRT3847_52624C.1.pep
MLSIKRVPTVVSNYQKEETGEAAAGGCGRNCLKSCCIQGARLPLYAFKKVDKVCGNELPLLGCKEQHPVAFLDSLVLGEWEDRMQRGLFRYDVTACETKVIPGEYGFIAQLNEGRHLKKRPTEFRVDKVLQPFDENKFNFTKVGQEEVLFQLEASNDGEAQFFPNAPIDVENSPSFVAINVSPIEYGHVLLIPRIFKCLPQRIDHASFLLALQMAVEARNPYFRLGYNSLGAFATINHLHFQAYYLALPFPIEKAPTKKIAKLSGGVIISKLLNYPVRGLVFEGGHTLEDLANAVSEACICLQHNNIPYNVLISDCGRQIFLLPQCYAEKQALGEVSPELLETQVNPAVWEISGHMVLKRKKDYEEASEANAWRLLAEVSLSEERLLEVTALVFQAITSSVEMNVKPQRLEEVDAVSPNAQHAMVAGSHECLVLQ

SEQ ID NO: 3864 - protein, 412 aa, Glycine max
  Clone ID: PAT_MRT3847_52745C.1.pep
MASWWCSSPSATLTVSTTTTRHFSLLSHTSQFRIQTLTFPPSSFTRFTTAPPSLRFRVPCSNKTAFETELPEDGVDCVGTGQDVECLVNTEEKQSEPSSSSSSSSSSSSMLCLAEALWEGAVLVSPFFFWGTAMVAMKEVLPKCGPFFVSAFRLIPAGFLLVAFAASRGRTLPSGFNAWLSITLFALVDAACFQGFLAEGLQRTSAGLGSVIIDSQPLTVAVLAALLFGESIGVVGAAGLVLGVIGLVLLELPALSFDESNFSLWGSGEWWMLLAAQSMAIGTVMVRWVSKYSDPVMATGWHMVIGGLPLVLFAVLNNDPAVSLSLKEYSSTDILALLYTSIFGSAVSYGVFFYSATKGSLTKLSSLTFLTPMFASIFGFLYLGETFSPVQLVGALVTVAGIYMVNFRSTSE

SEQ ID NO: 3865 - protein, 58 aa, Glycine max
  Clone ID: PAT_MRT3847_53506C.1.pep
AADNQTQVGIKVLQGEREMAADNKMLGEFDLVGIPPAPRGLPQIDVTFDIDANGIVTC

SEQ ID NO: 3866 - protein, 135 aa, Glycine max
  Clone ID: PAT_MRT3847_5356C.1.pep
MAGRGKTLGSSAAKKATSRSSKAGLQFPVGRIARFLKAGKYAERVGAGAPVYLAAVLEYLAAEVLELAGNAARDNKKTRIVPRHIQLAVRNDEELSKLLGDVTIANGGVMPNIHNLLLPKKAGGSSKGAAADDDS

SEQ ID NO: 3867 - protein, 135 aa, Glycine max; identical to SEQ ID NO: 3866
  Clone ID: PAT_MRT3847_5357C.1.pep

SEQ ID NO: 3868 - protein, 135 aa, Glycine max
  Clone ID: PAT_MRT3847_5358C.1.pep
MAGRGKTLGSSAAKKATSRSSKAGLQFPVGRIARFLKAGKYAERVGAGAPVYLAAVLEYLAAEVLELAGNAARDNKKTRIVPRHIQLAVRNDEELSKLLGDVTIANGGVMPNIHNLLLPKKAGGSSKAAAADDDS

SEQ ID NO: 3869 - protein, 65 aa, Glycine max
  UNSURE (1)..(65): unsure at all Xaa locations
  Clone ID: PAT_MRT3847_53649C.1.pep
  unsure (1)..(65): unsure at all Xaa locations
REENVYMAKLAEHAERYEEMVEFMENVSAAADNEELTVEEMNLLSCAYKNVIXARRASWLIISSI

SEQ ID NO: 3870 - protein, 38 aa, Glycine max
  UNSURE (1)..(38): unsure at all Xaa locations
  Clone ID: PAT_MRT3847_5387C.1.pep
  unsure (1)..(38): unsure at all Xaa locations
ITKPHXSHPXNTLDNPLKHCKXQAQRXXEIXKXINTII

SEQ ID NO: 3871 - protein, 195 aa, Glycine max
  UNSURE (1)..(195): unsure at all Xaa locations
  Clone ID: PAT_MRT3847_54011C.1.pep
  unsure (1)..(195): unsure at all Xaa locations
MSLKIAAEIYPKSPSETVKEPLVVVKEYDEDRHKVAVERLERLCEVGQSGKPSLVTDLMGDPICRIRHFQLHVMLVAEYGEEGEVVGVIRGCVKTVTRGNSVYIKLAYILGLRVSPRHRRFGIGTKLVEHLXEWCKQKGSKYAYMATDCTNEPSVNLFTRKCGYSKFRTLTILVQPVHAHYKPISSNVAVLRLPP

SEQ ID NO: 3872 - protein, 50 aa, Glycine max
  Clone ID: PAT_MRT3847_54023C.1.pep
VKPPQAPPKLILQCRLKANLNKSVFGPNSFYNSAPDWCILKFDPLLLFLA

SEQ ID NO: 3873 - protein, 496 aa, Glycine max
  Clone ID: PAT_MRT3847_54836C.1.pep
MATSDSNMLLNYVPVYVMLPLGVVNVDNVFEDPDGLKEQLLQLRAAGVDGVMVDVWWGIIELKGPKQYDWRAYRSLFQLVQECGLTLQAIMSFHQCGGNVGDIVNIPIPQWVLDIGESNHDIFYTNRSGTRNKEYLTVGVDNEPIFHGRTAIEIYSDYMKSFRENMSDFLESGLIIDIEVGLGPAGELRYPSYPQSQGWEFPGIGEFQCYDKYLKADFKAAVARAGHPEWELPDDAGKYNDVPESTGFFKSNGTYVTEKGKFFLTWYSNKLLNHGDQILDEANKAFLGCKVKLAIKVSGIHWWYKVENHAAELTAGYYNLNDRDGYRPIARMLSRHHAILNFTCLEMRDSEQPSDAKSGPQELVQQVLSGGWREDIRVAGENALPRYDATAYNQIILNARPQGVNNNGPPKLSMFGVTYLRLSDDLLQKSNFNIFKKFVLKMHADQDYCANPQKYNHAITPLKPSAPKIPIEVLLEATKPTLPFPWLPETDMKVDG

SEQ ID NO: 3874 - protein, 109 aa, Glycine max
  UNSURE (1)..(109): unsure at all Xaa locations
  Clone ID: PAT_MRT3847_54862C.1.pep
  unsure (1)..(109): unsure at all Xaa locations
MSKARVYTVVNVLRPKEYWVYXCLTAQWGDQDDYEVVRKEGRGKYREVFEGINVHSNERCIINILKPVKRKTIXREIEILQNLCGGPNIVKLLDIGRDQHCKTPSLISE

SEQ ID NO: 3875 - protein, 476 aa, Glycine max
  Clone ID: PAT_MRT3847_55132C.1.pep
MGGGFRVLHLVRPFLSFLPEVQTADRKVPFREKVIYTVISLFIFLVCSQLPLYGIHSTTGADPFYWMRVILASNRGTVMELGITPIVTSGLVMQLLAGSKIIEVDNNVREDRALLNGAQKLLGILIAVGEAVAYVLSGMYGSVGQLGVGNAILIILQLCFAGIIVICLDELLQKGYGLGSGISLFIATNICENIIWKAFSPTTINSGRGAEFEGAVIALFHLLITRTDKVRALREAFYRQNLPNVTNLLATVLIFLIVIYFQGFRVVLPVRSKNARGQQGSYPIKLFYTSNMPIILQSALVSNLYFISQLLHRKYSGNFFVDLLGKWKESEYGGGQSVPVGGIAYYITAPSSLADMAANPFHALFYLVFMLSACALFSKTWIEVSGSSARDVAKQLKEQQMVMPGHRESNLQKELNRYIPTAAAFGGICIGALTVLADFMGAIGSGTGILLAVTIIYQYFETFEKERASELGFFGF

SEQ ID NO: 3876 - protein, 463 aa, Glycine max
  Clone ID: PAT_MRT3847_5638C.1.pep
MDKKEHIAIFTTASLPWLTGTAVNPLFRAAYLAKSGERDVTLVIPWLSLKDQRLVYPNNITFASPSEHEKYICQWLEERVGFTSGFSIQFYPGKFSRDKRSILAVGDISEIIPDKVADIAVLEEPEHLTWYHHGKRWKTKFRLVIGIIHTNYLEYVKREKNGVMQAFLLKYLNNWVVSIYCHKVIRLSAATQDYTGSIICNVHGVNPKFLEIGNTAARRRQKGEHAFTKGAYFIGKMIWSKGYKELLQLLKDHEKELSALEVDLFGSGEDSDEVQKAAEKLELAVRVHPARDHADALFHDYKLFLNPSTTDVVCTTTAEALAMGKIVVCANHPSNDFFKQFPNCWTYDDDDGFVKLTLKALAEQPAQPTDAQRHDLSWEAATKRFLKAADLDKPLERKLSRTTSNFLAASLNLQEKVDEASAYVHHVASGFEVSRRIFGAIPDSLQPDEELRKELGLTDASTK

SEQ ID NO: 3877 - protein, 116 aa, Glycine max
  UNSURE (1)..(116): unsure at all Xaa locations
  Clone ID: PAT_MRT3847_56602C.1.pep
  unsure (1)..(116): unsure at all Xaa locations
GSQKAKAATHVSKAKPGEYIHYASQKAKETKDKTMEDAGEYTDXASQKANETKDNTMVNASEYTDYASHXTRTEAKDMTMGKGREYKDYTASKANXGKDATANKMGESKDYTADKA

SEQ ID NO: 3878 - protein, 536 aa, Glycine max
  Clone ID: PAT_MRT3847_5686C.1.pep
MRGACQTEVGFGRQGLVLSQSKREVMANIDIEGILKQQQPYDGRVPKTKIVCTLGPASRSVEMTEKLLRAGMNVARFNFSHGTHDYHQETLNNLKTAMHNTGILCAVMLDTKGPEIRTGFLKDGKPIQLKEGQEVTITTDYDIKGDPEMISMSYKKLPVHLKPGNTILCSDGTITLTVLSCDPDAGTVRCRCENTATLGERKNVNLPGVVVDLPTLTEKDKEDILGWGVPNKIDMIALSFVRKGSDLVNVRKVLGPHAKNIQLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATERALCKPGDAVVALHRIGAASVIKICIVK

SEQ ID NO: 3879 - protein, 73 aa, Glycine max
  Clone ID: PAT_MRT3847_56902C.1.pep
FVRCLIIPCSFCLLVLVKVLKEASVCRKGRKITFLLHKLFVRLCDIQQRCKAKNLCKWARRDISKWATLKWKM

SEQ ID NO: 3880 - protein, 160 aa, Glycine max
  Clone ID: PAT_MRT3847_57413C.1.pep
MSDEEHHFDSQADAGASKTYPQQAGTIRKNGYIVIKSRPCKVVEVSTSKTGKHGHAKCHFVAIDIFNGKKLEDIVPSSHNCDVPHVNRTDYQLIDISEDGFVSLLTDNGNTKDDLKLPTDEALLAQIKDGFSEGKDLVVSVMSAMGEEQICSLKDIGPKN

SEQ ID NO: 3881 - protein, 259 aa, Glycine max
  Clone ID: PAT_MRT3847_57838C.1.pep
MSAEKERETQVYLAKLAEQAGRYEEMVECMKKVAKLDLDLTVEERNLLSVGYKNVIGARRASWRIMSSIEQKEESKGNEHNVKLIKSYCQKVEEELSKICGDILTIIDQHLIPSSASAEASVFYYKMKGDYFRYLAEFKTDQERKEAAEQSLKGYEAASATANTDLPSTHPIRLGLALNFSVFYYEIMNSPERACHLAKQAFDEAIAELDTLSEESYKDSTLIMQLLRDNLTLWTSDLPEDGGEDSIKAEETKPSEPEH

SEQ ID NO: 3882 - protein, 239 aa, Glycine max
  Clone ID: PAT_MRT3847_58025C.1.pep
AIREPRVVVQTTSEVDILDDGYRWRKYGQKVVKGNPNPRSYYKCTNAGCTVRKHVERASHDLKSVITTYEGKHNHDVPAARASSHVNANASNAVPGQASLQTHVHRPEPSEVHNGIGRLERPSLGSFNLPGRQQLGPSHGFSFGMNQSMLSNLVMSGLGHAQAKLPVMPVHSFLAAHQQQQQHQQQQNQQQRAANDLGFMLPKGEPNVEAIPERGGLNLSNGSSVYQEIMSRMPLGPHM

SEQ ID NO: 3883 - protein, 151 aa, Glycine max
  Clone ID: PAT_MRT3847_58098C.1.pep
WSPGWSNADKALTAFVNGALIEYSKNRRKADSATTSFLSPHLHFGEVSVKKVFHLVRIKQVFWANEGNKAGEESVNLFLKSIGLREYSRYISFNHPYSHERPLLAHLKFFPWVVNEGYFKAWRQGRTGYPLVDAGMRELWATGWLHDRIRV

SEQ ID NO: 3884 - protein, 308 aa, Glycine max
  Clone ID: PAT_MRT3847_58517C.1.pep
MDGMYGVPAEYADKALMTPENLIFPPDYHHDFLAAGRIPLFGSDEFFSSSAGIHRQQEDDVAATTVMKAKIASHPHYPRLLQAYIECQKVGAPPEIARLLEEIRRENDPCKSDAVSSSTCFGADPELDEFMEAYCDMLVKYKSDLARPFDEATTFLNKIEMQLSHLCTGASVSNVSDDGGVSSDEDLSTGDGDAQDGQLKGEDRELKDRLLRKFGSHIGTLKLEFSKKKKKGKLPKEARQALLQWWNVHYKWPYPTEADKIELAKSTGLDQKQINNWFINQRKRHWKPSENMQFSMMENFNGRILADE

SEQ ID NO: 3885 - protein, 109 aa, Glycine max
  UNSURE (1)..(109): unsure at all Xaa locations
  Clone ID: PAT_MRT3847_5870C.1.pep
  unsure (1)..(109): unsure at all Xaa locations
RCASYLQQQQVPFIQLFAAYPQQFFPFNQLTAVNSRVYLQQHXILPFSQLDGVSPXTILTHPQLWPLYQHIAPNAVSLXQLQQGLPFTHLALSNPPALYQQPIIGGAIF

SEQ ID NO: 3886 - protein, 540 aa, Glycine max
  Clone ID: PAT_MRT3847_58755C.1.pep
MALTLRSSTSFINQKETKVLKTSDNAPAIVSFSKFKPSSSLFRLRAKNSMQEAHHTREKWEKVLAPSVAHSHNDSKRVPVYVMLPLDTVTMGGSLNKPRAMNASLMALKSAGVEGVMVDAWWGLVEKEGPLKYNWEPYAELVQMLQMHGLKLQVVMSFHQCGGNVGDNCSIPLPPWVLEEISKNPELVYTDRSGRRNPEYISLGCDSVPVLNGRTPLQVYSDYMRSFRDKFRDYFGSVIVEIQLGMGPCGELRYPSYPETNGTWRFPGIGEFQCYDKYMKASLAAAAEDIGKKEWGGGGPHDSGQYNQFPEDTGFFKREGTWNTEYGQFFLEWYSGKLLEHGERILVSAKGIFETTGVKLSGKVAGIHWHYRARSHAAELTAGYYNTRNNDGYLPIARMLAKHGVVFNFTCMEMKDREQPDFANCSPEGLVHQVKMATTTARAELAGENALERYDADAYAQVLSTSKSESGSGLAAFTYLRMNKRLFEADNWRHLVDFVRSMSEGGRRERLPAADSHGSDLYVGHIKATQEKHTQEAALV

SEQ ID NO: 3887 - protein, 246 aa, Glycine max
  UNSURE (1)..(246): unsure at all Xaa locations
  Clone ID: PAT_MRT3847_58757C.1.pep
  unsure (1)..(246): unsure at all Xaa locations
MALTLRSSTSFINQKETKVLKTSDDIPATVSFSKFKPLVRLRAKNSMQEAHHTRENSFNEASRSEKWEKVLAPSVAHNHNDSKRVPVYVMLPLDTVTMEGRLNKPRAMNASLMALKSAGVEGVMVDAWWGLVEKDGPLKYNWEPYAELVQMVQMHGLKLQVVMSFHQCGGNVGDNCSIPLPPWVLEEISKNPELVYTDRSGRRNPEYISLGCDSVPVLRGRTPLQVYSDYMRKLRDRFXRYLGSVI

SEQ ID NO: 3888 - protein, 96 aa, Glycine max
  Clone ID: PAT_MRT3847_58C.1.pep
LLGRMLYMAPSDGKWGEHELDYLLFMVRDVKLNPNPEQVADVKYVNRDQLMELLRKADAGEDGVKMSPWFRLVVDNFLMGWWDHVEQGTLQGAADM

SEQ ID NO: 3889 - protein, 73 aa, Glycine max
  Clone ID: PAT_MRT3847_59173C.1.pep
QMMTPNMMSPLTMPSILSPMVLPSMMSQMMMTQCHCDAVSQIMLQQQLPFMFNPMAMTIPPMFLQQPFVGAAF

SEQ ID NO: 3890 - protein, 139 aa, Glycine max
  Clone ID: PAT_MRT3847_59634C.1.pep
KLGVRPPKGVLLYGPPGTGKTLMARACAAQTNATFLKLAGPQLVQMFIGDGAKLVRDAFQLAREKSPCIIFIDEIDAIGTKRFDSEVSGDREVQRTMLELLNQLDGFSSDDQIKVIAATNRADILDPALMRSSRLDRKI

SEQ ID NO: 3891 - protein, 121 aa, Glycine max
  Clone ID: PAT_MRT3847_59716C.1.pep
KVPYGFAPCIMGQVLYFVPRLVIGVFIQVLCSPSPLPRYAFVTQMGAPYKRAIFNERFHQTIFGWAQKAKNRKGLKAYGNFGQGSFQESAKTGIQVGSIFKKAFAPGGSFFPPKADGSNSV

SEQ ID NO: 3892 - protein, 71 aa, Glycine max
  UNSURE (1)..(71): unsure at all Xaa locations
  Clone ID: PAT_MRT3847_60017C.1.pep
  unsure (1)..(71): unsure at all Xaa locations
MAASAPTPREDFVXMANLAEXAERYEEMVEFMEKVSASAESEELTVEERNLLSVAYKNVIGARRASWRIIS

SEQ ID NO: 3893 - protein, 110 aa, Glycine max
  Clone ID: PAT_MRT3847_60180C.1.pep
MAAAKLQALWNHPAGPKTIHFWAPTFKWGISIANIADFSKPPEKLSYPQQIAVTATGIIWSRYSTVITPKNWNLFSVNIAMAGTGLYQLSRKLRHDYSSEAEAEVAVTKE

SEQ ID NO: 3894 - protein, 477 aa, Glycine max
  Clone ID: PAT_MRT3847_60398C.1.pep
MWSSTSSTAAIPSDEEPSESSSSSSFSTSLFNFSSGNPRIEETRGLMHLFPDDTPSTLPVGRKPLVCVVGVPNHMTYADFCQFCGSFIQHMLEMRIVRMDGMEDQYSVLVRFDDQDSTDSFYKHYNGRRFSSLEVEVCRVLFTLDVQYTGSIEHAQPSNATSTELPTCPVCLERLDQDTGGILTTICNHSFHCSCISKWADSSCPVCRYCQQQAEKSICFVCQTTENLWICVICGYVGCGRYKGGHAIIHWKETQHCYSLEVETKRVWDYVGDNYVHRLIQSKTDGKLIELNTQCAHADNGCGSCSCEDNAMNEAILNSKVEAIVNEYNELLATQLENQKLYFESLLQEVKEESERKISKAVQKAISLKQQKIQSKIDRCKKEKKFLDDLNENLVKNEDIWKTKILAIEEREKKTTRLMGDRVADLEMQLGDLMVCLEGGRTVEQLAASDEIKEGIILDKSIESSTTSGSDLVGRDA

SEQ ID NO: 3895 - protein, 297 aa, Glycine max
  Clone ID: PAT_MRT3847_60645C.1.pep
MVSGNIFHCRKNSWPPQEYISKSTLQLFDYDSSAPPEQAWRRRLNSHANLLKEFRVTFTEAIKMVRLGIRIWSYVREEASHGRKAPIDPFTRESCKPSASQGVPLGGMGSGSISRGFRGEFRQWQIIPSLCEASPVMSNQFSIFISGEGGNKNFASVLAPGQHEGLGSSRKPDDQGISSWGWNLSGQHSTYHALFPRAWTVYDGEPDPELKISCRQISPFVPHNYRESSLPAAVFVYTLVNTGKERAKVSLLFTWANSIGGSSHLSGDHVNEPFKAEDGVSGDFYSQDSKGTLCTFA

SEQ ID NO: 3896 - protein, 544 aa, Glycine max
  Clone ID: PAT_MRT3847_60792C.1.pep
MSSSESQDPAAAAASSEAQVSKKAAKKEAAKLEKLRRRQEIAAASAATANLSVDEEDPLGGNYGDVPLVELQSKTSADVGEWTRVEALGGALENRSVLIRGRAQAIRPVGKKMAFLVIRENGFTVQCLVQAQPDTVSAQMVKFAAALSRESIVDVEGVVSVPTAPIKGATQQVEIQVRKLYCVSRAVPTLPINLEDAARSEVEIEKALQAGEQLVRVNQDTRLNFRVLDVRTPANQGIFRIQSQVGNAFRQFLVSQGFCEIHTPKLIAGSSEGGAAVLSLDYKGQPACLTQSPQLHKQMSICGDFGRVFEIGPVFRAEDSYTHRHLCEFTGLDVEMEIKKHYFEVMDLVDRLFVAMFDSLNQNCKKDLEAVGSQYPFEPLKYLRKTLRLTYEEGIQMLKDVGVEIEPYGDLNTEAERKLGQLVLEKYGTEFYILHRYPLAIRPFYTMPCYDNPAYSNSFDVFIRGEEIISGAQRVHVPEFLEQRAAACGIDVKTISSYIDSFRYGAPPHGGFGVGLERVVMLFCGLNNIRKTSLFPRDPLRIAP

SEQ ID NO: 3897 - protein, 307 aa, Glycine max
  Clone ID: PAT_MRT3847_60871C.1.pep
MKWESITLSSPTSCTPNSNTNWLVENNSRSTKWTPEENKLFENALAVHDKDTPDRWHKVAEMIPGKTVVDVIRQYKELEVDVSNIEAGLIPVPGYSSTAISPFTLDWVNTPGYDGFKGCGKRPSSVRPIEHERKKGVPWTEEEHKLFLLGLKKYGKGDWRNISRNFVITRTPTQVASHAQKYFIRQLSGGKDKRRASIHDITTVNLTETITTSCSEDTNRSTSPHVLSQPQQQNSTPTTPRTHFQWTNQSNTGVAMTLNPAHERVFMSPYGANSFGVKIEGQNLHESSYLGPQTQNMVFQMQQSSQH

SEQ ID NO: 3898 - protein, 72 aa, Glycine max
  Clone ID: PAT_MRT3847_60948C.1.pep
MASYQKHYDDQGRKVDEYGHVENQSDEYGNPVHADSDSYVDTRTAAGRYCDDIYKQHDTTSAYGVHTGRQHS

SEQ ID NO: 3899 - protein, 321 aa, Glycine max
  Clone ID: PAT_MRT3847_6094C.1.pep
MKWEMEILPPASPYMYNSNWLLDDNRTNNTKWTPAENKLFENALAVYDRDTPDRWHKVAEMIPGKTVMDVVKQYKELEADVCDIEAGLIPIPGYSSGTTTTSPFTLDWVNTSPAYDDGFKGITAKRSSSGRPLEQERKKGVPWTEEEHKLFLLGLKKYGKGDWRNISRNYVITRTPTQVASHAQKYFIRQLSGGKDKRRASIHDITTVNLTETTRTSSDESKRSASPQNSAMLSRHQQLNSNAASSGLNFQWSDQPNAGVAMALNPAHEQVFMSPYGLNSYGFKMQGQNLHRSSLHESSYLGPQTPNMVFQMQPSQHYSHA

SEQ ID NO: 3900 - protein, 50 aa, Glycine max
  UNSURE (1)..(50): unsure at all Xaa locations
  Clone ID: PAT_MRT3847_6220C.1.pep
  unsure (1)..(50): unsure at all Xaa locations
TWLGVNPGGCARXAGYRKEHRQHAQFHGVQNEKKGFMDKIKGKLPGGPRD

SEQ ID NO: 3901 - protein, 350 aa, Glycine max
  Clone ID: PAT_MRT3847_62243C.1.pep
MREFDSSVLVVLSSFLDVSVNTLSKAAMKKGMNDFVFIMYSNAFAACLLLLLALFFYRKRTLPPLSCNTLGLFLVVGMLSCINQSIKFFGIGYSSPTLASALSDLVPAFTFILAVIFRMEKLDWKANSTLAKSIGTVVSIAGALLLSLYKGQVIINNNPPFKLFPQKLVSSMQFDWVFGALLLAAHSCFLSINYILLTRIVREYPAELVVVLSRIALTSILSVPAALISVKDLKALRLGFNMELIAIGCSAIFVLSFRGVIHIWIMGKRGPVYVAMFKPLEIVFAVILGVTFLGDSLYIGSVIGAAIIVVGFYAVIWGKSQEKVEEDCTVCSSESYDNEVPLLQNKRTGE

SEQ ID NO: 3902 - protein, 68 aa, Glycine max
  UNSURE (1)..(68): unsure at all Xaa locations
  Clone ID: PAT_MRT3847_62711C.1.pep
  unsure (1)..(68): unsure at all Xaa locations
MAAXXXXPXXXFVYMXKXAEQAERYEEXVXFMXKVSXSAESXEXTVEEXNLLSXAXKXVIXARRASWX

SEQ ID NO: 3903 - protein, 149 aa, Glycine max
  UNSURE (1)..(149): unsure at all Xaa locations
  Clone ID: PAT_MRT3847_63030C.1.pep
  unsure (1)..(149): unsure at all Xaa locations
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERAXKEPKSPSKATKSPKKA

SEQ ID NO: 3904 - protein, 149 aa, Glycine max
  Clone ID: PAT_MRT3847_63031C.1.pep
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKSERASKEPKSPSKATKSPKKA

SEQ ID NO: 3905 - protein, 149 aa, Glycine max
  Clone ID: PAT_MRT3847_63035C.1.pep
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERASKEPKSPSKATKSPKKA

SEQ ID NO: 3906 - protein, 149 aa, Glycine max
  Clone ID: PAT_MRT3847_63039C.1.pep
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERAAKEPKSPSKATKSPKKA

SEQ ID NO: 3907 - protein, 146 aa, Glycine max
  UNSURE (1)..(146): unsure at all Xaa locations
  Clone ID: PAT_MRT3847_63148C.1.pep
  unsure (1)..(146): unsure at all Xaa locations
SAPCVLFFDELDSIATQRGSSGGDAGGAADRVLNQLLTEMDGMNAKKTVFIIGATNRPDIIDSALLRPGRLDQLIYIPLPDQESRYQIFKACMKKSPVSKDVNLGALAEYTKGXSGADITEICQRACKYAIRENIEKDIEHERKRR

SEQ ID NO: 3908 - protein, 479 aa, Glycine max
  UNSURE (1)..(479): unsure at all Xaa locations
  Clone ID: PAT_MRT3847_63328C.1.pep
  unsure (1)..(479): unsure at all Xaa locations
MMENGGKQTFEVSNDTLQRVGSKSFDDDGRLKRTGTIWTASAHIITAVIGSGVLSLAWAIAQLGWIAGPVVMILFSIVTYYTSTLLATCYRSGDQLSGKRNYTYTQAVRSYLGGFSFKFCGXVQYANLFGVAIGYTIAASISMMAVKRSNCYHSSGGKNPCKMNSNWYMISYGVAEIIFSQIPDFHELWWLSIVAAVMSFTYSFIGLGLGIGKVIGNGRIKGSLTGVTIGTVTESQKIWRTFQALGNIAFAYSYSMILIEIQDTIKSPPAESETMSKATLISVLVTTVFYMLCGCFGYASFGDASPGNLLTGFGFYNPFWLIDIANAGIVIHLVGAYQVYCQPLFSFVESNAAERFPNSDFMSREFEVPIPGCKPYKLNLFRLVWRTLFVILSTVIAMLLPFFNDIVGLIGAIGFWPLTVYLPVEMYITQTKIPKWGIKWIGLQMLSVACFVITILAAAGSIAGVIDDLKVYKPFVTSY

SEQ ID NO: 3909 - protein, 84 aa, Glycine max
  Clone ID: PAT_MRT3847_63488C.1.pep
MKVKILQWHAIASWTWDAQDETCGICRMAFDGCCPDCKLPGDDCPLIWGVCNHAFHLHCILKWVHSQTSQAHCPMCRREWQFKG

SEQ ID NO: 3910 - protein, 61 aa, Glycine max
  Clone ID: PAT_MRT3847_63655C.1.pep
LPRRVRKVGRVSIAIPIMSHPIPTSDDTHSVQIIIPHIQMGLKSNMYLFCCSYTHIAATKG

SEQ ID NO: 3911 - protein, 53 aa, Glycine max
  Clone ID: PAT_MRT3847_63797C.1.pep
LCCLLKNPTPVRVWLLKSFSMIKRKKFIAVTEKEDSLNENQPSVGMCSRAYGK

SEQ ID NO: 3912 - protein, 188 aa, Glycine max
  Clone ID: PAT_MRT3847_6427C.1.pep
MEATSAATVPTTFYMSPSQSHLSNFGMCYGVGENGNFHSPLTVMPLKSDGSLCILEALKRSQTQVMVPTSSPKLEDFLGGATMGTHEYGSHERGLSLDSIYYNSQNAEAQPNRDLLSQPFRQQGHMSVQTHPYYSGLACHGLYQAPLEEETTKETHVSDCSSLMPMTEGLKNWVAPTREFFTHQQVLE

SEQ ID NO: 3913 - protein, 48 aa, Glycine max
  UNSURE (1)..(48): unsure at all Xaa locations
  Clone ID: PAT_MRT3847_64305C.1.pep
  unsure (1)..(48): unsure at all Xaa locations
TTSLSKTTXASYXKHYDDQGRKXDEXGNXEKQTDEYGNPVXAASXTXX

SEQ ID NO: 3914 - protein, 148 aa, Glycine max
  Clone ID: PAT_MRT3847_65269C.1.pep
NEALRINVLFRHIQNMLSSHTTVIAEAGDTWFTCQKLKLPQGCGYEFQMQYGSIGWSVGATLGYAQAAPHKRVIACIGDGSFQMTVQEVSTMLRCEQNGIIFLINNGGYTTEVEIHDGPYNVIKNWDYAGLVERLDNGESKCWTAKVL

SEQ ID NO: 3915 - protein, 244 aa, Glycine max
  Clone ID: PAT_MRT3847_65615C.1.pep
MDSFNSFFDSTNRWNYDTLKNFRQISPVVQNHLKQVYFTLCFAVVAAAVGAYLHVLLNIGGFLTTVACVGSSVWLLSTPPFEERKRVTLLMAASLFQGASIGPLIDLAIQIDPSLIFSAFVGTSLAFACFSGAALVARRREYLYLGGLVSSGLSILLWLHFASSIFGGSTALFKFELYFGLLVFVGYIVVDTQEIVERAHLGDLDYVKHALTLFTDLVAVFVRILVIMLKNSTERNEKKKKRRD

SEQ ID NO: 3916 - protein, 104 aa, Glycine max
  Clone ID: PAT_MRT3847_65785C.1.pep
PRVLFNEDLVVVHDALEFGHCRLSLAVPKEGIFENIHTMEDLLKMSEWTEERPLRVVTGFGYLGDKFLREKGFKHVSFLSADGALESYPPVSLLPLHLFSFLFP

SEQ ID NO: 3917 - protein, 376 aa, Glycine max
  Clone ID: PAT_MRT3847_65831C.1.pep
MSLLSDLINLNLSDTTEKVIAEYIWIGGSGMDLRSKARTLPGPVSDPSELPKWNYDGSSTGQAPGEDSEVILYPQAIFRDPFRRGNNILVICDAYTPAGEPIPTNKRHAAAKVFSHPDVVAEVPWYGIEQEYTLLQKDIQWPLGWPVGGFPGPQGPYYCGVGADKAFGRDIVDAHYKACIYAGINISGINGEVMPGQWEFQVGPSVGISAGDEIWAARYILERIIEIAGVVVSFDPKPIKGDWNGAGAHTNYSTKSMREDGGYEVIKAAIDKLGKKHKEHIAAYGEGNERRLTGRHETADINTFLWGVANPLSPSTLTLSPRALLPPSRALLSPSRALLTLAAPSLSKPPPASFRWLVTPHRISKQRLCLTRSLST

SEQ ID NO: 3918 - protein, 757 aa, Glycine max
  Clone ID: PAT_MRT3847_66342C.1.pep
MWKLKFAEGGNPWLRTLNNHVGRQVWEFDPKLGSPQDLLEIEKARQNFHDNRFTHKHSADLLMRMQFARENPTREVLPKVGVKDIEDVTQEIVTKTLRRAVSFHSTLQCHDGHWPGDYGGPMFLMPGLVITLSITGALNTVLTEEHRKEICRYLYNHQNKDGGWGLHIEGPSTMFGSVLSYITLRLLGEGPNDGQGEMEKARDWILGHGGATYITSWGKMWLSVLGVYEWSGNNPLPPEIWLLPYMLPFHPGRMWCHCRMVYLPMSYLYGKRFVGPISPTVLSLRKELYTVPYHDIDWDQARNLCAKEDLYYPHPLVQDILWASLHKFLEPILMHWPGKRLREKAIISALEHIHYEDENTRYICIGPVNKVLNMLCCWVEDPNSEAFKLHLPRIYDYLWIAEDGMKMQGYNGSQLWDTAFAVQAIIASNLIEEFGPTIRKAHTYIKNSQVLEDCPGDLNKWYRHISKGAWPFSTGDHGWPISDCTAEGLKAVLLLSKIAPEIVGEPIDVKRLYDSVNVILSLQNEDGGFATYELKRSYNWLEIINPAETFGDIVIDYPYVECTSAAIQALASFRKLYPGHRREEIQHCIDKATTFIEKIQASDGSWYGSWGVCFTYGAWFGVKGLIAAGRSFSNCSSIRKACEFLLSKQLPSGGWGESYLSCQNKVYSNLEGNRSHVVNTGWAMLALIDAGQAKRDSQPLHRAAAYLINSQLEDGDFPQQEIMGVFNKNCMITYAAYRNIFPIWALGEYQSQVLQSR

SEQ ID NO: 3919 - protein, 158 aa, Glycine max
  Clone ID: PAT_MRT3847_6668C.1.pep
FGSSGSVSSLAWFMSNQETSFVTIGQRVLARPLKVRFHYGHPDVFDRIFHITRGGISKASCGINLSEDIFAGFNSTLRRGNITHHEYIQCGKGRDVGLNQISLFEAKVACGNGEQTLSRDIYRLGHRFDFFRMLSCYFTTIGFYISSMIVGLTCYAFL

SEQ ID NO: 3920 - protein, 59 aa, Glycine max
  Clone ID: PAT_MRT3847_66759C.1.pep
TSVHKWSCCRGMTFREVVTEPMRSGNRDSTCCDFASRTRLEPWRVQSCTAKWILGKVKW

SEQ ID NO: 3921 - protein, 260 aa, Glycine max
  UNSURE (1)..(260): unsure at all Xaa locations
  Clone ID: PAT_MRT3847_66975C.1.pep
  unsure (1)..(260): unsure at all Xaa locations
MAAAPSPREENVYMAKLAEQAXERYEEMVEFMEKVSAAADNEELTVEERNLLSVAYKNVIGARRASWRIISSIEQKEESRGNEDHVSVIRDYRSKIESELSNICDGILKLLDSRLIPSASSGDSKVFYLKMKGDYHRYLAEFKTGAERKEAAESTLSAYKAAQDIANAELPPTHPIRLGLALNFSVFYYEILNSPDRACNLAKQAFDEAIAELDTLGEESYKDSTLIMQLLRDNLTLWTSDMQDDGADEIKEAAPKQDDQ

SEQ ID NO: 3922 - protein, 192 aa, Glycine max
  Clone ID: PAT_MRT3847_67765C.1.pep
WRIVCPSPIIETRNNNLEMQSVNNKSLIEELDKLLERLRVPSEYATNLTGGSFDEARMLQNVEACEWLTSALRGLGVPNLDPSYANMRTVKEKRAELEKLKSTFVRRASEFLRNYFASLVDLMISDKSYFSQRGQLKRPDHADLRYKCRTYARLLQHLKSLDKNCLGPLIKAYCSSLNLLLRRELFSLCFLF

SEQ ID NO: 3923 - protein, 59 aa, Glycine max
  Clone ID: PAT_MRT3847_68206C.1.pep
LKASIPTTINSGRGAEFEWAVIALFHLLITSTARVRALREAFYRQNLPYVTNLLATVLV

SEQ ID NO: 3924 - protein, 103 aa, Glycine max; identical to SEQ ID NO: 3555
  Clone ID: PAT_MRT3847_68258C.1.pep

SEQ ID NO: 3925 - protein, 244 aa, Glycine max
  Clone ID: PAT_MRT3847_68261C.1.pep
QNLSKEEFVHILRRQSTGFSRGSSKYRGVTLHKCGRWEARMGQFLGKKAYDKAAIKCNGREAVTNFEPSTYEGELKSAAINEGGSQNLDLNLGIATPGPPKENWGQLQFPSFPYNTHGGRSSMMETNVSSGIGNPSLKRMVATEDRPSLWNGMSPNFFPNGQERAERIGVDPSNGLPNWAWQTHGQVNATPVPTFSAAASSGFSISATFPSAAIFPTSSMNSIPQSLCFTSSSMPTRNASEYYY

SEQ ID NO: 3926 - protein, 44 aa, Glycine max
  Clone ID: PAT_MRT3847_69342C.1.pep
NIISLIKGWCYHENSYYMCEIAIRSHIPHNILSGNIKFKSWGSL

SEQ ID NO: 3927 - protein, 584 aa, Glycine max
  Clone ID: PAT_MRT3847_69622C.1.pep
GGGHLVYLEIGDGILQEVKHAQLEYEISCLDINPIGENPNHSNLAAVGMWTDISVRIFSLPDLSLITKEQLGGEIIPRSVLLCAFEGISYLLCALGDGHLLNFMLNTSTGELTDRKKVSLGTQPITLRTFSSKNTTHVFAASDRPTVIYSSNKKLLYSNVNLKEVSHMCPFNSAAFPDSLAIAKEGELTIGTIDDIQKLHIRSIPLGEHARRICHQEQSRTFAICSLKYNPASGEDSEMHFVRLLDDQTFEFISTYSLDTYEYGCFIISCSFSDDNNVYYCVGTAYVLPEENEPTKGRIIVFAVEDGKLQLIAEKETKGAVYCLNAFNGKLLAAINQKIQLYKWVLRDDGTHELQSECGHHGHILALYVQTRGDFIVVGDLMKSISLLIYKHEEGAIEERARDYNANWMSAVEIVDDDIYLGAENSFNLFTVRKNSEGATDEERGRLEVVGEYHLGEFVNRFRHGSLVMRLPDSDVGQIPTVIFGTINGVIGVIASLPHEQYVFLEKLQSNLRKVIKGVGGLSHEQWRSFNNEKKTVEARNFLDGDLIESFLDLNRSKMDEISKAVDVSVEELCKRVEELTRLH

SEQ ID NO: 3928 - protein, 82 aa, Glycine max
  Clone ID: PAT_MRT3847_69723C.1.pep
PGSTHAVRKKKKKKKKKKKKKKKKKKKKKKKKKKKKKKKKKKKKKKKKKRGGRLKEPNLNTPGFQRKIFLLGPPKLNSWPGF

SEQ ID NO: 3929 - protein, 367 aa, Glycine max
  Clone ID: PAT_MRT3847_69851C.1.pep
MGAGLVAFLLMVLVQLVYAVMNITSKLAIESGMSPLVLVAYRQLFATVSIAPFAYWLEWNTLPRITQRLMIQILFSSLTGVTGNQMLYFVGLKYSSATIACALTNLLPAFTFILAVLFRQENLGIKKRAGLAKVFGTILCVSGALLLSFYHGKTIGLGQSSIHWRYAEKMEGTSSSGKGNMFLGPLVVILSTLVWAAWFIIQKDISKTFPAPYTSTGLMCFMASFQCVIIAVCVDHRASAWSLHNAMRLSSALYAGIFCTGLAYCLMSWTIERKGPLYVSVFTPLQLVLTAILSWALLREKLYVGTAVGSLLIVLGLYSVLWGKSEEVNKGDGIEEDAVKEAVKDSKNDMELQSYVPSNGNNGRVIA

SEQ ID NO: 3930 - protein, 352 aa, Glycine max
  Clone ID: PAT_MRT3847_71429C.1.pep
QFLSVSFFTASMELDGVLLGMCNPLLDISAVVDDAFLQKYGIKLNDAILAEDKHKPMYEELANNPNVEYIAGGATQNSIRVAQWMLQAPGATSYIGCIGKDKFGEEMKKKCTLDGVKVNYYEIDNTPTGTCAVCVVGGERSLVANLSAANCYKSEHLTRPENWALVEKAKYFYISGFFLTVSPDSIQLVAEHAAANNKFFMMNLSAPFICEFFKDALNKVLPYMDYVFGNETEARTFSKAQGWETDNVEEIALKISQLPKASETHKRITVITQGADPVCVAEDGKVKIYPVIPLPKEKLVDTNGAGDAFVGGFLSQLVKHKPIEECIRAGCYAANVIIQRPGCTYPPTPDFH

SEQ ID NO: 3931 - protein, 37 aa, Glycine max
  Clone ID: PAT_MRT3847_71501C.1.pep
IFCLIMLLGASASAATASIFPQCSQAPIASLLPHTSH

SEQ ID NO: 3932 - protein, 44 aa, Glycine max
  Clone ID: PAT_MRT3847_72097C.1.pep
NFFPSKSFVGGSQTLPFAVGLVWESRVIFKLLKVKWTFFQPFPP

SEQ ID NO: 3933 - protein, 49 aa, Glycine max
  UNSURE (1)..(49): unsure at all Xaa locations
  Clone ID: PAT_MRT3847_72935C.1.pep
  unsure (1)..(49): unsure at all Xaa locations
LQSTHTIGIGHALNFSVIYYEIXNSPERACHLAKQAFDEAIAELNTLSE

SEQ ID NO: 3934 - protein, 283 aa, Glycine max
  Clone ID: PAT_MRT3847_73198C.1.pep
MEDPSAATTLLLNSEYSRLFVEDTDLYNRIVLGTLLPHFVWGPLPHFLQTWLRNYLGGVLLYLLSGLLWCFYIYYWKRNVYVPKDAIPSRRAMLLQISVAMKAMPWYTLLPTVSEYLVETGWTKCYPRLYNVGWLAYLVYLAIYLSIVEFGIYWMHRELHDIKPLYKYLHATHHIYNKQNTLSPFAGLAFHPLDGILQALPHSLCLFFMPIHFTTHLVLIFIEGIWTANIHDCIHGKLWPVMGAGYHTIHHTTYRHNYGHYTIWMDWLFGTLHNPEEDEGKAM

SEQ ID NO: 3935 - protein, 266 aa, Glycine max
  Clone ID: PAT_MRT3847_7340C.1.pep
VRNSRGRPTRPGFSYLFAAKSNEELTSIKRAAYLTTSVMKNFVVTKLENVIDEEKKISHSTLMEETEKVILEPSKVNCKLKADNVDICYPPIFQSGGEFDLKPSAVSNDELLHYDSASVIICAVGARYKSYCSNIARTFLIDADPLQSRAYEVLLKAHEAVIGSMKPGNKLSVAYQAAVSVVERDAPDLISYLTKSAGTGIGIEFRESGLNLNAKNEQIIREGMVFNVSLGVQKLQCENSKSKNKQFSLLLADTVIITKDKTEIVT

SEQ ID NO: 3936 - protein, 56 aa, Glycine max
  Clone ID: PAT_MRT3847_73437C.1.pep
FVKVRAFAYKDFIDLALLKNGLVVALVPAMVRVRAKTKPESLTIFQCFWWWDHLIF

SEQ ID NO: 3937 - protein, 389 aa, Glycine max
  Clone ID: PAT_MRT3847_73498C.1.pep
MADLGSASSKRMWCSVPERMQLHLAMLALQFGYAGFHVVSRAALNMGVSKLVFPVYRNIIALLLLLPFAYFLEKKDRPAMTLNFVCQFFLLALVGITANQGFYLLGLENTSPTFASAIQNSVPAITFLMAAILRIEQVRLNRKDGLGKVAGTVLCVVGATVITLYKGPTIYSPTTGVNINNTRVTQVFELGSVSLGDAKGKNWTLGCLYLIGHCLSWSGWLVLQAPVLKKYPARLSVTSYTCFFGLLQFLVIALLLERDAQAWLFHSGGEAFTILYAGVVASGIAFAVQIWCIDRGGPVFVAVYQPVQTFVVAIMASIALGEEFYLGGIIGAVLIVAGLYLVLWGKSEERKFAREQLAIASTEHSIIRPASHAKASLAQPLLSSSTENV

SEQ ID NO: 3938 - protein, 133 aa, Glycine max
  Clone ID: PAT_MRT3847_73499C.1.pep
MADLGSAPSKRMWCSVPERMQLHLAMLALQFGYAGFHVISRAALNMGVSKLVFPVYRNIIALLLLLPFAYFLEKKERPAMTLNFVGQFFLLALVGITANQGFYLLGLDNTSPTFASAIQNSVPAITFLMAVIL

SEQ ID NO: 3939 - protein, 47 aa, Glycine max
  Clone ID: PAT_MRT3847_73971C.1.pep
LRNCSQNKKKAGLKIKIVISNLCVYKPFSFYPIPFHWCPSPQYSVVN

SEQ ID NO: 3940 - protein, 475 aa, Glycine max
  Clone ID: PAT_MRT3847_74475C.1.pep
MMALNISSPAEVKSIFFADSFKSNCLTAKFSGGFAFKRKERRAASGGRVYCSVQATPPPPAWPGRAVPEQGRKTWDGPKPISIVGSTGSIGTQTLDIVAENPDKFKVVALAAGSNVTLLADQVKRFKPQLVAVRNESLIAELEEALHDVEEKPEIIPGEQGIIEVARHPDAVSVVTGIVGCAGLKPTVAAIEAGKDIALANKETLIAGGPFVLPLAQKHNVKILPADSEHSAIFQCIQGLPEGALRRVILTASGGAFRDWPVDKLKDVKVADALKHPNWNMGKKITVDSATLFNKGLEVIETASGGAFNYDHIEIVIHPQSIIHSMIETQDSSVLAQLGWPDMRLPILYTLSWPDRIYCSEVTWPRLDLCKLGSLTFKTPDNVKYPSMNLAFSAGRAGGTMTGVLSAANEKAVEMFIDEKISYLDIFKVVELTCEKHQNELVSSPSLEEIIHYDLWARKYAASLQDSSSFTPILA

SEQ ID NO: 3941 - protein, 103 aa, Glycine max
  UNSURE (1)..(103): unsure at all Xaa locations
  Clone ID: PAT_MRT3847_74488C.1.pep
  unsure (1)..(103): unsure at all Xaa locations
MSGRGKGGKGLGXGGAKRHRKVLRDNIQGITKPAIRRLARMGGVKRISGLIYEETRGVLRIFLDNVIRDAVTYTEHARRKTVTAMDVVYALKRQRGTLYGFGG

SEQ ID NO: 3942 - protein, 83 aa, Glycine max
  UNSURE (1)..(83): unsure at all Xaa locations
  Clone ID: PAT_MRT3847_74583C.1.pep
  unsure (1)..(83): unsure at all Xaa locations
MASYQKHYYDXGXAXVXEYGNVEKQTDEYGNPVHAAXVTYVATRTAAGGYSXDXXXQRDXTNAYXVXTXRQHSSXXYDGDTNK

SEQ ID NO: 3943 - protein, 134 aa, Glycine max
  Clone ID: PAT_MRT3847_75107C.1.pep
MSGKGAKGLITAKNPSSSKDKDKKKPISRSSRAGLQFPVGRIHRLLKSRVTAHGRVGATAAVYSAAILEYLTAEVLELAGNASKDLKVKRITPRHLQLAIRGDEELDTLIKGTIAGGGVIPHIHKSLINKSSKE

SEQ ID NO: 3944 - protein, 131 aa, Glycine max
  UNSURE (1)..(131): unsure at all Xaa locations
  Clone ID: PAT_MRT3847_75209C.1.pep
  unsure (1)..(131): unsure at all Xaa locations
DSWANTWLNSWAHWLKADPRKYLKMKERLVGVSEETTTVVKRLYQMHETGALLFPAINVNDYVTKSKFDNLYGCRHSLPDGLMMATDVMIAGKDAAVCGYGDVLTGCAAALKQCXARVIETEIDPICAVQA

SEQ ID NO: 3945 - protein, 193 aa, Glycine max
  Clone ID: PAT_MRT3847_7526C.1.pep
ITTGYGAAVITAGRGGVEKGSQVAIFGAGCVGLSVIQGAVKQGASKIIVVDVNDSKKEWAKKFGATDFVNPAKDLKEGENIQSRLIDMTDGGCDYTFDCTGNVHVMRSALEACHKGWGESIIIGVAAAGQEISTRPFQLVTGRVWKGCAFGGVKGRSQMGSLVQDYMDNKLKVDEFITHRQPLSGINDAFHDM

SEQ ID NO: 3946 - protein, 182 aa, Glycine max
  Clone ID: PAT_MRT3847_75496C.1.pep
MFSRRSSGRVASGRVALENGVPLPLLPDPKANLQWDEVKPLSGKPYWHSVLSPTNLQPRYNLMPGMNLRSKLPSNEVPTILIYGGKSWDMVYYGQSKQKAFGVTGWKKFVIDNCLRVGDACIFELMESSDKKVILEVQILRGDIPSEWLGNEMIIGQGNEMIIGQENEMIIGHSRENPIVLN

SEQ ID NO: 3947 - protein, 74 aa, Glycine max
  UNSURE (1)..(74): unsure at all Xaa locations
  Clone ID: PAT_MRT3847_75960C.1.pep
  unsure (1)..(74): unsure at all Xaa locations
IQEEIYENCTVYIHAAPGKDEMXYRVDRSGGLVNAXTGIKSDILIQVPNSSTRNDAAQAVKKMRIMEEDEDGMD

SEQ ID NO: 3948 - protein, 469 aa, Glycine max
  Clone ID: PAT_MRT3847_76010C.1.pep
MATAAEKLSALKSAVAGLNEISENEKNGFISLVGRYLSGEAQHVEWSKIQTPTDEVVVPYDTLAPTPEGSSEVKNLLDKLVVLKLNGGLGTTMGCTGPKSVIEVRDGLTFLDLIVIQIENLNSKYGSNVPLLLMNSFNTHDDTQKIVEKYQNSNIEIHTFNQSQYPRLVVEDFLPLPSKGHTDKDGWYPPGHGDVFPSLLNSGKLDALLSQGKEYVFVANSDNLGAIVDLKILNHLIQNKNEYCMEVTPKTLADVKGGTLISYEGRVQLLEIAQVPDEHVNEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARENPENPSIELGPEFKKVSNFLGRFKSIPSIVELDSLKVAGDVWFGAGVILKGKVSIVSKPGVKLEVPDGVAIVDKEINGPEDL

SEQ ID NO: 3949 - protein, 503 aa, Glycine max
  Clone ID: PAT_MRT3847_76330C.1.pep
MNSNNFFHPNKNIFLTLNAVFLFLLFSCFRSLGLFLRCRHPTHNTFTTQHLISLFCHPQNPQSFLLNISDPNKKKQASHGFPDPWLVLVKSTPLPEEDQIEEGLKKMKGSNNRFFTVALVAAWYSSNIGVLLLNKYLLSNYGFKYPIFLTMCHMTACSLLSYVAIAWMKVVPLQSIRSRVQFFKISALSLVFCVSVVFGNISLRYLPVSFNQAIGATTPFFTAVFAYLMTFKREAWLTYLTLVPVVTGVIIASGGEPSFHLFGFIICVAATAARALKSVLQGILLSSEGEKLNSMNLLLYMSPMAVVFLLPATLIMEENVVGITLALARDDSKIIWYLLFNSALAYFVNLTNFLVTKHTSALTLQVLGNAKGAVAVVVSILIFRNPVSVTGMMGYSLTVFGVILYSEAKKRSNERTTFSYTLQLQHLVFVTAQSTSRFLKENLFSMLVIRIQSFLTIIYIFFTHTPDLIERVSRCISNDRCRNSPQNKIAINDVSLLYLCWDN

SEQ ID NO: 3950 - protein, 307 aa, Glycine max
  Clone ID: PAT_MRT3847_76332C.1.pep
MKGSNNRFFTVALVAAWYSSNIGVLLLNKYLLSNYGFKYPIFLTMCHMTACSLLSYVAIAWMKVVPLQSIRSRVQFFKISALSLVFCVSVVFGNISLRYLPVSFNQAIGATTPFFTAVFAYLMTFKREAWLTYLTLVPVVTGVIIASGGEPSFHLFGFIICVAATAARALKSVLQGILLSSEGEKLNSMNLLLYMSPMAVVFLLPATLIMEENVVGITLALARDDSKIIWYLLFNSALAYFVNLTNFLVTKHTSALTLQVLGNAKGAVAVVVSILIFRNPVSVTGMMGYSLTVFGVILYSEAKKRSK

SEQ ID NO: 3951 - protein, 540 aa, Glycine max
  Clone ID: PAT_MRT3847_77498C.1.pep
SSRKFSTDYNRWEEEIEKWQNPILKDETLPEWYKFTLFNELYFLVAGGTIWIDSPVLSSNMRNDQDRVRELESAVVKETEDKMSDRKRTVVESTTDSTYDSAVITGHDRADEKLYEDDDDVGRFLYLEGVEYIMWCTYDVHFYASFALLELFPRIELNIQRDFARAVLCEDGRKVKFLAEGNWGIRKVYGAVPHDLGTHDPWHEMNAYNIHDTSKWKDLNPKFVLQVYRDFATTGDLEFGVDVWPAVRAAMEYMEQFDRDGDGLIENDGFPDQTYDTWTVHGVSTYCGCLWLAALQAAAAMALDLGDREFAEKCKRKFLKAKPAFEEKLWNGTYFNYDSGSSGNSKSIQADQLAGQRWHASSGLPPLFEDSKIKSALRKVYDFNVMKVKGGRMGAVNGMHPNGKVDETCMQSREVWTGVTYGLAATMILAGMEEEAFATAEGIFLAGWSEDGYGYWFQTPEAWTMDGHYRSLMYMRPLAIWGMQYAINRPKAILEAPKINIMDRIHLSPVIGGYSHNETGVRKITTKARCFNNSVFHCAC

SEQ ID NO: 3952 - protein, 445 aa, Glycine max
  Clone ID: PAT_MRT3847_77871C.1.pep
MATIKAVKARQIFDSRGNPTVEVDVILSDGTFHRAAVPSGASTGVYEALELRDGGSDYLGKGVLKAVENVNSIIAPALLGKDPTKQTEIDNFMVQQLDGTVNEWGWCKQKLGANAILAVSLAVCKAGAAVKKIPLYKHIANLAGNKTLVLPVPSFNVINGGSHAGNKLAMQEFMILPVGASSFKEAMKMGVEVYHHLKAVIKKKYGQDATNVGDEGGFAPNIQENKEGLELLKTAIAKAGYTGKVVIGMDVAASEFYDNKDKTYDLNFKEENNDGSQKISGDSLKNVYKSYVTDYTIMSMAIPLFQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRFERLAKYNQLLRIEEELGSAAVYAGAKFRAPVEPY

SEQ ID NO: 3953 - protein, 86 aa, Glycine max
  Clone ID: PAT_MRT3847_78078C.1.pep
GFVTSFNPLCMIIVTTLGPSLLEKPLPLGSIIGGIIIPVGLYSGGWGKAKDYKNDGSSPAPPKETETMRLPIPFPNNKYQPLCVAL

SEQ ID NO: 3954 - protein, 97 aa, Glycine max
  UNSURE (1)..(97): unsure at all Xaa locations
  Clone ID: PAT_MRT3847_7831C.1.pep
  unsure (1)..(97): unsure at all Xaa locations
EKTTVQNHTPLDQMLVPEYSEAFPAQHAASKTPGAILSYSESGYAEVHTXSTVTDHVTNKTISEHLDSNKSKGRYPVDRSSCGSNTAYNWDVETDAL

SEQ ID NO: 3955 - protein, 344 aa, Glycine max
  Clone ID: PAT_MRT3847_7877C.1.pep
MGASSDPTQDGSDEQQKRSEIYTYEAPWHIYAMNWSVRRDKKYRLAIASLLEQYPNRVEIVQLDDSNGEIRSDPSLSFEHPYPPTKSIFIPDKDCHRPDLLATSSDFLRVWHISESSVELKSLLNGNKNSEYCGPLTSFDWNEAEPRRIGTSSIDTTCTIWDIEKETVDTQLIAHDKEVYDIAWGGVGVFASVSADGSVRVFDLRDKEHSTIIYESSEPDTPLVRLGWNKQDPRYMATIIMDSAKVVVLDIRFPTLPVVELQRHQASVNAVAWAPHSSCHICTAGDDSQALIWDLSSMGQPVEGGLDPILAYTAGAEIEQLQWSSSQPDWVAIAFSTKLQILRV

SEQ ID NO: 3956 - protein, 373 aa, Glycine max
  Clone ID: PAT_MRT3847_78923C.1.pep
MALESAPASADIRGVHTHGGGYVQYNIYGNLFEVSRKYVPPIRPVGRGAYGIVCAAVNAETHEEVAIKKVGNAFDNRIDAKRTLREIKLLRHMEHENVIALKDIIRPPQRYNFNDVYIVYELMDTDLHQIIQSNQQLTDDHCRYFLYQLLRGLKYVHSANVLHRDLKPSNLLLNANCDLKIADFGLARTTSETDFMTEYVVTRWYRAPELLLNCSEYTAAIDIWSVGCILGEIITRQPLFLGKDYVHQLRLITELIGSPDDTSLGFLRSDNARRYVRQLPQYPRQQFAARFPSMSPGAVDLLEKMLVFDPNRRITVEEALCHPYLAPLHDINEEPACVRPFSFDFEQPSFTEEDIKELIWRESVLFNPDPPIY

SEQ ID NO: 3957 - protein, 44 aa, Glycine max
  UNSURE (1)..(44): unsure at all Xaa locations
  Clone ID: PAT_MRT3847_7958C.1.pep
  unsure (1)..(44): unsure at all Xaa locations
GIRPEVAECIDKIRVNPGNFADRRAQLXTLEYAEADYQNELEPY

SEQ ID NO: 3958 - protein, 485 aa, Glycine max
  Clone ID: PAT_MRT3847_79740C.1.pep
MALLVEKTTSGREYKVKDLSQADFGRLEIELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEELYEKTGELPDPNSTDNAEFQIVLTIIRDGLKTDPTRYRKMKERLVGVSEETTTGVKRLYQMQANGTLLFPAINVNDSVTKSKFDNLYGCRHSLPDGLMRATDVMIAGKVAVVAGYGDVGKGCAAAMKQAGARVIVTEIDPICALQALMEGLQVLTLEDVVSEADIFVTTTGNKDIIMVDHMRKMKNNAIVCNIGHFDNEIDMLGLENYPGVKRITIKPQTDRWVFPETNTGIIVLAEGRLMNLGCATGHPSFVMSCSFTNQVIAQLELWKEKSTGKYEKKVYVLPKHLDEKVAALHLGKLGAKLTQLSKSQADYISVPVEGPYKPAHYRY

SEQ ID NO: 3959 - protein, 114 aa, Glycine max
  UNSURE (1)..(114): unsure at all Xaa locations
  Clone ID: PAT_MRT3847_80400C.1.pep
  unsure (1)..(114): unsure at all Xaa locations
MRSTMKAQHANGRGSRSPFLTSYALTLAFITFVSVLYFKDFSSTLHRPFLHRPRXHAXPDKSQAGRRAAAERLPFAVGAAPAGCDVGRGEWVYDDAARPWYQEEECPYIQPQLT

SEQ ID NO: 3960 - protein, 658 aa, Glycine max
  UNSURE (1)..(658): unsure at all Xaa locations
  Clone ID: PAT_MRT3847_8046C.1.pep
  unsure (1)..(658): unsure at all Xaa locations
MDPPPLSAATQKNHPESVESFSPCFRVAETWTDETLPAVPGAKLRLMCSYGGHIMPRPHDKSLSYIGGDTRIVVVDRHSSLKDLCSRLSRTILNGRPFTLKYQLPNEDLESLITVTTDEDLDNMVEEYDRIMAKGSASSRLRVFLFFTKPEATVSMGSLLDDAKSETWFVDALNNSGMISRVVSDSAAGDSFVNLDGVGVGGVSASGSSNNLESLPDANKVKNFPEVVQVQSTPGSPMMENSSSSPSFSPSLVNLPPIRVHVDDNGSRLQQENKVGLVVEEQFAQMTIASGVKPDDGLVNVVSSAVAVPVIPASVTMASAGVITTSDNVMNRVVCEDDRSDPGFQKPPLPLQLVQPRTSGGVGLPSPDSVASDSSIAAANSFSKTVYYQDQVQAALLDNKIVAMPNAKSEISDQMIQVQGQLQDSGYTLPPQLDPNKQHFQQQKPFVHASTHYIHHPAATGPVPVSSYYPVYAPPQPQQLHPPIGQQQYPVYVMPVGPTQVTQPYNMALQPNIADPNVVASSRSLMPQSIVTSAAYKDGTPPIYPTKSVSSTMASNSGYAPIPTNQFQPQYVGLHQFHHPPQSIAVAPSSTTTNNNYGYEYGGHVQDQAYYTQQTTTAPLLPQYQSMTPAAAAAALSDASKXFPADNIQQPTRASQPV

SEQ ID NO: 3961 - protein, 67 aa, Glycine max
  UNSURE (1)..(67): unsure at all Xaa locations
  Clone ID: PAT_MRT3847_80550C.1.pep
  unsure (1)..(67): unsure at all Xaa locations
MRKPMEPKXAGGAEXTLARXWXGSRXTTXXYYYASKVXTXPLVXXAKLTLGNSYRANPNHXNLTVPX

SEQ ID NO: 3962 - protein, 50 aa, Glycine max
  Clone ID: PAT_MRT3847_80955C.1.pep
LSAASSESKVLYLKLNGDYHRYLDEFTTGAERKDAAESTLLAYKSAHDIA

SEQ ID NO: 3963 - protein, 463 aa, Glycine max
  Clone ID: PAT_MRT3847_81594C.1.pep
MGVAAESESNDNIPLLLTQSAYPLKRTGTVWTAVAHIVTGVIGSGVLSLPWSTAQLGWLAGPFSILLIASTTLFSSFLLCNTYRHPHPEYGPNRSASYLDVVHLHLGISNGRLSGLLVSISLYGFAIAFVITTAISLRTIQNSFCYHNKGPEAACESVDAYYMLLFGAIQIVLSQIPNFHNIKWLSVVAAIMSFTYSFIGMGLSIAQIIEKGHAEGSIGGISTSNGAEKLWLVSQALGDISFSYPFSTILMEIQDTLKSPPPENQTMKKASVIAVSVTTFLYLSCGGAGYAAFGDNTPGNLLTGFVSSKSYWLVNFANACIVVHLVGSYQVYSQPLFGTVENWFRFRFPDSEFVNHTYILKLPLLPAFELNFLSLSFRTAYVASTPVIAMIFPYFNQILGVLGSIIFWPLTIYFPVEIYLSQSSTVSWTTKWVLLRTFSFFGFLFGLFTLIGCIKGIVTEKIS

SEQ ID NO: 3964 - protein, 333 aa, Glycine max
  Clone ID: PAT_MRT3847_81676C.1.pep
MSSVSKGDRKASIDAASWLFNVVTSVGIILVNKALMATYGFSFATTLTGLHFATTTLLTLILKSLGYIQTSHLPLSDIIKFVLFANFSIVGMNVSLMWNSVGFYQIAKLSMIPVSCFLEVVLDNVRYSRDTKLSIVLVLLGVAVCTVTDVSVNAKGFIAAVIAVWSTALQQYYVHFLQRKYSIGSFNLLGHTAPAQAASLLLVGPFMDYWLTGKRVDAYGYGLTSTLFIILSCTIAVGTNLSQFICIGRFTAVTFQVLGHMKTILVLILGFIFFGKEGLNLHVVLGMIIAIAGMVWYGSASSKPGGKERRSFSLPKTQDYSSLPVSSEPDTKE

SEQ ID NO: 3965 - protein, 384 aa, Glycine max
  Clone ID: PAT_MRT3847_8188C.1.pep
PPIISMATQGQVITCKAAVAWEPNKPLTVQDVQVAPPQAGEVRVQILFTALCHTDAYTWGGKDPEGLFPCILGHEAAGIVESVGEGVTNVQPGDHVIPCYQAECGECKTCKSGKTNLCGKVRSATGVGVMLNDGKSRFSINGKPIYHFMGTSTFSQYTVVHDVSVAKIDPKAPLEKVCLLGCGVSTGLGAVWNTAKVESGSIVAIFGLGTVGLAVAEGAKTAGASRVIGIDIDSKKFDVAKNFGVTEFINPNEHDKPIQQVIIDRTDGGVDYSFECIGNVSVMRAALECCHKGWGTSVIVGVAASGQEISTRPFQLVSGRVWKGTAFGGFKSRSQVPWLVDKYLKKEIKVDEYITHTLTLSEINKAFDLLHEGGCLRCVLSTQE

SEQ ID NO: 3966 - protein, 98 aa, Glycine max
  UNSURE (1)..(98): unsure at all Xaa locations
  Clone ID: PAT_MRT3847_82083C.1.pep
  unsure (1)..(98): unsure at all Xaa locations
FTSRDRRTLXFPAVXPXRXISPXXLVTSLITLXQXXCNFQXXSFXTQRRNARETIXXXSIVLMXLXXIRLXXXSXILSLAELXXXLRXIHXXLQDCTL

SEQ ID NO: 3967 - protein, 192 aa, Glycine max
  Clone ID: PAT_MRT3847_82249C.1.pep
MRFMPLSRLIFRLPRHYTHGPLQSRALQTDSVLKDPQAKPIKYKIPQFYDPYGPRPPPSEKIVQLAEQIEALSEEERGQIMPTLSERLKLPKLQPISTDGMDMGTEGGGAAGLKVEEKKAEKTAFDVKLEKFDAAAKIKVIKEVRAFTNLGLKEAKDLVEKVPVVLKQGVTKEEANEIIEKIKAAGGVAVME

SEQ ID NO: 3968 - protein, 339 aa, Glycine max
  Clone ID: PAT_MRT3847_82360C.1.pep
MGRSPCCDENGLKKGPWTPEEDQKLVQHIQKHGHGSWRALPKLAGLNRCGKSCRLRWTNYLRPDIKRGKFSQEEEQTILHLHSILGNKWSAIATHLPGRTDNEIKNFWNTHLKKKLIQMGFDPMTHQPRTDLVSTLPYLLALANMTDLMDHQTLDEHAIRLQAEAVHLAKLQYLHYLIRSSNSLSTNKSYDQSATTNMEPAAFSLLNSISNVKENPVMLQPADDTPAASLSHGIVSSQPLHHPNVLPHHLLEPQVSFSSQSCLNSEIGQGTNFAIISQGDHTLDLDSSWIIPSITPPNAIGTSANNPGDASSSTSSYGGGPSSYWSELLFEDPILHELS

SEQ ID NO: 3969 - protein, 377 aa, Glycine max
  Clone ID: PAT_MRT3847_82686C.1.pep
MVESIAATSLLGHRPICGGNLTRDVSVKRKSLNTVRFPTTEFLGGGRIVVSLALPKSDKQDRFVFSSIKALAVELTREAHAYREEKLPNRDTKIDRGFDQRPDSWPPANRADKPSLRNPLLRHERMGCGWLGAIFEWEGVLIEDNPDLEKQAWLALSQEEGKPSPPAFILKRIEGMKNEQAISEVLCWSRDPAQLRRMANRKEEIYQSLQGGIYRFLSGSKEFVSVLMHYKIPMALVSTRPRKALESAIGEIGIEDTFSVIVAAEDVHRGKPDPEMFVYAAQLLNFIPERCIVFGNSNLTVEAAHEARMKCVAVASKHPVYELGAADLVVRRLDELSVVDLKNLADIEMTEFGSVEPEMELEVEKDYGSSSVDDNFW

SEQ ID NO: 3970 - protein, 527 aa, Glycine max
  Clone ID: PAT_MRT3847_83093C.1.pep
MHSSHLLLEEPIRMVSILEPSKPNFFPAMTKIVGTLGPKSRSVEVISACLKAGMSVARFDFSWDDPEYHQETLENLKNAIKTTKKLCAVMLDTVGAEMQVVNKSEKAISLEADGQVVLTPDRGQEASSQILPINFDGLAKSMKKGDTIFIGQYLFTGSETTSVWLEVSEVKGQDVVCIIKNTATLAGSLFTLHASQIHIDLPTLTEKDQEVISSWGVKNKIDFLSLSYTRHAEDVRQAREFLSKLGDLSQTQIFAKIENVEGLTHFDEILQEADGIILSRGNLGIDLPPEKVFLFQKSALYKCNMAGKPAVLTRVVDSMTDNLRPTRAEATDVANAVLDGSDAILLGAETLRGLYPIETISTVGRICSEAEKVFNQDLYFKRTVKYVGEPMTHLESIASSAVRAAIKVKASIIICFTSSGRAARLIAKYRPTMPVLSVVIPRLKTNQLKWSFSGAFEARQSLIVRGLFPMLADPRHPAESTSATNESILKVALDHGKALGVIKSHDRVVVCQKLGDASVVKIIELED

SEQ ID NO: 3971 - protein, 502 aa, Glycine max
  Clone ID: PAT_MRT3847_83345C.1.pep
MATTRVVAEQKPKTKIVCTLGPASRSVPMIEKLLRAGMNVARFNFSHGSHEYHQETLDNLRAAMENTGILCAVMLDTKGPEIRTGFLKDSKPIQLIQGNEITISTDYDLKGDEKTICMSYKKLPEDVKPGMVILCADGTISFTVLSCDKQAGLVQCRCENSATLGERKNVNLPGVIVDLPTLTDKDKEDILAWGVPNKIDMIALSFVRKGSDLVEVRKVLGKHAKNIMLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPDLAVQTMAKICIEAESTLDYGDVFKRIMEHSPVPMSPLESLASSAVRTANSARAALILVLTRGGSTAKLVAKYRPGMPILSVVVPELKTDTFDWACSDEAPARHSLIFRGLVPVLSAASARASHAETTEEAIEFAMQHAKSKGLCHNGDSVVALHRVGTASIIKILTVK

SEQ ID NO: 3972 - protein, 139 aa, Glycine max
  UNSURE (1)..(139): unsure at all Xaa locations
  Clone ID: PAT_MRT3847_83406C.1.pep
  unsure (1)..(139): unsure at all Xaa locations
LDSRLIPCFFSGDSEVFYLMRKGDDLRYLAXFKTGAQRLEGAESTVFAYKAAQDIGNAELPPTGPIMLGLALSFSVFYYEILNSPDRACNLAKQACDEAIAELDTLGEESYRDSTVIMQLLRDNLTLWTSDMADDGADE

SEQ ID NO: 3973 - protein, 79 aa, Glycine max
  Clone ID: PAT_MRT3847_83528C.1.pep
KEWHAVASWTWDAQDETCGICRMAFDGCCPDCKLPGDDCPLIWGVCNHAFHLHCILKWVNSQTSQAHCPMCRREWQFKG

SEQ ID NO: 3974 - protein, 84 aa, Glycine max
  Clone ID: PAT_MRT3847_83529C.1.pep
MKVNILQWHAVASWTWDAQDETCGICRMAFDGCCPDCKLPGDDCPLIWGVCNHAFHLHCILKWVNSQTSQAHCPMCRREWQFKG

SEQ ID NO: 3975 - protein, 289 aa, Glycine max
  Clone ID: PAT_MRT3847_83932C.1.pep
MAPPLEHNGVSTSGDSLRSIPTPFLTKTFQLVDDHTIDHVISWNDSGSSFIVWNTTAFAKDLLPKYFKHNNFSSFVRQLNTYGFRKVVPDRWEFSNEYFRRDEKRLLCEIQRRKILPATPPTRATATAAVLSPLPLSTIPPAKLIVSPSNSAEEQVISSNSSPAELLDENDRLRKENILLTKELEEMRSLCNNIFNLMSNYANVQADGGSAGVAARCFGEDAVEEMNPKLFGVVIGTKRAREENDTVLSLHQPFHADVKSEALDFARRGENKKTPWLNQCHRANQRVCN

SEQ ID NO: 3976 - protein, 139 aa, Glycine max
  Clone ID: PAT_MRT3847_84011C.1.pep
MLGEYSDVVRSPRFNGSGSKVSSFRSPLSKLVESVDEGSDGHEDQNESDRVLYAGWNTSSVPSKAMGHSGNASKSAMNRSADEQLPSSMCFVRLSDMSADEWDVFLEKFQELLKEALHESARAAAGQRMKQRLGTLCKF

SEQ ID NO: 3977 - protein, 47 aa, Glycine max
  Clone ID: PAT_MRT3847_84065C.1.pep
FSPPRIGRFELFHHILVHMYFCLHLYFTTHLVHAPLEASVSSISACT

SEQ ID NO: 3978 - protein, 638 aa, Glycine max
  Clone ID: PAT_MRT3847_85713C.1.pep
MNYELLQIVALLTVIAFGGALRKATGACGSDDLEGLMGFKNGIQMDTSGRLAKWVGRSCCEWEGVVCDNATTRVTQINLPGLIEKDLFQTQMVGQLSPSITLLTSLEILDLGGLVGLTGLARETIGLQMPNLQKLYLYGNNLTGPVPESIGDLPRLQELALHENKISGSIPSTIGSLKKLKSLLLYSNQISGTIPFSLGNLTNLVELDVHDNAIMGQVPNSIGQMQALEKLDLSSNMLSGSIPSSLTNLTAISVLYMDTNYLEGTIPFPSRSGEMPSLGFLRLHNNHLSGNIPPSFGYLVSLKRVSLSNNKIEGALPSSLGNLHSLTELYLSDNSFSGQIPKSIGQLSQLIMLNISSNLIEWPLPQEISSLQNLQTLDLSFNPLNLSSIPPWLTSISSLSRISLAGCGIKGQIPDSLQTTQSPIQELDLSGNLLSGSIPSWIGSLSQLYLLNLSSNSLDSHIPESLTNLPDLGVLDLHSNKLTGSIAGVFDTEQGTLTYIDLSDNNFSSGVEAIGVGEQLNIQYLNLSHNLLKGTLPSSLGKLNSIHSLDLSFNELASNLPEMLAKLTLLERLKLQGNHFSGKIPSGFLKLKKLKELDLSDNVLEGEIPEGKPLTDFPGSTYSGNKGLCGKPLNPCKE

SEQ ID NO: 3979 - protein, 373 aa, Glycine max
  Clone ID: PAT_MRT3847_8643C.1.pep
MSAVESAEHNNIRGVPTHGGRYVQYNIYGNLFEVSRKYVPPIRPVGRGAYGIVCAAVNAETGEEVAIKKIGNAFDNRIDAKRTLREIKLLRHMDHANIMSIKDIIRPPQKENFNDVYLVSELMDTDLHQIIRSNQQLTDDHCRYFLYQLLRGLKYVHSANVLHRDLKPSNLLLNANCDLKIADFGLARTTSETDFMTEYVVTRWYRAPELLLNCSEYTAAIDIWSVGCILGEIITRQPLFPGKDYVHQLRLITELIGSPDDASLGFLRSDNARRYVKQLPQYPKQNFSARFPNMSPGAVDLIEKMLIFDPNRRITVDEALSHPYMSPLHDINEEPVCTRPFSFDFEQPSFTEEDIKELIWRESVKFNPATIYV

SEQ ID NO: 3980 - protein, 487 aa, Glycine max
  Clone ID: PAT_MRT3847_86591C.1.pep
MVEMDGVGSKYHQQTLNVSIDIHQQGISKCFDDDGRPKRTGTVWTASAHIITAVIGSGVLSLAWAIAQLGWIAGPIVMVIFSAITYYTSTLLSDCYRTGDPVTGKRNYTYMDAIQSNFGGNGFKVKLCGLVQYINLFGVAIGYTIAASTSMMAIERSNCFHKSGGKDPCHINSNMYMISFGIVEILFSQIPGFDQLWWLSIVAAVMSFTYSTIGLGLGIGKVIENGGVGGSLTGITIGTVTQTDKVWRTMQALGDIAFAYSYSLILIEIQDTVKSPPSESKTMKKASFISVAVTSIFYMLCGCFGYAAFGDASPGNLLTGFGFYNPYWLLDIANAAIVIHLVGSYQVYCQPLFAFVEKHAAQMFPDSDFLNKEIEIPIPGFHPYRLNLFRLVWRTIYVMLSTVISMLLPFFNDIGGLLGAFGFWPLTVYFPVEMYIIQKRIPKWSTKWICLQILSMTCLLMTIGAAAGSIAGIAIDLRTYKPFKTNY

SEQ ID NO: 3981 - protein, 126 aa, Glycine max
  Clone ID: PAT_MRT3847_86809C.1.pep
MRNNKPQLWLSLSLIITCFSFHTSLAALTTISANQSLSGDETLVSQHGNFELGFFNTGNNSNKFYIGMWYKKISQRTYVWVANRDQPVSDKNSAKLTILEGNLVLLDQSQNLVWSTNLSSPSSGSA

SEQ ID NO: 3982 - protein, 307 aa, Glycine max
  UNSURE (1)..(307): unsure at all Xaa locations
  Clone ID: PAT_MRT3847_87205C.1.pep
  unsure (1)..(307): unsure at all Xaa locations
RFRDYLGSVIIEIQVGMGPCGELRYPSYPESNGTWRFPGIGEFQCYDKYMRASLEASTEAIGKKEWGKNGPHDSGQYNQFPEDFSKGXGTWNTEYGQFFLDWYSTKLVEHGEKILVSAKGIFNSCGVKLSAKVAGIHWHYKTRSHAAELTAGYYNTRFRDGYLPIAQMVAKHGVVLNFTCMEMRDREQHEHCSPEGLVHQVKMAARTAGAELAGENALERYDAGAFSQVLSTSNSGSGLAAFTYLRMNRRLFEGDNWRHFVEFVKCMSEGGKRQRLPQSDSCGTHLYVGHITGIQKQQEQAQEVALV

SEQ ID NO: 3983 - protein, 393 aa, Glycine max
  UNSURE (1)..(393): unsure at all Xaa locations
  Clone ID: PAT_MRT3847_87237C.1.pep
  unsure (1)..(393): unsure at all Xaa locations
MATSPLSQLLLSLILLQNFHHSHSFSLSVENHNEDVIVSSPNATFTAGFYPVGENAFCFAIWYTRPPRTVVWMANRDQPVNGKRSTLSLLGTGNLELTDAGQFIVWSTNTATPSKQNPRLHLYDTGNLVLIAILDNSEDHVLWQSFDFPTDTLLPNQPLSKSTNLVSSRSGTNYSSAHRPLFFDFENVLRLMYQGPRVSSVYWPYAWLQSNNFGNGNGRSTFNDSRVVVLDDFGKLVSSDNFTFTTIDSGTVVLRRRLTLDHDGNARVYSIRDGEDNWKVTGIFRPQPCFIHGICGPNSYCSNKPTTGRTCSCLPGYRWVDSQDWSQGCESSFQLWCNNTEKESHFLRLPEFDXYGYDYGYYPNHTYEQCVNLCLELCECKGFHTASQRKVTL

SEQ ID NO: 3984 - protein, 87 aa, Glycine max
  Clone ID: PAT_MRT3847_87591C.1.pep
DIALADLAPTHPIRLGLALNFSVFYYEILNSTDRACNLAKQAFDEAISELDSLGEESYKDSTLIMQLLRDNLTLWTSDTNEDRGDEI

SEQ ID NO: 3985 - protein, 114 aa, Glycine max
  Clone ID: PAT_MRT3847_8787C.1.pep
FPKIFSEEEATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 3986 - protein, 151 aa, Glycine max
  Clone ID: PAT_MRT3847_88032C.1.pep
RLVIRLQAKYGNKWKKIAAEVPGRTAKRLGKWWEVFKEKQQREKKDVNRISDPINNSKYEHILESFAEKLVKERPSPSFLMAASNGAFLHTDTPAPASSLLPSWLSNSSSPAADGPSSLSVTLSLSSSMVIAPPFSWLPPKRGPDNAPFVL

SEQ ID NO: 3987 - protein, 371 aa, Glycine max
  Clone ID: PAT_MRT3847_88033C.1.pep
VQVSRHGLWDLHLEMKERQRWRAEEDALLRSYVKQYGPREWNLVSQRMNTYLNRDAKSCLERWKNYLKPGIKKGSLTEEEQRLVIHLQAKYGNKWKKIAAEVPGRTAKRLGKWWEVFKEKQQREKKEINRIADPINNSKYEHILESFAEKLVKERPSPSFVMAASDGAFLLTDTPAPASSLRPSWLSNSSSAAAIGPSSLSVKLSLSSSTVATPPFSWLPPERGPDNAPFVLGNVSALHGAIPTLSDSMHMSQMVEHCKELEEGHRALATHKKEAAWRLSRVELQLESEKANRRREKIEEFEAKIKALQEEEKAALGRIEAEYREQLAALRRDAENKEQKLAEQWDAKHLRFTRLLEQLGCRAGLLEPNAR

SEQ ID NO: 3988 - protein, 345 aa, Glycine max
  Clone ID: PAT_MRT3847_8803C.1.pep
MAVSDGVVKKIVLSYTYVAIWIFLSFTVIVYNKYILDRKMYNWPYPISLTMIHMAFCSSLAYILVRVLKLVEPVSMSRDLYLKSVVPIGALYSLSLWFSNSAYIYLSVSFIQMLKALMPVAVYSIGVIFKKEAFKNETMANMVSISLGVAVAAYGEAKFDAWGVTLQLMAVAFEATRLVLIQILLNSKGISLNPITSLYYIAPCCLVFLSVPWIIMEYPSLRDNSSFHLDFAIFGTNSACAFALNLAVFLLVGKTSALTMNVAGVVKDWLLIAFSWSVIKDTVTPINLIGYGLAFLGVAYYNHCKLQALKASEAQKKALQADEEAGRLLEQKDGEGTGRKNDNQN

SEQ ID NO: 3989 - protein, 37 aa, Glycine max
  UNSURE (1)..(37): unsure at all Xaa locations
  Clone ID: PAT_MRT3847_88136C.1.pep
  unsure (1)..(37): unsure at all Xaa locations
FYLSPXLXCXSFYSXRXFXISLCNHVRRERERDPGXL

SEQ ID NO: 3990 - protein, 57 aa, Glycine max
  UNSURE (1)..(57): unsure at all Xaa locations
  Clone ID: PAT_MRT3847_88256C.1.pep
  unsure (1)..(57): unsure at all Xaa locations
LXLLLGRVCFVXNRVXWFEXKGKGLTFWGLVVGXGECAVWWLXXRWSEGSAXNGFXE

SEQ ID NO: 3991 - protein, 34 aa, Glycine max
  Clone ID: PAT_MRT3847_8838C.1.pep
YIIIRMQQVAARSLIFTPIFSYVLEAEIVFCSLY

SEQ ID NO: 3992 - protein, 40 aa, Glycine max
  Clone ID: PAT_MRT3847_88927C.1.pep
VIGACFTSHHNFLASDYNQGPPTCILILQQKQNKTAPGAP

SEQ ID NO: 3993 - protein, 33 aa, Glycine max
  Clone ID: PAT_MRT3847_89506C.1.pep
YRVQQAIAAGILPLAPLLLQRSSGVFEQLPLVH

SEQ ID NO: 3994 - protein, 86 aa, Glycine max
  Clone ID: PAT_MRT3847_89565C.1.pep
MATPNPTRFSLAMERTGQWVFSPEIPTDVIVAVGESTFSLHKFILAAKSNYIRKVIMESEESDLTRIEISNIPWRTRSFLRKPRNF

SEQ ID NO: 3995 - protein, 103 aa, Glycine max
  Clone ID: PAT_MRT3847_89776C.1.pep
MTGRGKGGKGLGKGGAKRHRKILRDNIQGITKPAIRRLARRGGVKRISAMIYEETRGVLKTFLEGVIRDAVTYTEHAKRKTVTSLDVVYALKRQGRTLYGFGG

SEQ ID NO: 3996 - protein, 293 aa, Glycine max
  Clone ID: PAT_MRT3847_89886C.1.pep
MMRTPISSDESGLKKGPWSPEEDKILVDFIEKHGHGSWRALPRLAGLNRCGKSCRLRWTNYLRPDIKRGKFSDEEEQLIINLHSVLGNKWAAIASHLPGRTDNEIKNLWNTHLKKKLMQMGLDPVTHRPRTHHLNLLSNLQQILALIRLQSDANKLQLLQNIFEASNSDPLPDSSYSLLNDVLGGLNNLHSNDLHNLYDGNSLSVQNFDQNLNGGRNAEPSPSSNSLPNLVSASPDRSPVVKEAQNILVNSKDFSTSAFELTWGDFMDEEETNQTYWKGFMDQHSNQTWSTFP

SEQ ID NO: 3997 - protein, 175 aa, Glycine max
  UNSURE (1)..(175): unsure at all Xaa locations
  Clone ID: PAT_MRT3847_9026C.1.pep
  unsure (1)..(175): unsure at all Xaa locations
AVTFVAAGLSSGKIGSIAYACXFTVLGATLMDKSGRRPLITASASGTFLGCFITGVAFFLKDQSXLLDWVPILAVAGVLIYVGAFSIGMGPVPWIIISEIFPIHVKGTAGSLVVLVNWLGSWVVSYTFNFLMSWSSPGTLFLYAGCSLLTILFVAQLVPETKGKTLDEVKHASIH

SEQ ID NO: 3998 - protein, 134 aa, Glycine max
  UNSURE (1)..(134): unsure at all Xaa locations
  Clone ID: PAT_MRT3847_90691C.1.pep
  unsure (1)..(134): unsure at all Xaa locations
LEDDDRYLAEFKACNDTNEAADHSIRAYESAALAVHADTPPTHPMRLGVAGNNSERYYEILNSPRRACHLAKQAFHESISELDTLHEESCXDCTLSMHLLRDNLTVWTSGIPEDGEDAPKVNGTGKLGRGEDAP

SEQ ID NO: 3999 - protein, 63 aa, Glycine max
  Clone ID: PAT_MRT3847_91167C.1.pep
PAATKASITANHLKVNTFSSKNPVRYKLQETMYTLLISISSCHIRYASLIWLKPFPTCYRFTL

SEQ ID NO: 4000 - protein, 78 aa, Glycine max
  Clone ID: PAT_MRT3847_91658C.1.pep
YGCEKTTEGDKRRSKVKNTDGMTPRNQMKNCAFYGYVSSFNFIYSICVYISTLIIASLLNDNGGPINRNNVGAEQRIF

SEQ ID NO: 4001 - protein, 314 aa, Glycine max
  Clone ID: PAT_MRT3847_91852C.1.pep
ANALNVNSLRMLLHRSSTPQSSNAIQRIQSSDIEYSHFTRSLVRKVLEESLLKLKEETTRHSKSIRWELGACWVQHLQNQATGKTEPKKEEEAKVEPAVKGLGKQGGLLKELKKKIDIRNSKVEVGKDISPCNGNDINKPEATKQELERQDEEKEIIWKKLLSDAAYTRLKESKTDLHLKSPDELMEMAHKYYVDTALPKLLADFGSLELSPVDGRTLTDFMHTRGLQMSSLGRVVELADKLPHVQSLCIHEMVVRAYKHILQAVVAAVDNVSELASSIASCLNILLGTPSPETNDEVTSCADVETLLRFLGEC

SEQ ID NO: 4002 - protein, 103 aa, Glycine max; identical to SEQ ID NO: 3555
  Clone ID: PAT_MRT3847_92215C.1.pep

SEQ ID NO: 4003 - protein, 103 aa, Glycine max; identical to SEQ ID NO: 3555
  Clone ID: PAT_MRT3847_92216C.1.pep

SEQ ID NO: 4004 - protein, 103 aa, Glycine max
  Clone ID: PAT_MRT3847_92218C.1.pep
MSGRGKGGKGLGKGGAKRHRKGLRDNIQGITKPAIRRLARRGGVKRISGLIYEETRGVLKIFLENVIRDAVTYTEHARRKTVTAMDVVYALKRQGRTLYGFGG

SEQ ID NO: 4005 - protein, 207 aa, Glycine max
  Clone ID: PAT_MRT3847_92219C.1.pep
MVKHNNVIPNGHFRKHWQNYVKTWFNQPARKTRRRLARQKKAVKIFPRPTAGSLRPIVHGQTLKYNMKVRAGRGFSLEELKAAGIPKKLAPTIGISVDHRRKNRSLESLQANVQRLKTYKAKLVVFPRRAHKVKAGDSSLEELANATQVQGPFLPIVREKPTVDLVKVTDEMKAFKAYYKLRLERTNKRHHGARLKKAAEAEKEDKK

SEQ ID NO: 4006 - protein, 686 aa, Glycine max
  UNSURE (1)..(686): unsure at all Xaa locations
  Clone ID: PAT_MRT3847_92419C.1.pep
  unsure (1)..(686): unsure at all Xaa locations
TVGVTPSDPRKSLPQWGLHFLSYTHRLNQIKKRSSGVYASLSERERGEYYSQRPPTPLLDTVNYPIHMKNLSTXVSRTGGHLGSSLGVVELTVALHYVFNAPQDKILWDVGHQSYPHKILTGRRDKMHTMRQTNGLSGFTKRSESEFDCFGTGHSSTTISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKRIGGPMHELAAKVDEYARGMISGSGSSLFEELGLYYIGPVDGHNINDLVAILNEVKSTNTTGPVLIHVITEKGRGYPYAEKAADKYHGVTKFDPPTGKQFKSKATTRSYTTYFAEALIAEAEADKDVVAIHAAMGGGTGMNLFHRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEAELFHMVATAAAINDRPSCFRYPRGNGIGVQLPTGNKGTPLEIGKGRILIEGERVALLGYGSAVQNCLAAASLVEHHGLRVTVADARFCKPLDRSLIRSLAKSHEVLITVEEGSIGGFGSHVAQFMALDGLIDGKLKWRPIVLPDRYIDHGSPADQLSLAGLTPSHIAATVFNILGQTREALEVMS

SEQ ID NO: 4007 - protein, 673 aa, Glycine max
  UNSURE (1)..(673): unsure at all Xaa locations
  Clone ID: PAT_MRT3847_92420C.1.pep
  unsure (1)..(673): unsure at all Xaa locations
IKKRSSGVYASLSERERGEYYSQRPPTPLLDTVNYPIHMKNLSTNELKQLADELRSDVIFSVSRTGGHLGSSLGVVELTVALHYVFNAPQDKILWDVGHQSYPHKILTGRRDKMHTMRQTNGLSGFTKRSESEFDCFGTGHSSTTISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKRIGGPMHELAAKVDEYARGMISGSGSSLFEELGLYYIGPVDGHNINDLVAILNEVKNTETTGPXLIHVVTEKGRGYPYAERAAAKYHVVSKFDPATGEQFKAKATTRSYSTYFAEALIAEAEADKDIIGIHAAMGGGTGMNLFHRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEADLFHMVATAAAINDRPSCFRYPRGNGIGVQLPTGNKGTPLEIGKGRILIEGERVALLGYGSAVQNCLAAASLVEHHGLRVTVADARFCKPLDRSLIRSLAKSHEVLITVEEGSIGGFGSHVAQFMALDGLIDGKLKWRPIVLPDRYIDHGSPADQLSLAGLTPSHIAATVFNILGQTREALEVMS

SEQ ID NO: 4008 - protein, 749 aa, Glycine max
  Clone ID: PAT_MRT3847_92633C.1.pep
MDAYSSGEEVVVKTRKPYTITKQRERWTEEEHNRFLEALKLHGRAWQRIEEHIGTKTAVQIRSHAQKFFTKLEKEALVKGVPIGQALDIDIPPPRPKRKPNNPYPRKTRIGTTSLHSGAKDGKLNLVESSHVNQALDLKKEPLPEKHDLDEGLTTVKENKDENHAKVFTLLQEVPCSSVSSANESSITMSVPLGNPCAFKEITPSVKEVIARDEKTESFVTVEPENGKLEINDGKQTNGTSKDSRLEDSDALHMKLVQNEKPDGLDCELTIDGMQGNQNYPRHVTVHVVDGNLGTNTQNPSQDMLFRDSMFQPIGGVNGQRNVFTNTAPSNTSESQNNTARSSVHQSFLPYPPFTQHNQDDYQSFLHMSSTFSNLIVSTLMQNPAAHAAASFAATFWPYANPETSANSPRCSQGGFTNRQIGSPPCVAAIAAATVAAATAWWAAHGLLPLCAPLHTSFACPASVTTVPSMNTGEAPALKAEQEKTTLQNPPLQDQMLDPEYSEAQQAQHSASKSPAAILSDSESGDAKLNTSSKVTDHETNKTISEHLDSNKTKGRKPVDRSSCGSNTASSSDVETDALEKGEKGKEEPEIPDANQLAIEFSNRRRSVSNLTDSWKEVSEEGRLAFQALFSREVLPQSFSPPHALKNTDHQMDNANDNKQNIDDKDEDLDGKKCSSNYEAMQKNLLFVENNEGLLTIGLGQGKLKTHRTGFKPYKRCSMEAKENRVGASSNQGEEQGCKRIRLEGETST

SEQ ID NO: 4009 - protein, 36 aa, Glycine max
  Clone ID: PAT_MRT3847_93042C.1.pep
MAAFNKLGGLLRHSALVPGITGGSSPAVFNAARLMS

SEQ ID NO: 4010 - protein, 97 aa, Glycine max
  Clone ID: PAT_MRT3847_93101C.1.pep
KKKLHPLQFAHKLRDYEFSLRFGKKASFCYNYYYFFPDSLGCGCVKRVADSLQMLLDYMLLSSSTSPLLFITSSLSLNFLQRECVTSNNCVFVCMFL

SEQ ID NO: 4011 - protein, 188 aa, Glycine max
  Clone ID: PAT_MRT3847_93738C.1.pep
SEAFRTLLMWLCRYKHVEDAEALFHNSVKKGLRADIKMWNVILNGWCVLGNSHEAKRVWRDIVASPCKPDIFTYATFIKALTKKGKLGTALKLFRGMWDKGGKPDVVICNCIIDALCFKKRIPEALEIFCDMSERGCEPNVATYNSLIKYMCKIQRMEKVYELVDEMERKKGSCLPNAVTYCYLLKSL

SEQ ID NO: 4012 - protein, 74 aa, Glycine max
  UNSURE (1)..(74): unsure at all Xaa locations
  Clone ID: PAT_MRT3847_9385C.1.pep
  unsure (1)..(74): unsure at all Xaa locations
STXKERETHVCVAKLSEQAXRYEEMVECMKTIAKLDLELTVEERNLLSVGYKNVIGARRASWRIMSSIEQKEES

SEQ ID NO: 4013 - protein, 33 aa, Glycine max
  Clone ID: PAT_MRT3847_94325C.1.pep
VDQGRKYDEYGFVEKQSVEYGFPVHAFSVTYVA

SEQ ID NO: 4014 - protein, 92 aa, Glycine max
  UNSURE (1)..(92): unsure at all Xaa locations
  Clone ID: PAT_MRT3847_94669C.1.pep
  unsure (1)..(92): unsure at all Xaa locations
SAPTTREDYEYMAKLADQSTRYEEMEEFMNKVYLSAXSYELTVEERNLLSVAYKNMIGARRASXRIISSIEQKEESRSNXDHCPVIHDYRSR

SEQ ID NO: 4015 - protein, 481 aa, Glycine max
  Clone ID: PAT_MRT3847_94687C.1.pep
MAIEKHEDVESGYLHEPFIQPEDAAAACKENGSDKSVKNGSIGMVFLSTLVAVCGSFTFGTCVGYSAPTQAAIRADLNLSLAEFSMFGSLVTIGAMLGAITSGRITDFIGRKGAMRISTGFCITGWIAVFFSKGSYSLDMGRFFTGYGIGVISYVVPVYIAEIAPKNLRGGLATTNQLLIVTGGSVSFLLGSVINWRELALAGLVPCICLLVGLCFIPESPRWLAKVGREKEFQLALSRLRGKDADISDEAAEILDYIETLQSLPKTKLLDLFQSKYVHSVVIGVGLMACQQSVGINGIGFYTAEIFVAAGLSSGKAGTIAYACIQIPFTLLGAILMDKSGRRPLVMVSAAGTFLGCFVAAFAFFLKDQSLLPEWVPILAFAGVLIYIAAFSIGLGSVPWVIMSEIFPIHLKGTAGSLVVLVAWLGAWVVSYTFNFLMSWSSPGTLFLYAGCSLLTILFVAKLVPETKGKTLEEIQACISS

SEQ ID NO: 4016 - protein, 129 aa, Glycine max
  UNSURE (1)..(129): unsure at all Xaa locations
  Clone ID: PAT_MRT3847_9479C.1.pep
  unsure (1)..(129): unsure at all Xaa locations
MTQCRNMQGDLIDYVPGFPKESDMNIVECTILLNVPQGYSDVLIKNLYLSCDPYMRLLMAKDRAFGDGYFTLDYPLKGYGVSQVLESGRSDYMKGDLMWGITEWEEYSXWPSSIIHFIIEHTDXPLCYY

SEQ ID NO: 4017 - protein, 468 aa, Glycine max
  Clone ID: PAT_MRT3847_95346C.1.pep
MRIPSTLVEVLLVLALFCCSPWTVWSSNTLCQQTNEEVRPHSVSITEFGAVGDGVTLNTKAFQNAIFYLNSFADKGGAKLFVPAGRWLTGSFDLISHLTLWLDKDAVILGSTNPEDWPVVDPLPSYGRGRELPGGRHKSLIYGHNLTDVIITGNNGTIDGQGSIWWNRFWNRSLDYTRPHLVELMNSTGVLISNLTFLNSPFWTIHPVYCSQVTVQNVRILAPHDSPNTDGIDPDSSDNVCIEDCYISTGDDLIAIKSGWDEYGIAYGRPSTNIIIHRLVGKTQTSGIAIGSEMSGGVSEVHAEDIQFYDSYNGIRIKTSPGRGGYVRNIYVSNVSLANVDIAIWFTGSYGEHPDDAYDPNALPVIEKVTIKDVVGENIKTAGLIEGIEGDNFVNICLSNIILNVTSNYPWNCSYVKGYSDLVQPEACEPLKERIFPDHCSDCYYLTNQIQSSNSQNRAGQTSGDIRG

SEQ ID NO: 4018 - protein, 333 aa, Glycine max
  Clone ID: PAT_MRT3847_95870C.1.pep
MSKARVYTDVNVLRPKEYWDYESLTLQWGDQDDYEVVRKVGRGKYSEVFEGINVNSNERCIIKILKPVKKKKIKREIKILQNICGGPNIVKLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDELNAYLNKYHLELDPQLDALVGRHSRKPWSKFINADNQHLVSPEAIDFLDKLLRYDHQDRLTAREAMAHPYFSQVRAAESSRMRTQ

SEQ ID NO: 4019 - protein, 87 aa, Glycine max
  Clone ID: PAT_MRT3847_96578C.1.pep
AAAPSPREENEYMAKLADQAARYEEMVETMENVSAAVDNQELTVKERNLLSPAYKNVIGARRASRRIISSIEQKDESHTNQDHESVI

SEQ ID NO: 4020 - protein, 96 aa, Glycine max
  UNSURE (1)..(96): unsure at all Xaa locations
  Clone ID: PAT_MRT3847_9664C.1.pep
  unsure (1)..(96): unsure at all Xaa locations
MAPPNPTEFSFAMERTGQWVFSQKIPTVVIVAVDQTNFSFHRLFLAGKSNYVKKSDNGNQRESDLTRXIRFPTYPGGSESFEKSGEILFTALNFEN

SEQ ID NO: 4021 - protein, 160 aa, Glycine max
  Clone ID: PAT_MRT3847_96842C.1.pep
MSDEEHHFESKADAGASKTYPQQAGTIRKNGYIVIKGRPCKVVEVSTSKTGKHGHAKCHFVGIDIFTAKKLEDIVPSSHNCDVPHVNRTDYQLIDIAEDGFLSLLTENGNTKDDLKLPTDESLLTQIKDGFAEGKDLVVSVMSAMGEEQICALKDIGPKN

SEQ ID NO: 4022 - protein, 160 aa, Glycine max; identical to SEQ ID NO: 4021
  Clone ID: PAT_MRT3847_96843C.1.pep

SEQ ID NO: 4023 - protein, 71 aa, Glycine max
  UNSURE (1)..(71): unsure at all Xaa locations
  Clone ID: PAT_MRT3847_97352C.1.pep
  unsure (1)..(71): unsure at all Xaa locations
MGYSSREENAYMEKLAELSTRFNEMVDFMXMVAXTVEVEELTVEERILLSVAYKNVIDSRRAWLMIIFFIE

SEQ ID NO: 4024 - protein, 58 aa, Glycine max
  UNSURE (1)..(58): unsure at all Xaa locations
  Clone ID: PAT_MRT3847_97372C.1.pep
  unsure (1)..(58): unsure at all Xaa locations
MARYQKHFHDQGPQGDQFCNRYKQTDQYXGTPVHAAKCTYVATKTAAGGYSDDINKQH

SEQ ID NO: 4025 - protein, 147 aa, Glycine max
  UNSURE (1)..(147): unsure at all Xaa locations
  Clone ID: PAT_MRT3847_97721C.1.pep
  unsure (1)..(147): unsure at all Xaa locations
DAWEQIESLQRPITMEAGSIVLMDLLWSDPTENDSVEGLRPNARGPGLVTFGPDRVMEFCNNNDLQLIVRAHECVMDGFERFAQGHLITLFSATNYCGTANNAGAILVLGRDLVVVPKLIHSLPPAMSSPEASSERLIXDTWMQELN

SEQ ID NO: 4026 - protein, 66 aa, Glycine max
  Clone ID: PAT_MRT3847_97804C.1.pep
HINMRWWLVASLIVQSMLDSQPTHRNHEFGAAEECRRGQLAGIARIGRHAPSAHESLESSSFISHR

SEQ ID NO: 4027 - protein, 160 aa, Glycine max; identical to SEQ ID NO: 4021
  Clone ID: PAT_MRT3847_98128C.1.pep

SEQ ID NO: 4028 - protein, 160 aa, Glycine max; identical to SEQ ID NO: 4021
  Clone ID: PAT_MRT3847_98129C.1.pep

SEQ ID NO: 4029 - protein, 257 aa, Glycine max
  Clone ID: PAT_MRT3847_98366C.1.pep
MSDSSREENVYMAKLAEQAERYEEMVEFMEKVAKTVEVEELTVEERNLLSVAYKNVIGARRASWRIISSIEQKEESRGNEDHVAIIKEYRGKIEAELSKICDGILNLLESNLIPSAASPESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDDAGDEIKETSKQQPGE

SEQ ID NO: 4030 - protein, 350 aa, Glycine max
  Clone ID: PAT_MRT3847_98379C.1.pep
MENAPVVCKEDDQMDLPPGFRFHPTDEELISHYLYKKVIDTKFCARAIGEVDLNKSEPWDLPWKAKMGEKEWYFFCVRDRKYPTGLRTNRATEAGYWKATGKDKEIFRGKSLVGMKKTLVFYRGRAPKGEKSNWVMHEYRLEGKFSVHNLPKTAKNEWVICRVFQKSSAGKKTHISGIMRLDSFADELGSSALPPLSDSSPSIGNTKPLNDTAYVPCFSNPIDVQRNQEGVFDSFTNSIYAVSSNPMGILPRMPPSGSFYSTQGVQAAPNLAFPGSVYTLQDHTILRTLCENNGYKPERDMISVSQETGLTTDINAETSSNFDMGRRPFENHNHASVSVAPLDLDGLWNY

SEQ ID NO: 4031 - protein, 350 aa, Glycine max
  Clone ID: PAT_MRT3847_98380C.1.pep
MENVPAVCKEDDQMDLPPGFRFHPTDEELISHYLYKKVIDTKFCARAIGEVDLNKSEPWDLPWKAKMGEKEWYFFCVRDRKYPTGLRTNRATEAGYWKATGKDKEIFRGKSLVGMKKTLVFYRGRAPKGEKSNWVMHEYRLEGKFSAHNLPKTAKNEWVICRVFQKSSAGKKTHISGIMRLDSFANELGSSALPPLSDSSPSIGNTKPLNDSAYVPCFSNPIDVQRNQEGVFDSFTNSMYGVSSNPMDILPRMPPSGSFYSTQGVQAAPNFAFPGSVYTLQDHTILRALCENNGYKPERDMISVSQETGLTTDINAETSSNFDVGWRPFENHNHASVSVAPLDLDGLWNY

SEQ ID NO: 4032 - protein, 505 aa, Glycine max
  Clone ID: PAT_MRT3847_98690C.1.pep
RGVFLLSRRSGGMGGPGGPGFPLAFGQSKAKFQMEPNTGVTFDDGAGVDEAKQDFMEVVEFLKKPERFTAVGARIPKGVLLVGPPGTGKTLLAKAIAGEAGVPFFSISGSEFVEMFVGVGASRVRDLFKKAKENAPCIVFVDEIDAVGRQRGTGIGGGNDEREQTLNQLLTEMDGFEGNTGIIVVAATNRADILDSALLRPGRFDRQVTVDVPDIRGRTEILKVHASNKKFDADVSLEVIAMRTPGFSGADLANLLNEAAILAGRRGKTAISSKEIDDSIDRIVAGMEGTVMTDGKSKSLVAYHEVGHAICGTLTPGHDAVQKVTLVPRGQARGLTWFIPNDDPTLISKQQLFARIVGGLGGRAAEEIIFGEPEVTTGAAGDLQQITSLAKQMVTTFGMSDIGPWSLMEPSAQGGDVIMRMMARNSMSERLAEDIDAAIKRISDEAYEIALEHIRNNREAIDKIVEVLLEKETLSGDEFRAILSEFVEIPAENRVAPSTPVPATV

SEQ ID NO: 4033 - protein, 336 aa, Glycine max
  Clone ID: PAT_MRT3847_98960C.1.pep
MENSTEESHLRSENSVTYESPYPIYGMSFSPSHPHRLALGSFIEEYNNRVDILSFHPDTLSVTPHPSLSFDHPYPPTKLMFHPRKPSPSSSSDLLATSGDYLRLWEIRDNSVDAVSLFNNSKTSEFCAPLTSFDWNDIDPNRIATSSIDTTCTIWDIERTLVETQLIAHDKEVYDIAWGEARVFASVSADGSVRIFDLRDKEHSTIIYESPHPDTPLLRLAWNKQDLRYMATILMDSNKVVILDIRSPTTPVAELERHRGSVNAIAWAPHSSTHICSAGDDTQALIWELPTLASPTGIDPVCMYSAGCEINQLQWSAAQPDWIAIAFANKMQLLKV

SEQ ID NO: 4034 - protein, 234 aa, Glycine max
  Clone ID: PAT_MRT3847_9915C.1.pep
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVAETTTATAQGVFYMEEEEQVLDMPELLRNMVLMSPTHCLGYEYEDADLDAQDAEVSLWNFSI

SEQ ID NO: 4035 - protein, 100 aa, Glycine max
  UNSURE (1)..(100): unsure at all Xaa locations
  Clone ID: PAT_MRT3847_99178C.1.pep
  unsure (1)..(100): unsure at all Xaa locations
AFXXSSEKFKKAGAVVVGISGDDAASHKAFASKYRLPFTLLSDEGTKVRKEWGVPGDFFGSLPGRETYVLDKNGVVQLVYNNQFQPEKHIDETLKILQSL

SEQ ID NO: 4036 - protein, 214 aa, Glycine max
  Clone ID: PAT_MRT3847_99180C.1.pep
MASLTVPNHCVPTLLRTHSLNYPSSQNLPLPSAPSNSQFFGLKLSHSSFSTIPSSSSSLKGSIFAKVNKGSKPPNFTLKDQNGKNVSLSNFKGKPVIVYFYPADETPGCTKQACAFRDSYEKFKKAGAVVVGISGDDAASHKAFASKYKLPFTLLSDEGNKVRKEWGVPGDFFGSLPGRETYVLDKNGVVQLVYNNQFQPEKHIGETLKILQSL

SEQ ID NO: 4037 - protein, 174 aa, Glycine max
  Clone ID: PAT_MRT3847_99342C.1.pep
MRVTNKPMMGRDSANRAQQTPVREKRKKASNKKAPKPPRPPKAPSLDAADHKLIREISELAMLKRARMERMRVRKIAKSSAPSSSNASSLLAMIFTVVFFVVIILQGMSSGKTSVASFQGSPVSAGESEDGLISVHYQLNPSAIDSNAPGSESHTFVQQVAGSDLPEKLRRDSG

SEQ ID NO: 4038 - protein, 159 aa, Glycine max
  Clone ID: PAT_MRT3847_99499C.1.pep
MSDEEHHFESKADAGASKTFPQQAGTIRKNGYIVIKNRPCKVVEVSTSKTGKHGHAKCHFVGIDIFTGKKLEDIVPSSHNCDVPHVNRIDYQLIDISEDGFVSLQTETGGTKDDLRLPTDENLLTQIKDGFAEGKDLVVSVMSSMGEEQICALKDIGPK

SEQ ID NO: 4039 - protein, 179 aa, Glycine max
  Clone ID: PAT_MRT3847_99501C.1.pep
SLVWPSLGIFCALPGAEFGTRSDEEHHFESKADAGASKTFPQQAGTIRKNGYIVIKNRPCKVVEVSTSKTGKHGHAKCHFVAIDIFTGKKLEDIVPSSHNCDVPHVNRIDYQLIDISEDGFVSLLTETGGTKDDLRLPTDENLLSQIKDGFAEGKDLVVSVMSSMGEEQICALKDIGPK

SEQ ID NO: 4040 - protein, 72 aa, Glycine max
  Clone ID: PAT_MRT3847_99856C.1.pep
HPTNTLFGTKRLIGRRFDDAQTHKEMKMVPFKIVKAPNGDAWVEANGQQYSPSQIGAFVLTKMKETAEAYLG

SEQ ID NO: 4041 - protein, 493 aa, Zea mays
  UNSURE (1)..(493): unsure at all Xaa locations
  Clone ID: PAT_MRT4577_100006C.1.pep
  unsure (1)..(493): unsure at all Xaa locations
QTDLQYIKXXISSVERXRAELYRTKERYSMKLRMLLDEPTAQKIWPSPIDKASCRFLPNSRTPLSGLCPGTLQNKKLDLKAQVSHQGFQRRDALTSSDPPNSPXIQSGNVIARKRRVQAQFNELQEYYLQRRRTGAQARRQEERDIVAMNREGYHAGLQDFQSVLTTFTRYSRLRVIAELRHGDLFHSANIVSSIEFDRDDELFATAGVSKRIKVFEFSTVVNEPSDVHCPVVEMATRSKLSCLSWNKYSKNIIASSDYEGIVTVWDVQTRQSVMEYEEHEKRAWSVDFSRTDSSMLVSGSDDCKVKVWCTNQEASVINIDMKANICSVKYNPGSSFYVAVGSADHHIHYFDLRNPSSPVHIFGGHKKAVSYVKFLSNNELASASTDSTLRLWDVKDNCPVRTFRGHKNEKNFVGLSVNNEYIACGSETNEVFVYHKAISKPAASHRFVSSDPDDADDDPGSYFISAVCWKSDSPTMLTANSQGTIKVLVLAP

SEQ ID NO: 4042 - protein, 44 aa, Zea mays
  Clone ID: PAT_MRT4577_100058C.1.pep
SVHPMMAHIHILHTVDTSHDWQIRHRSLISFSVSIRNYEVGLVD

SEQ ID NO: 4043 - protein, 271 aa, Zea mays
  Clone ID: PAT_MRT4577_100095C.1.pep
MAHGDRMTTFEEGERESEYGYVRKVSGPVVVADGMGGAAMYELVRVGHDSLIGEIIRLEGDSATIQVYEETAGLTVNDPVLRTKKPLSCELGPGILGNIFDGIQRPLKTIAIKSGDVYIPRGVSVPALDKDQQWEFQPNKLGVGDNITNGDLYATVFENTLMKHHIALPPGAMGKISYIAPAGQYSLQDTVLELEFQGIKKEFTMLHTWPVRTPRPVASKLAADTPLLTGQRVLDALFPSVLGGTCAIPGAFRCGKTSIRQVLSQYSNSDT

SEQ ID NO: 4044 - protein, 69 aa, Zea mays
  Clone ID: PAT_MRT4577_100187C.1.pep
RLQMIMKLGESTRQNCFWQSTLTHPIRIHHYSSRKANSYFSCHLSSCDYHKKTCYATAYMIMHMHAKDN

SEQ ID NO: 4045 - protein, 58 aa, Zea mays
  Clone ID: PAT_MRT4577_100196C.1.pep
EKSSSKATVCIHHHRAGWFSVHRMLIAPPDAPRPSHTLMFCHHKLNTLPAQMHVKNTC

SEQ ID NO: 4046 - protein, 350 aa, Zea mays
  Clone ID: PAT_MRT4577_100216C.1.pep
MAAGGNGAGGDTRAAFARIYKTLKEELLTDPAFEFTEESRQWIDRMVDYNVLGGKCNRGLSVVDSYKLLKGADALGEEETFLACTLGWCIEWLQAFFLVLDDIMDDSHTRRGQPCWFRVPQVGLIAANDGIILRNHISRILRRHFKGKPYYADLLDLFNEVEFKTASGQLLDLITTHEGEKDLTKYNITVHGRIVQYKTAYYSFYLPVACALLLSGENLDNYGDVENILVEMGTYFQVQDDYLDCYGDPEFIGKIGTDIEDYKCSWLVVQALERADESQKRILFENYGKKDPACVAKVKNLYKELDLEAVFQEYENESYKKLIADIEAQPSIAVQKVLKSFLHKIYKRQK

SEQ ID NO: 4047 - protein, 217 aa, Zea mays
  Clone ID: PAT_MRT4577_100218C.1.pep
MKFLYLPPFKQMVDYNVLGGKCNRGLSVVDSYKLLKGADALGEEETFLACTLGWCIEWLQAFFLVLDDIMDDSHTRRGQPCWFRVPQVGLIAANDGIILRNHISRILRRHFKGKPYYADLLDLFNEVEFKTASGQLLDLITTHEGEKDLTKYNITVHGRIVQYKTAYYSFYLPVACALLLSGENLDNYGDVENILVEMGTYFQVQDDYLDCYGDPEI

SEQ ID NO: 4048 - protein, 419 aa, Zea mays
  Clone ID: PAT_MRT4577_100294C.1.pep
MELLPVEVVGNILSHLGVARDVMIASAVCRKWRDACRRHLRLLSFNSNDFPRDMTTRQLEIVITQTIFQTIGLQRLSIHIDNTHEFSAAPVIAWLMYTRETLRSLSYNVRTIPNVSILEKCGRQKLEVLDLELDHNTITGVEPSYQRFTCLKSLSLRHVSILALDLSLLVAACPRIESLALDVLEVVTSELQSTMELTSHTLKSLFAKSVGVDKIILDADNLEVLHLNALNLDLFELNGKGTLKHFKIDDVSVTHLDIGDNTDHLEAVDVSNFTIVWPKFYSMISRASNLRMLRFWGVVFDDEDEIVDSETIAVSFPLLRHLSLSYELRDGLLHYSLQGSSLLENVSVLELGWTVISEHFGPWVFGMIGRCPNLKKLVIHGVLSETKTREDRQMLASFTSFIVCVMRKYVHVDVQFEYE

SEQ ID NO: 4049 - protein, 1090 aa, Zea mays
  UNSURE (1)..(1090): unsure at all Xaa locations
  Clone ID: PAT_MRT4577_100586C.1.pep
  unsure (1)..(1090): unsure at all Xaa locations
MAPPPGKLSDDIDGSSDPDADKKGLDSEMDMLGRGNSEKKASERTRRGLDIDLEDQKVRRIPVDEFAPKKLTLQLDLEKPSLGDEKSPSERRQPQPQPQQLQQQKPSKAEIKHEKSAMPAAVTPPMPIPVGGWLGNFPPFGYLSPVPGLSAAGLHHPMDVKPGSSSGLHHSALLPPPSRSKRCATHCYIAQFIQHQQRVAKMNSFWPPTAAAAAAAAANRPPGPFFGARPFSMGVVPPTDAASMLVNPMQGSYPVRAHTPMQEAKAPMATSPFQGSLSKDKTLGNAAGAESSQRKQPPSHETLQSTPLPNMLQAPAFIFPFNQQHAMVAAANAANRAGDAKSSGAGNTLPPSASAHTLATNSGAAAMNLSFANMQPADAQFLAILQNGYPFQVAAHPGGPPYRGMAPPGPAVPFFNGHVYSSPMLHPSQQQGAQSQSHQKTQMPNLPSSSQKHQPQQSQGLLGYAPNANAAAAASNSQNYSSGNQRPVLAHRQESDKTGEDGLSSDDKPSHSQKSGYEHNFAVPVHLPNFAMMPAAQPAVSQSEKKLSDHHHQQQQPQVSRGQGVRIDLASSQPFVMPFGSIGPPGSTPSGLDFSALAQNHAVFQSHQDAARHGYPQLNFAAAQSTQHKPQHGETKSVAGDSSLTHIAGDSQRKKSTSTKYSGDSQQHSLSFTRTESKNHVPPFLSGSTNESSSRTLSXLEQNLQIHLWEANPQIPPLLPQHHLQLXSSISQQHQHFLQMQVQHKHQHQQMIQHHHLNRPRSAAPSTQNSAGGYPDRLNMASFQNMMYPPNAAQGQGRVQSPQLKASSGRGTPSSTATTPPAAAPPNLIVMKTSSLHPQQAKIPMQALSTPGHQSQSSLSMSSSKMAPVTNLSTGGGDLSRSSNAPVASGSPSNSVSKSTGGSPPATGNAKGVQQPVQLPSPQQQLAKNSVSTCGSKSTPANHFSMAMPSILGQQPNSSPGSNTGSKQQSHMSSSMKQQPFPQGHFFISSTYAPQAPGAGGAAALGLYQKRPGDKTQPQAPHQQNALSAAAGSNMKSLHPSSGGFMHLAAATQSAGGGMPHTHMPAAQLSFGTMPVPLKPSSDQKPAAGK

SEQ ID NO: 4050 - protein, 90 aa, Zea mays
  UNSURE (1)..(90): unsure at all Xaa locations
  Clone ID: PAT_MRT4577_100678C.1.pep
  unsure (1)..(90): unsure at all Xaa locations
KNKAPXWHDHLQCWCLNFHGRVTVASVKNFQLVATAGSGGPWGVGDEETVILQFGKIEDDAFTMDYRQPLSAFQAFAICLTSFGTKLACE

SEQ ID NO: 4051 - protein, 195 aa, Zea mays
  Clone ID: PAT_MRT4577_100772C.1.pep
METEEAYEMVLNDVLGFMLLSTPRVDSQLPRSLFFSRSGSAAVAAMDVSGAGGKAKKGAAGRKAGGPTKKSVSRSSRAGLQFPVSRVGRYLKKGRYAQRVGTGAPVYLAAVLEYLAAEVLELAGNAARDNKKTRIIPRHVLLAIRNDEELGKLLAGVTIAHGGVLPNIHTVLLPKKVAEKAAKEPKKAAKSPKKA

SEQ ID NO: 4052 - protein, 419 aa, Zea mays
  Clone ID: PAT_MRT4577_100776C.1.pep
MAARVLPPPLTLVLLLLLLPLSARDTVAAGEDFPRDGRVIDLDESNFEAALGAIDFLFVDFYAPWCGHCKRLAPELDEAAPMLAGLSEPIVVAKVNADKYRKLGSKYGVDGFPTLMLFIHGVPIEYTGSRKADQLVRNLKKFVAPDVSILESDSAIKNFVENAGTSFPMFLGFGVNDSFIAEYGRKYKKRAWFAVAKDFSEDVMVAYEFDKVPALVAIHPKYKEQSLFYGPFEENFLEDFVRQSLLPLVAPINTETIKMLNDDQRKVVLTIMEDDSDENSTQLVKILRSAASANRDLVFGYVGIKQWDEFVETFDVSKSSQLPKLLVWDRNEEYELVDGSERLEEGTDQASQISQFLEGYRAGRTTKKKISGPSFMGFLNSLVSLTSLYILIFVIALLFVMVYFAGQDDTPQPRRIHEE

SEQ ID NO: 4053 - protein, 552 aa, Zea mays
  Clone ID: PAT_MRT4577_100777C.1.pep
MAQKKKKKKKKKKKKKKKKKKKKKKKKKRAPATAMAAKVLPPALLSFILLLLLSLSAREEGVPFPYFRRGGDRIERPPRRWRLESCHRLCSLSYSCCCSRSQTSRPAGGPGKLVKFSAPILPARRRSNRAPATAMATRVLPPALLSLVLLLLLSLSARDTVAAGEDFPRDGRVIDLDDSNFEAALGAIDFLFVDFYAPWCGHCKRLAPELDEAAPVLSGLSEPIVVAKVNADKYRKLGSKYGVDGFPTLMLFIHGVPIEYTGSRKADQLVRNLKKFVSPDVSILESDSAIKNFVENAGISFPIFLGFGVNDSLIAEYGRKYKKRAWFAVAKDFSEDIMVAYEFDKVPALVAIHPKYKEQSLFYGPFEENFLEDFVRQSLLPLVVPINTETLKMLNDDQRKVVLTILEDDSDENSTQLVKILRSAANANRDLVFGYVGIKQWDGFVETFDVSKSSQLPKLLVWDRDEEYELVDGSERLEEGDQASQISQFLEGYRAGRTTKKKITGPSFMGFLNSLVSLNSLYILIFVIALLFVMVYFAGQDDTPQPRRIHEE

SEQ ID NO: 4054 - protein, 158 aa, Zea mays
  UNSURE (1)..(158): unsure at all Xaa locations
  Clone ID: PAT_MRT4577_101009C.1.pep
  unsure (1)..(158): unsure at all Xaa locations
FGSRWSQAVGFRWRELQSCVRTXRRCLETMARSNLRLDIHGGRKCEGXGLDIQDLSHDGCWGXLKTSGTFNPSKGCTLXTYVDWWMRGSLKKSIFKNSXLMRLPQSVYALSRTVIKARMECIMDGEHPTIDVVVRLAGITIEMLAKLIAKTRKVRYMH

SEQ ID NO: 4055 - protein, 122 aa, Zea mays
  Clone ID: PAT_MRT4577_101107C.1.pep
TTPRRVRTRRVFGARVRGGADSRWRGSDVENRWLPGGLACATDDHSLHNAFSTYGEALESKIILDRETQRSRGCGLATFFTEEAMRNAIEGMNGKELDGPNMTENEVQSLCGRGGGGGGYGG

SEQ ID NO: 4056 - protein, 202 aa, Zea mays
  Clone ID: PAT_MRT4577_101123C.1.pep
MASIVASRRAVPLVRALEKLIAASSAPGTGSALRPVAVAGGLRGYNTGAPLRRYEGAESEDDSVREYDGRHGGRDYAVPSLFSGNIFRDPLSAPHSIGRLLNLMDDLAVAAPGRAVRRGWNAKEDEEALHLRVDMPGLGKEHVKVWAEQNSPPPRYSGRIELAPEVYRMDKIKAEMKNGVLKVVVPKVKEQQRKDVFQVNVE

SEQ ID NO: 4057 - protein, 219 aa, Zea mays
  UNSURE (1)..(219): unsure at all Xaa locations
  Clone ID: PAT_MRT4577_101127C.1.pep
  unsure (1)..(219): unsure at all Xaa locations
MASIVASRRAVPLVRALEKLIAASSAPGTGSALRPVAVAGGLRGYNTGAPLRRYEGAESEDDSVREYDGRHGGRDYAVPSLFSDIFRDPLSAPHSIGRLLNLVDDLAVAAPGRAVRRGWNAKEDEEALHLRVDMPGLGKEHVKVWAEQNSLVIKGEGEKEDSEDEAAPXPPRYSGRIELAPEVYRMDKIKAEMKNGVLKVVVPKVKEQQRKDVFQVNVE

SEQ ID NO: 4058 - protein, 190 aa, Zea mays
  Clone ID: PAT_MRT4577_101162C.1.pep
QQQQLSLSHKTATWLRRRPRRWRWRSPRSPPPPPADDSKALAIVEKVADEPAPEKPAPAKQGGSNDRDLALARVETEKRNSLIKAWEENEKTKAENKAAKKVSAILSWENTKKANIEAELKKIEEQLEKKKAEYAEKMKNKVAMIHKEAEEKRAMVEAKRGEEVLKAEEMAAKYRATGHAPKKLIGCFGA

SEQ ID NO: 4059 - protein, 199 aa, Zea mays
  Clone ID: PAT_MRT4577_101166C.1.pep
MAEEEAKKVEVEVTKEPEAAAKEDVADDKAVIPATDPPPPPPPADDSKALAIVEKVADEPAPEKPAPAKQGGSNDRDLALARVETEKRNSLIKAWEENEKTKAENKAAKKVSAILSWENTKKANIEAELKKIEEQLEKKKAEYAEKMKNKVAMIHKEAEEKRAMVEAKRGEEVLKAEEMAAKYRATGHAPKKLIGCFGA

SEQ ID NO: 4060 - protein, 205 aa, Zea mays
  Clone ID: PAT_MRT4577_101168C.1.pep
MAEEEAKKVEVEVTKEPEAAPASAAEAAAKEDVADDKAVIPATDPPPPPADDSKALAIVEKVADEPAPEKPAPAKQGGSNDRDLALARVETEKRNSLIKAWEENEKTKAENKAAKKVSAILSWENTKKANIEAELKKIEEQLEKKKAEYAEKMKNKVAMIHKEAEEKRAMVEAKRGEEVLKAEEMAAKYRATGHAPKKLIGCFGA

SEQ ID NO: 4061 - protein, 199 aa, Zea mays; identical to SEQ ID NO: 4059
  Clone ID: PAT_MRT4577_101170C.1.pep

SEQ ID NO: 4062 - protein, 189 aa, Zea mays
  Clone ID: PAT_MRT4577_101249C.1.pep
PLLSGVAYAQRVVHADREGFERHQGWIIKTMKHEPSPAQDEYAPVVYSQETVSYIEGLDMMSGEEDRENILRSRASGKAVLTRPFRLMSNHLGVVLTFPVYHADLPSDAKEEDRVAATAGYLGGAFDVESLVENLLRQLAGNQELVVNVYDVTNISNPLVMYGSEVPLGNPSSSHICMLDFGDPFRKHH

SEQ ID NO: 4063 - protein, 104 aa, Zea mays
  Clone ID: PAT_MRT4577_101312C.1.pep
MLAESNSASSYRGGTSREMLRATEEVLATSRVPVGLVNITRLSEYRRDAHTQTYKKQWVEPTAEQRADPRSYADCTHWCLPGVPDTWNELLYWKLFFPSNDQVL

SEQ ID NO: 4064 - protein, 391 aa, Zea mays
  Clone ID: PAT_MRT4577_101314C.1.pep
RSSSSPCWRSSPPPPPGQGEEGGGPPLPFALGAAPAGCDVAQGEWVRDDDARPWYQEWECPYIQPQLTCQAHGRPDKAYQSWRWQPRGCSLPSSFNATLMLEMLRGKRMLFVGDSLNRGQYVSLLCLLHRAIPDGAKSFETVDSLSVFRAKNYDATIEFYWAPMLAESNSDDAVVHSADDRLIRGAPMDRHSSFWKGADVLVFNSYLWWVAGDKIQILRGADNDPSKDIVEMKSEEAYRLVLHQVVRWLERNVDPGKSRVFFVTASPTHTDGRAWGDDDAEGSSNCYNQTSPISAASSYRGGTSREMLRATEEVLATSRVPVGLVNITRLSEYRRDAHTQTYKKQWVEPTAEQRADPRSYADCTHWCLPGVPDTWNELLYWKLFFPSNDQV

SEQ ID NO: 4065 - protein, 393 aa, Zea mays
  Clone ID: PAT_MRT4577_101317C.1.pep
MKVLVLAVLALVAAASAAGQGEEGGGPPLPFALGAAPAGCDVAQGEWVRDDDARPWYQEWECPYIQPQLTCQAHGRPDKAYQSWRWQPRGCSLPSFNATLMLEMLRGKRMLFVGDSLNRGQYVSLLCLLHRAIPDGAKSFETVDSLSVFRAKNYDATIEFYWAPMLAESNSDDAVVHSADDRLIRGAPMDRHSSFWKGADVLVFNSYLWWVAGDKIQILRGADNDPSKDIVEMKSEEAYRLVLHQVVRWLERNVDPGKSRVFFVTASPTHTDGRAWGDDDAEGSGNCYNQTSPISAASSYRGGTSQEMLRATEEVLATSRVPVGLVNITRLSEYRRDAHTQTYKKQWVEPTAEQRADPRSYADCTHWCLPGVPDTWNELLYWKLFFPSNDQVL

SEQ ID NO: 4066 - protein, 165 aa, Zea mays
  UNSURE (1)..(165): unsure at all Xaa locations
  Clone ID: PAT_MRT4577_10137C.1.pep
  unsure (1)..(165): unsure at all Xaa locations
LSPAGTSVCENXPILQXPTAIHQCNSXMAVLPLXPLCLQHSXALLQQXPLVHLLGQNIRFFQLQQLVLANLAAYCQXQQILPFNXQLGSLNSASYLRQQQLPFSQLPAAYPQQYIAFNQLAAXLNCTAYLQEHQLLPFMQLAGVSHATLLXQPQMMPFYHHVAPN

SEQ ID NO: 4067 - protein, 66 aa, Zea mays
  Clone ID: PAT_MRT4577_101478C.1.pep
LFYAVQVSIPKRVKVATAAEITEGGGTTYTITSRSLSLQHHEHTPAPTILAMPASNRMHITLMIRA

SEQ ID NO: 4068 - protein, 47 aa, Zea mays
  Clone ID: PAT_MRT4577_101706C.1.pep
FLVHSHLPFIPFELQLTLNISTFSPHKLITCHLLVLHINAESLFLAL

SEQ ID NO: 4069 - protein, 348 aa, Zea mays
  UNSURE (1)..(348): unsure at all Xaa locations
  Clone ID: PAT_MRT4577_101720C.1.pep
  unsure (1)..(348): unsure at all Xaa locations
MMPVAAVDDWSERGFSLTCEEDCADLGNGVVDDDEFLPLYNAGEEEEEEYLEQLVFKETSLCSSSDSAADCDGDGEGDEEYPSLASEEWFRQARLAAVKWILETRGCFGFGHRTAYLAIAYFDSFLLRRRVDREAMPWAAQLLSVACVSVAAKMEECQVPALSEFHAGGYDFDSASIRRMELLVLSTLGWRMGAVTPLDFLPCFSSRVXARRRRRRRXVAHKAIGFIFATAEAGSVLDHRPSTVAAAAILAATYGPLLTKEALDSKMSYLSPSCLIEKEHVHACYSMMVGDNNRRGSKRSLPCSGSNEIATSTYHSVLVDDVTDTAAAFATAVSARNKRIRLELTGIS

SEQ ID NO: 4070 - protein, 264 aa, Zea mays
  Clone ID: PAT_MRT4577_101955C.1.pep
LLGHLTPKQKDIIYKLEAHDRFKRNAVGSALYIHPCLSELSEVNAEHRANTFRDDLVDSLVDSITVRDGVKANFFMNILSLANSAGEKVLAFSQYISPMIFFERLLVKKKGWHVGKEIFMISGDTSQEDRELATDHFNNSADAKIMFGSIKACGEGISLVGASRVVILDVHLNPSVTRQAIGRAFRPGQQKKVFVYRLVAADSDEVKVHETAFKKEVIPKLWFEWSEHCTTEDFKLGQIDIDDSGDELLDTKAIRKDIKALYRR

SEQ ID NO: 4071 - protein, 199 aa, Zea mays
  UNSURE (1)..(199): unsure at all Xaa locations
  Clone ID: PAT_MRT4577_102061C.1.pep
  unsure (1)..(199): unsure at all Xaa locations
QRRKHNTSTNNGSQKFRLLTLAGLSARAATATIFPHCSXQAAIACLLPPYLSPEVASVCENPILQPYRIQQAITGGMLPLSPLLLQQSSALLHQVPLMHSLAQNIRARQLQHLGLPHLAAYSQQQLFLALNQLAVLNSASYEQQQQLPFTQLTAAYPQYFLPFNQPTALNSPAYLQEQQLLPFRQLAGVSPATFLIQPQ

SEQ ID NO: 4072 - protein, 59 aa, Zea mays
  Clone ID: PAT_MRT4577_102085C.1.pep
AAHRYGIKRVILPERNLKDLSEVPSPILSGMEILLVKHIEDVLDHAFEGGCPLKSRSKL

SEQ ID NO: 4073 - protein, 74 aa, Zea mays
  UNSURE (1)..(74): unsure at all Xaa locations
  Clone ID: PAT_MRT4577_102318C.1.pep
  unsure (1)..(74): unsure at all Xaa locations
MSCNCGSSCGCGSSCTCGKKYPDLEATSTGGQATVTLEGGREKKAAPXFVQGAAALREAPHGWSXGGNWKCDPC

SEQ ID NO: 4074 - protein, 79 aa, Zea mays
  UNSURE (1)..(79): unsure at all Xaa locations
  Clone ID: PAT_MRT4577_102583C.1.pep
  unsure (1)..(79): unsure at all Xaa locations
MAAKIGRLIMLLGLSASASSSSIFPXCSQAPIASLLSPYLSPAMSSVCENPIFIPYRIQQAILASNFYLLSPLAAITPF

SEQ ID NO: 4075 - protein, 147 aa, Zea mays
  Clone ID: PAT_MRT4577_102590C.1.pep
LRVRGRVGARKGKKARRKKELRPLDVLDDENDGDEDGGGGGSDSTESSAGGSGGGERQREHPFVVTEPGEVARAKKNGLDYLFHLYEQCRVFLLQVQSLAKLGGHKFPTKVTNQVFRYAKKCGASYINKPKMRHYVHCYALHCLDED

SEQ ID NO: 4076 - protein, 57 aa, Zea mays
  Clone ID: PAT_MRT4577_102632C.1.pep
QKKTNLIHKQKGSQIFLHTYMLMVEDAVDHLKLNTYLLRLIQLVATSEVHMLTDDKF

SEQ ID NO: 4077 - protein, 104 aa, Zea mays
  UNSURE (1)..(104): unsure at all Xaa locations
  Clone ID: PAT_MRT4577_102752C.1.pep
  unsure (1)..(104): unsure at all Xaa locations
WAPKDPRVLGDPPGDFVPDRFLGEEGSKLFQYVYWSTGRETENPRVDNKQCPGKNFVVLVGRFLLVEFFLRXDTFPPEVGKELLGPRVFFPGVPKATSXGPGSE

SEQ ID NO: 4078 - protein, 367 aa, Zea mays
  Clone ID: PAT_MRT4577_102819C.1.pep
MERELLETFDAAKKAADATAGQGDSPEAGRCLDALHRLRDIRVNTDILVSTQVGKRLRPLTKHPHSGIQAVASDLFGYWKKVVLEETGKKNGSSENEKSMDSSGKVEKVRPMKVEKNSASASMKVEKRDVDDRGQKPDNVKVEKTASNGSRTQSVKVERVSKEVNRTDAKKPASVPNGHPKLTSLVKCNDPTRDKIRELLAEAFVRVSRETSDDDRDEVKNILDEVEACDPYRVAVTVESALFERLGPSTGTHRAKYRSIMFNLRAENNTDFRRRVLIGLVTPERLPDISPDEMASDARKQENMQIKEKALFDCERGAAPKATTDQFKCGRCGQRKTTYYQLQTRSADEPMTTFVTCVNCNNHWKFC

SEQ ID NO: 4079 - protein, 316 aa, Zea mays
  Clone ID: PAT_MRT4577_102820C.1.pep
VGKRLRPLTKHPHSGIQAVAADLFGYWKKVVLEESGKKNGGSENERSSDSSGKVEKVRPVKIEKNSASASMKLEKRDVDVRGQKPNNVKVEKTTSNGSKAQSVKVERVSKEVIRTPDSKRPASVPNGHPKLTSLVKCNDPTRDKIRELLAEAFVSVSRETSDDDRDEVKNILDEVEACDPYRVAVTVESALFERLGPSTGTHRAKYRSIMFNLRAENNTDFRRRVLIGLVAPERLPDIPPDEMASDARKQENMQIKEKALFDCERGAAPKATTDQFKCARCGQRKTTYYQLQTRSADEPMTTFVTCVNCNNHWKFC

SEQ ID NO: 4080 - protein, 66 aa, Zea mays
  Clone ID: PAT_MRT4577_102894C.1.pep
SLESAMKEAKSNGADKADAKLAAKSKVADKPAKGKKGKDGKDPNKPNRAPSAFFEFIDEFHKEFKE

SEQ ID NO: 4081 - protein, 107 aa, Zea mays
  UNSURE (1)..(107): unsure at all Xaa locations
  Clone ID: PAT_MRT4577_102912C.1.pep
  unsure (1)..(107): unsure at all Xaa locations
MRRPKVACGPGGEGLGKGGAKRHRKVLRDNIQGITKPAIRRLARRGGVERIXGLIYEETRGVLKIFLENVIRDDCNYTEHARRKTVTGMDVVYPLKRQGRSVYGFGS

SEQ ID NO: 4082 - protein, 73 aa, Zea mays
  Clone ID: PAT_MRT4577_102920C.1.pep
MATTTDLGFEATELRLGLPGGGGGGEPALCGKERSSCCAYGMRGYSETMDLKLKLEPAAAVEAYDDEEDHGVG

SEQ ID NO: 4083 - protein, 340 aa, Zea mays
  Clone ID: PAT_MRT4577_102951C.1.pep
MTSCGCLMLEKVEGDASAKTRVKAAPGAGAGAWCGSCAGDWRGRSEAIFPIYVMGSSRESTVAAARGIVDSPEDPIWVAVKAEAKSEAEKEPILSSFLYASVLSHDCLERALSFVLANRLEDPTLLATQLIDIFNDVMLNNKDICRSIRLDAQAFKDRDPACAQYSWALLYLKGYQSLQSYRIANILWNQGRKVLALALQSRISEVFAVDIHPAAKIGEGILLDHGTGLVIGETAVVGNWVSLMQGVTLGGTGKEHGDRHPKIGQGALIGASATILGNINVGEGAMIAAGSLVLKDVPPHSMAVGNPAKVVGYTEKEDPSLTMKHDARRDYFEHAAIRLR

SEQ ID NO: 4084 - protein, 126 aa, Zea mays
  UNSURE (1)..(126): unsure at all Xaa locations
  Clone ID: PAT_MRT4577_102973C.1.pep
  unsure (1)..(126): unsure at all Xaa locations
RKPKNILLHIYLHISLTDFQLCFFTSRRXQMFLPHYIDKKKKRRNSISNPIFFAEPILSSNSFVGTXEYISPDIITRAGHTSSVYCFALGILLYEILYCYTLFIGKTIHKTFTNIFYKDIIFSVSI

SEQ ID NO: 4085 - protein, 409 aa, Zea mays
  Clone ID: PAT_MRT4577_103013C.1.pep
MAVVAGDSESLMQRCKPYVAMISLQFGYAGMNVITKVSLNHGMSHYVLVVYRHAFATLSIAPFALVLERKVRPRMTLWAFLQIFVLALLGPVIDQNFYYAGLKFTSPTFSCAMSNMLPAMTFVLAVLFRMEKVNLKKARCVAKVVGTLVTVAGAMLMTLYKGRVVELVWTKHIHLHGPHPDAAAAAAAADKDWFTGSIFLIIATLAWASLFILQAATLKRYDAPLSLTTLICFVGTLQAIVVTFVMEREPSVWRIGFDMNLLAAAYAGIVTSSIAYYVQGLVIQSRGPVFASAFSPLMMIIVAIMGSFILAENIYLGGIIGSVLIVAGLYSVLWGKHKENEEKEGEAAMEIPVAIKAVDGNGRIMEIVELDEVQLEKAQANTNANANAAVAVTAVPAAEARMQGKDDQA

SEQ ID NO: 4086 - protein, 133 aa, Zea mays
  UNSURE (1)..(133): unsure at all Xaa locations
  Clone ID: PAT_MRT4577_103148C.1.pep
  unsure (1)..(133): unsure at all Xaa locations
GRERVXRVQEGGEGXQAQAAPRRXAAPSPPGPSHFTKSPRRKRTXGARAPPQDQEEGSGGGGRRLRGFRLPRAPRKKKGPQGGPGGRRQKKAPLFRLIDPPVSSSLPXCATGGCVKXIERPPFCGGVRMYALV

SEQ ID NO: 4087 - protein, 75 aa, Zea mays
  UNSURE (1)..(75): unsure at all Xaa locations
  Clone ID: PAT_MRT4577_103156C.1.pep
  unsure (1)..(75): unsure at all Xaa locations
FAIGSAALVSLALFGSFVIIAGGNIFDVLSPNLFINXIVXALLPYXFSAITMNSVGSSSLNMVDYVHTQFNTIPF

SEQ ID NO: 4088 - protein, 191 aa, Zea mays
  Clone ID: PAT_MRT4577_103177C.1.pep
LDSAQFFHQALYLGGVTAAPARPTLRLMKQNLAFLSSVLTEQAQLPAVLEVMRASVEAFLTVVLAGGSGRAFARGDHAAVAADFASLKRLFCSFGVGEEAVERETVRAEGVLALMAVPTEQLIHELLGHYASTPMRAAGDELPQLPMMPMTPTARRWSRSDANTVLRVLCYRDDEPANRFLKKTFNLPKRR

SEQ ID NO: 4089 - protein, 287 aa, Zea mays
  UNSURE (1)..(287): unsure at all Xaa locations
  Clone ID: PAT_MRT4577_103195C.1.pep
  unsure (1)..(287): unsure at all Xaa locations
RSRLMESDLHHFIKANDDLTKEHYQFFLYQLLRALKYIHTANVYHRDLKPKNILANSNCKLKICDFGLARVAFNDTPTTIFWTDYVATRWYRAPELCGSFFSKYTPAIDVWSIGCIFAEVLTGKPLFPGKNVVHQLDLMTDLLGTPSMDTISRVRNEKARRYLSSMRKKELISFSHKFPNADPLALDLLQRLLAFDPKDRPTAEEALSHPYFKGLAKVEREPSCQPITKMEFEFERRRVTXEDIRELIFREILEYHPTLLKDYTNGTERXTFLYPSAVDHFRXQFAH

SEQ ID NO: 4090 - protein, 45 aa, Zea mays
  Clone ID: PAT_MRT4577_103258C.1.pep
GAGFPGPLTPEQVADPKSYADCTHWCLPGLQDTWNELLYSKLFFP

SEQ ID NO: 4091 - protein, 210 aa, Zea mays
  UNSURE (1)..(210): unsure at all Xaa locations
  Clone ID: PAT_MRT4577_10326C.1.pep
  unsure (1)..(210): unsure at all Xaa locations
MARERREIRRIESAAARQVTFSKRRRGLFKKAEELAVLCDADVALVVFSATGRLSQFASSSVNDIVDKYSTHSKNLGKSHQQPSIDLNVEQSKYSGLNEQLAEETNGLRQMRGEDLEGLSVEELHRMERKLEAGLHRVISTKDQLFMQQIGELLQKGTQLEDENRASKRTKNILTEDGQSSESVMTALHSGSSLDCDDGSDISXLKLSLP

SEQ ID NO: 4092 - protein, 225 aa, Zea mays
  Clone ID: PAT_MRT4577_10330C.1.pep
MARERREIRRIESAAARQVTFSKRRRGLFKKAEELAVLCDADVALVVFSATGRLSQFASSSVNDIVDKYSTHSKNLGKSHQQPSIDLNVEQSKYSGLNEQLAEETNGLRQMRGEDLEGLSVEELHRMERKLEAGLHRVISTKDQLFMQQIGELLQKGTQLEDENRRLKEQMPQVLTAGTMVVAAAAENILTEDGQSSESVMTALHSGSSLDCDDGSDISLKLSLP

SEQ ID NO: 4093 - protein, 174 aa, Zea mays
  Clone ID: PAT_MRT4577_103363C.1.pep
MAMATSASYPPPPPFYRLYKKFEQDPSSAPEPPPPIDEPFKALGVDYTGDVVIPSLESHNVRQLYPKGPNIDFKKELRTLNRELQLHILELADILVERPSQYARRVEDITLIFKNLHHLLNSLRPHQARATLIHMLESQIRHRKEAIEDIKQRREEAQKMLGESLLILDGSQTN

SEQ ID NO: 4094 - protein, 174 aa, Zea mays
  Clone ID: PAT_MRT4577_103367C.1.pep
MAMATSSSYPPPPPFYRLYKNFEQDPSSAPEPPPPIDGPFKALGVDYTGDVVIPSLESHNVRQLYPKGPNIDFKKELRTLNRELQLHILELADILVERPSQYARRVEDITLIFKNLHHLLNSLRPHQARATLIHMLESQIQRRKEAIEDIKQRRVEAQKLLGESLHILDASQAN

SEQ ID NO: 4095 - protein, 135 aa, Zea mays
  UNSURE (1)..(135): unsure at all Xaa locations
  Clone ID: PAT_MRT4577_10366C.1.pep
  unsure (1)..(135): unsure at all Xaa locations
QHLVLESIHAYSQQQQFLPFNQLAALNSAAYLQQQLPFSQLAAAYPQQLLPFSQLTALNYAAYLQQQQLPPFSQLSDVSPXAAFLTQQQLLLFYSRYAPSVGTLLQLQRLLPFSQHALSNTAAFYRQTIIGGALF

SEQ ID NO: 4096 - protein, 153 aa, Zea mays
  Clone ID: PAT_MRT4577_10397C.1.pep
MSLVRRSSVFDPFSVDLFDPFDSMFRSIVPSSSSAAASETAAFASARIDWKETPEAHVFKADLPGVKKEEVKVEVEDGNVLLISGQRSREEEDKGDKWHRVERSSGQFVRRFRLPENAKTEEVRAALENGVLTVTVPKAEVKKPEVKSIQISG

SEQ ID NO: 4097 - protein, 77 aa, Zea mays
  Clone ID: PAT_MRT4577_104004C.1.pep
RWGPPGQVILFPPLVFSLVQRVYLRSSRLVWPLWVFDCKVALCQLLMLCSSPAPADPCVNQHGMWIGGYCYPRQDLF

SEQ ID NO: 4098 - protein, 350 aa, Zea mays
  Clone ID: PAT_MRT4577_10400C.1.pep
MDQSFGNLGAGAGSSSGGSNSKAAAAAVSSSSFLQLPLSTASPAYYGAPLALLHHAAAAPSSSQQQQQHHHHQYARHGAEMSAAEAEAIKAKIVAHPQYSALLAAYLDCQKVGAPPDVLERLTAMAAKLDARPPGRHEPRDPELDQFMEAYCNMLVKYREELTRPIDEAMEFLKRVEAQLDCISGGGGSSSARLSLADGKSEGVGSSEDDMDPNGRENDPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGS

SEQ ID NO: 4099 - protein, 326 aa, Zea mays
  Clone ID: PAT_MRT4577_104121C.1.pep
MADNAKAAAAHARPESSQEEEEDWKEAEGDVAEVDRAATNGAGEGGVPTDRPIRVYADGIYDLFHFGHAKSLEQAKKSFPNTYLLVGCCNDELTHKFKGRTVMTEDERYESLRHCKWVDEVIPDAPWVVTEEFLDKHNIDFVAHDSLPYADASGAGNDVYEHVKKLGKFKETQRTDGISTSDIIMRIVKDYNEYVMRNLARGYTRKDLGVSYVKEKRLRVNMGLKNLRDRVKQHQEKVGEKWSTVAKLQEEWVENADRWVAGFLEKFEEGCHSMGTAIKERIQERLIKAQSSDFGSLLQYDSYDSDEAKENDEDEDEDELFEDVKE

SEQ ID NO: 4100 - protein, 71 aa, Zea mays
  Clone ID: PAT_MRT4577_104216C.1.pep
HGAPPSDPCPCVSHSTSQLKPDACLCSNPSSPSFFDLGFQTQHSKAGKFLGPTSFSAQICSSPIADVTATT

SEQ ID NO: 4101 - protein, 245 aa, Zea mays
  UNSURE (1)..(245): unsure at all Xaa locations
  Clone ID: PAT_MRT4577_104403C.1.pep
  unsure (1)..(245): unsure at all Xaa locations
MGRGKVQLKRIENKINRQVTFSKRRSGLLKKAHEISVLCDAEVALIIFSTKGKLYEYSTDSCMDKILDRYERYSYAEKVLISVESETQGNWCHEYRKLKAKVETIQKCXRHLMGEDLETVNLKELQQLEQQLESSLKHIRTRKSQLMLESISELQRKEKSLQEENKVLQKELAEKQKAQRKQVQWGQTQQQTSSSSSCFMIREAAPTTNISIFPVAAGGRLVEGAAAQPQARVGLPPWMLSHLSS

SEQ ID NO: 4102 - protein, 363 aa, Zea mays
  UNSURE (1)..(363): unsure at all Xaa locations
  Clone ID: PAT_MRT4577_104555C.1.pep
  unsure (1)..(363): unsure at all Xaa locations
MINHHEIVQFGKLYNRDMESAPAHTPLIHGLPDEVALICLARVPRRYHNILRRVSRRWRALLCSEEWHLCRKRNNLDEPWIYVICREAGIKCYVLAPDPPSRCFRIMHVIEPPCSGRKGVTIEALDKKLFLLGGCSSVYDATDEVYCYDASSNRWSSAAPMPTARCYFVSASLKEKLYITDGYGLTDKSPNSWDIYDPATDSWCTHKNPLLTPDIVKFVALGEELVXFTERRGTGCTXAGVYDPLERTWRGRGNEIALCYSSPTVVVDGTLYMLEQSMGTKLMVWREDAKEWAMLGRLSDKVTRPPCALVAIGRKIHVVGRGLSMVTVDVDTAARVDGFLVTTSVGPLVEEDLTPERCVVITI

SEQ ID NO: 4103 - protein, 76 aa, Zea mays
  UNSURE (1)..(76): unsure at all Xaa locations
  Clone ID: PAT_MRT4577_104608C.1.pep
  unsure (1)..(76): unsure at all Xaa locations
MVGTAEGGADRAVRRWVDAVGKRLVLDCRLATELXINCADLNDTVWSAKCLISSSDLIRKVHMDYLETGANIIITA

SEQ ID NO: 4104 - protein, 74 aa, Zea mays
  UNSURE (1)..(74): unsure at all Xaa locations
  Clone ID: PAT_MRT4577_10482C.1.pep
  unsure (1)..(74): unsure at all Xaa locations
MAGRIFCKLMLLGLSASVATATIFPQCSQAPIASLLPPYLSPAVSAMCETPIVQPYKIHXAIATSILPLSPLNL

SEQ ID NO: 4105 - protein, 48 aa, Zea mays
  Clone ID: PAT_MRT4577_10491C.1.pep
TKRPPHPDLPTSLIEVLRIPPLQLTASAHPLKAHAACLKLFNTTLYRV

SEQ ID NO: 4106 - protein, 69 aa, Zea mays
  Clone ID: PAT_MRT4577_104966C.1.pep
MESTFIMIKPDGVQRGLIGVIISRFEKKGCYLKALKLDHAQRSVAEKHYADLACKPFFQGLADYMISVP

SEQ ID NO: 4107 - protein, 76 aa, Zea mays
  UNSURE (1)..(76): unsure at all Xaa locations
  Clone ID: PAT_MRT4577_105105C.1.pep
  unsure (1)..(76): unsure at all Xaa locations
SSQATISTIITSYLSPSMSSLXKNPILQPYNIQHAITSRILPLSPFFLQQSSPLLHQLHLMHLFSQNIRAQQLQQL

SEQ ID NO: 4108 - protein, 48 aa, Zea mays
  Clone ID: PAT_MRT4577_105235C.1.pep
SCVHPRLQQTHASTSMDCGSRGAVTTVRLYSKLNPNEKNCASWCCKSK

SEQ ID NO: 4109 - protein, 57 aa, Zea mays
  UNSURE (1)..(57): unsure at all Xaa locations
  Clone ID: PAT_MRT4577_105517C.1.pep
  unsure (1)..(57): unsure at all Xaa locations
GSPVFDLGGEQIEMAAHDVEYRYYVGRLIWATDDHXIHNAFSTYCEVLXSKIIRVWE

SEQ ID NO: 4110 - protein, 137 aa, Zea mays
  Clone ID: PAT_MRT4577_105598C.1.pep
MAGKGGKGLLAAKTTAAKSAEKDKGKKAPISRSSRAGLQFPVGRIHRQLKQRTQANGRVGATAAVYSAAILEYLTAEVLELAGNASKDLKVKRITPRHLQLAIRGDEELDTLIKGTIAGGGVIPHIHKSLINKSSKE

SEQ ID NO: 4111 - protein, 137 aa, Zea mays; identical to SEQ ID NO: 4110
  Clone ID: PAT_MRT4577_105599C.1.pep

SEQ ID NO: 4112 - protein, 162 aa, Zea mays
  Clone ID: PAT_MRT4577_105638C.1.pep
MASPSSSPSRKALSKIACSRLQKELAEWQVNPPAGFKHRVTDDLQRWVIDVAGAAGTLYTGETYKLQVDFPEHYPMEAPQVIFLHPAPMHPHIYSNGHICLDILYDSWSPAMTVSSICISILSMLSSSPEKQRPADNDRYVKNCRNGRSPKETRWWFHDDTV

SEQ ID NO: 4113 - protein, 252 aa, Zea mays
  UNSURE (1)..(252): unsure at all Xaa locations
  Clone ID: PAT_MRT4577_105744C.1.pep
  unsure (1)..(252): unsure at all Xaa locations
LEAGRDRASIIRDXLIADSINDRKRKERLDSVSEETTTIVXRLYHMYESGVLLFPAINVYDSPTDSKIDNLYGCRHSLPDGLMRATDAXIAVKVTVVCGYIDVDNDCAAVLKQDVVRAIVDEIDPICGLQDLMEGLQNLLLXMLALKTDIFXVTTNGNKDIIMPDHMKKIKNNAVVCNIGHFDNENDMLLLEYYPEDXRINIKPHTDRCVFPDNNTAIIVLDXGRLMNLGCATDHPNSDMLWSFTNHVIAQL

SEQ ID NO: 4114 - protein, 109 aa, Zea mays
  UNSURE (1)..(109): unsure at all Xaa locations
  Clone ID: PAT_MRT4577_105790C.1.pep
  unsure (1)..(109): unsure at all Xaa locations
HICVPTLAAIILSLLMLLGLSASAATATIFPXCSQAPICFLFPPFLSPAVSSVCVNPILLPFKIQHAFTAGILPLSPLFLQHSSALLHQFPLVHLLAHYIMAQHLLQLV

SEQ ID NO: 4115 - protein, 415 aa, Zea mays
  Clone ID: PAT_MRT4577_105922C.1.pep
MGQMISGDKSDEQTARDDGIIKNGREILFQAFNWESNKHNWWSILEEKVTDLAESGFTSVWLPPPTQSLSREGYLPQNLYCLDSCYGSLHELKLLLHKMSEHNVRAMADVVINHRIGTTQGSNGMYNRYDGIPVSWDEHAVTSCSGGKGNKSTGDNFDGVPNIDHTQPFVRKDIIEWLIWLRKSVGFQDFRFDFTKGYAAKFVKEYIEESKPLFAVGEYWDSCEYSPPDYRLNYNQDIHRQRIINWIDNTGGLCAAFDFTTKGILQEAVKGELWRLRDSEGKPPGVMGWWPSRSVTFIENHDTGSTQGHWPFPSDHIMEGYAYILTHPGIPTVFYDHFYDQGVPLHDEIAKLMQIRKCQDIHSRSSIKILEVGSDLYSAIIDDKLCMKIGDGSWCPSDPEWRLAVSGDRYAVWHK

SEQ ID NO: 4116 - protein, 261 aa, Zea mays
  Clone ID: PAT_MRT4577_106002C.1.pep
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLETHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQ

SEQ ID NO: 4117 - protein, 261 aa, Zea mays; identical to SEQ ID NO: 4116
  Clone ID: PAT_MRT4577_106003C.1.pep

SEQ ID NO: 4118 - protein, 102 aa, Zea mays
  UNSURE (1)..(102): unsure at all Xaa locations
  Clone ID: PAT_MRT4577_106005C.1.pep
  unsure (1)..(102): unsure at all Xaa locations
PELSREENVYMANLAEQADRYEEIVEFMEKVPKTVDSDELTVEERNLLSVAYNNVIGPRRAXWRIICSIEHNEEGRGNEDRLTLIKDYRGKIETELTKICDG

SEQ ID NO: 4119 - protein, 278 aa, Zea mays
  Clone ID: PAT_MRT4577_106010C.1.pep
MYICRSGVLQILKLNCKMASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQ

SEQ ID NO: 4120 - protein, 78 aa, Zea mays
  Clone ID: PAT_MRT4577_106098C.1.pep
SVLGYKVDTVDTTGAGDTLVGCLLFNVGTDDCMLHNEEKLREAIKFCNACGAICTTKKGAIPVLSTVDTAQDLIAKAN

SEQ ID NO: 4121 - protein, 406 aa, Zea mays
  Clone ID: PAT_MRT4577_106131C.1.pep
MSSAGGMDGSPPVAEFQPTVTHGGRFLRYNIFGNLFEITRKYQPPVMPIGRGAYGIVCSVMNFETREMVAIKKIANAFDNHMDAKRTLREIKLMRHLDHENIIGIRDVIPPPIPRAFNDVYIGMEFMETDLHQIIRSGQELSEEHCQYFLYQILRGLKYIHSAGVIHRDLKPSNLLLSANCDLKICDFGLARPSSDSDMMTEYVVTRWYRAPELLLNSTDYSAAIDVWSVGCIFMELINRQPLFPGRDHMHQMRLITEARVTHATHPTSPSYNSIPSSSSAHNIAARQVIGTPTDDELGFIRNEDARKYMRHLPQFPRRPFVSLFPRMQPVALDLIERMLTFNPLQRITVEEALEHPYLERLHDVADEPICTDPFSFDFEQQALTEDQMKQLIFNEAIELNPNFRY

SEQ ID NO: 4122 - protein, 390 aa, Zea mays
  Clone ID: PAT_MRT4577_10627C.1.pep
MEIDSLREGFDRVAEKRSLSSAKALEVVDQIVNEIEQAIVKLQMMNTDSTGNVDHPSILAELKAKLNEMAPLNQLEGSQKELNVALSKYLKLLEKSFNPDISKAYRNVDFEVHTVNNIIANHFYRQGLFDLGDMFVHECGELGGASLKLPFQEMYAILEAMKARNLEPALSWAAKNHDQLLQNGSMLEFKLYQLQFVEILSKGSRGEAKDEALLYARTHLVPFAAVHKEEFQKLMACLLWVGRLDQSPYSELMSSAHWEKLAEELTHQFCSLLGQSRESPLSVAVSAGFQGLPTLLKLTQVMAAKKQEWQVMKQLPVPIDIGPEFQYHSVFVCPVLREQSSDENPPMRMPCGHVVSKQSIMKLSKSSSRAFKCPYCPSEAMASHCKQLHF

SEQ ID NO: 4123 - protein, 242 aa, Zea mays
  Clone ID: PAT_MRT4577_106286C.1.pep
MGQGGEVKAAPAVRVLVVDDSPVDRKVVELLLRNHNHQGGAAPFHVTAVDSGKKAMEHLRLMEQGGQLDSCAADANRITIDIVLTDYCMPEMTGYDLLKAIKALSSPNPIPVVVMSSENEPQRISRCLTAGAEDFILKPLKTKDVQRLRNCSSAARPTDGAAHQCESLRSSSRKLRSDQVAAPAHRSQPTTGLTMVLHASSIELSHYFQFLLKFVLLAYAVLCLTELLHRWSNGSVLSLWSA

SEQ ID NO: 4124 - protein, 222 aa, Zea mays
  Clone ID: PAT_MRT4577_106290C.1.pep
RKNEIKFPQHELIKARVSFLSSFGSVTAVDSGKKAMEHLRLMEQGGQLDSCAADANRITIDIVLTDYCMPEMTGYDLLKAIKALSSPNPIPVVVMSSENEPQRISRCLTAGAEDFILKPLKTKDVQRLRNCSSAARPRDDAAHQCESLRRSSRKLRSDQVAAPGHRSQPTTGLTMVLHASSIELSHYFQFLLKFVLLAYAVLCLTELLHRWSNGSVLSLWSA

SEQ ID NO: 4125 - protein, 390 aa, Zea mays; identical to SEQ ID NO: 4122
  Clone ID: PAT_MRT4577_10629C.1.pep

SEQ ID NO: 4126 - protein, 145 aa, Zea mays
  Clone ID: PAT_MRT4577_106327C.1.pep
MGISSMPAPEDSLLGFVLYNTAASVAILAGLVRAALLFLGLAAAEDEEPRQQAEAVTVTAVGPSLADRFRSRFRPSRYGRRRGGDCRVCLVRFETESVVQRLPCGHLFHRACLETWIDYDHATCPLCRHRLLPPAAAADEVPRIA

SEQ ID NO: 4127 - protein, 252 aa, Zea mays
  UNSURE (1)..(252): unsure at all Xaa locations
  Clone ID: PAT_MRT4577_106424C.1.pep
  unsure (1)..(252): unsure at all Xaa locations
MAFFRGLAAVSRLRSRMGQDATTLGGVRWLQMQSASDLDLRSQLQEMIPEQQDRLKKLKSEHGKVQLGNITVDMVLGGMRGMTGMLWETSLLDPEEGIRFRGLSIPECQKVLPAAVKDGEPLPEGLLWLLLTGKVPTKEQVDALSKELLSRSTVPGYVYKAIDALPVTAHPMTQFTTGVMALQVESEFXKAYDKGMPKTKFWEPTYEDCLXLIARLXTSGFYGYRRISRMGSYAADXTLDYAANFXHMLWFD

SEQ ID NO: 4128 - protein, 120 aa, Zea mays
  Clone ID: PAT_MRT4577_106455C.1.pep
MNLHSDQGSNSLGCSDLGWENDTKTPDITSIAPIPTIAEGDESVFVNSNSNSSMVPPVLENNAVDLTDGLTDLESYMRFLMDGGASDSIDSLLNLDGSQDLGSNMDLWTFDDMPIAGDFF

SEQ ID NO: 4129 - protein, 361 aa, Zea mays
  Clone ID: PAT_MRT4577_106460C.1.pep
MCGGAILAELREPAPRRLTERDIWQQKKKPKRGGAGGRRSFAAEDDEDFEADFEDFEADSGDSDLELGEGADDDVIEIKPFAAKSTFSRDGLSTMTTAGYDAPAARLAKRKRKNQYRGIRQRPWGKWAAEIRDPQKGVRVWLGTFNSPEEAARAYDAEARRIRGKKAKVNFPDAPAVGQKCRSSSASAKALKSCVEQKPIVKTDMNILANTNAPFYQSVNYASNNPFVPAMNSTVSFEDPIMNLHSDQGSNSLGCSDLGWENDTKTPDITSIAPIPTIAEGDESVFVNSNSNSSMVPPVLENNAVDLTDGLTDLESYMRFLMDGGASDSIDSLLNLDGSQDLGSNMDLWTFDDMPIAGDFF

SEQ ID NO: 4130 - protein, 98 aa, Zea mays
  UNSURE (1)..(98): unsure at all Xaa locations
  Clone ID: PAT_MRT4577_106556C.1.pep
  unsure (1)..(98): unsure at all Xaa locations
AVTIXGGRGQAGTWGKQLGAEVYDCNNMVEQELPGGGLLIYQSFCAAEDAVATSPKSVLHCFEGVNMENAPPVKDRKLANLLCWEEVDAMEKDGVLDE

SEQ ID NO: 4131 - protein, 56 aa, Zea mays
  Clone ID: PAT_MRT4577_106579C.1.pep
VKRHYSFFRSIYTHGPCHDGGNHCTYTFISALESLLTHRWGQYVFLANKQLGKTSF

SEQ ID NO: 4132 - protein, 184 aa, Zea mays
  Clone ID: PAT_MRT4577_106585C.1.pep
MAMATQGQADQQQQHGRSEPTTSVAANRWGPYSGAGDFASNMAVILAALLAALALGLALNAAVRYLLRRSRRAGSVGGQGNGSGVLMPSDDPAEKPSVEVELQAPPPALLVYSAAGTTLAGAAAECAICLAEFADGDAVRVMPACGHGFHARCIERWLAEGRRSSCPTCRAPAVQRSLHASELL

SEQ ID NO: 4133 - protein, 197 aa, Zea mays
  Clone ID: PAT_MRT4577_106587C.1.pep
MAMATQGQADQQQQHGRSEPTTSVAANRWGPYSGAGDFASNMAVILAALLAALALGLALNAAVRYLLRRSRRAGSVGGQGNGSGVLMPSDDPAEKPSVEVELQAPPPALLVYSAAGTTLAGAAAECAIWTKLAGAAAECAICLAEFADGDAVRVMPVCGHGFHARCIERWLAEGRRSSCPTCRAPAGRRSLHASELL

SEQ ID NO: 4134 - protein, 58 aa, Zea mays
  Clone ID: PAT_MRT4577_106632C.1.pep
LRSGSAVSPRTGSSVRGGTAAATGKKRNATAVLASPPYSPPSSSAPLEDLVSTRRTCL

SEQ ID NO: 4135 - protein, 208 aa, Zea mays
  Clone ID: PAT_MRT4577_106650C.1.pep
MSTVTSCTFLSLGSPVRPAVSSARPAAAAVASRRRPRSLSVCCEAGRKGDHNPKTDLHPFNIPAFVLVHPVAPREERWQLEEDADKVNLWFEVPGQSKDDLTVEIDEDVLVIKKRKELVGQRSPAGGGVAEYGSQSQQQSRRGTADGKELPAAQQGQAGEVVYARMLLPAGYSRDGVQAELKSGVLRVTVVKVTERARRKIDVPIQVK

SEQ ID NO: 4136 - protein, 591 aa, Zea mays
  Clone ID: PAT_MRT4577_106832C.1.pep
MGGEAEGGERRLGRVLSFGIPDTALGLVMGYVEDPWDRDAISLVCRHWCRVDALSRKHVTVAMAYSTTPERLFGRFPCLESLKLKAKPRAAMFNLISDDWGGSASPWIRQLSATFHSLKKLHLRRMIVSNDDINTLVRAKAHMLVSLKLDRCSGFSTPSIALIARSCRKLETLFLEESMIDEKENDEWIRELATSNSVLETLNFFQTDLRASPEYLTLLVRNCQRLKTLKISECFMPDLVSLFRTAQTLQEFAGGSFEDQGQPVAGRNYENYYFPPLLHRLSLLYMGTNEMQILFPYAAALKKLDLQFTFLSTEDHCQIVQRCPNLETLEVRDVIGDRGLQVVAETCKKLQRLRVERGDDDQGGLEDEQGRISQVGMMAIAQGCPELTYWAIYVSDITNAALEAVGTCSRNLNDFRLVLLDREAHITELPLDNGVRALLRGCTKLRRFAFYVRPGALSDVGLGYVGEFSKSIRYMLLGNVGESDNGIIQLSKGCPSLQKLELRGCLFSEHALAMAALELKSLRYLWVQGFRSSPTGTDLMAMVRPFWNIEYILPDQDEPCPEYKKQILAYYSLAGRRTDCPPSVTPLYPAV

SEQ ID NO: 4137 - protein, 638 aa, Zea mays
  UNSURE (1)..(638): unsure at all Xaa locations
  Clone ID: PAT_MRT4577_106833C.1.pep
  unsure (1)..(638): unsure at all Xaa locations
ISQPSLSPSSSSPPHHHTPSPPRTNPKEGEEGNRSAGGNXSRLGXGTMGGEAEGGERRLGRVLSFGIPDTALGLVMGYVEDPWDRDAISLVCRHWCRVDALSRKHVTVAMAYSTTPERLFRRFPCLESLKLKAKPRASMFNLISDDWGGSASPWIRQLSATFHFLKKLHLRRMIVSNEDINILVRAKAHMLVALKLDRCSGFSTPSIALVARSCRKLETLFLEESTIDEKENDEWIRELATSNSVLETLNFFLTDLRASPEYLTLLVRNCQRLKTLKISECFMPDLVSLFRTAQTLQEFAGGSFEEQGQPVASRNYENYYFPPSLHHLSLLYMGTNDMQILFPYATALKKLDLQFTFLSTEDHCQIVQRCSNLETLEVRDVIGDRGLQVVAQTCKKLHRLRVERGDDDQGGLEDEQGRISQVGLMAIAQGCPELTYWAIHVSDITNAALEAVGTCSKNLNDFRLVLLDREAHITELPLDNGVRALLRGCTKLRRFAFYVRPGALSDVGLGYVGEFSKSIRYMLLGNVGESDNGIIQLSKGCPSLQKLEVRGCLFSEHALALAALQLKSLRYLWVQGFRSSPTGTDIMAMVRPFWNIEYIVPDQDEPCPEHKRQILAYYSLAGRRTDCPPSVTLLYPAF

SEQ ID NO: 4138 - protein, 96 aa, Zea mays
  Clone ID: PAT_MRT4577_106856C.1.pep
RNLPGRLLFSSVRSPTRLPHRSSPTSALPPHALATSPSPPRCSHPRLYKCRRSSWRKLRRALAAAAGAREREPRGGGAVARQGQDRFCHRNIIGHE

SEQ ID NO: 4139 - protein, 139 aa, Zea mays
  UNSURE (1)..(139): unsure at all Xaa locations
  Clone ID: PAT_MRT4577_107184C.1.pep
  unsure (1)..(139): unsure at all Xaa locations
MAGKGGKGLLAAKTTRRPSRRSKDTGXKKAPISRSSRAGLQFPVGRIHRQLKQRTQANGRVGATAAVYSAAILEYLTAEVLELAGNASKDLKVKRITPRHLQLAIRGDEELDTLIKGTIAGGGVIPHIHKSLINKSSKE

SEQ ID NO: 4140 - protein, 137 aa, Zea mays; identical to SEQ ID NO: 4110
  Clone ID: PAT_MRT4577_107185C.1.pep

SEQ ID NO: 4141 - protein, 137 aa, Zea mays; identical to SEQ ID NO: 4110
  Clone ID: PAT_MRT4577_107186C.1.pep

SEQ ID NO: 4142 - protein, 67 aa, Zea mays
  Clone ID: PAT_MRT4577_107313C.1.pep
ATPGRRAHTEAGRCGGAGAGAGAYMGVVEPGGCTAEAVVNGSTLGVGSSSRPSCSFGRRRPRQTLTS

SEQ ID NO: 4143 - protein, 66 aa, Zea mays
  UNSURE (1)..(66): unsure at all Xaa locations
  Clone ID: PAT_MRT4577_107364C.1.pep
  unsure (1)..(66): unsure at all Xaa locations
MAIKRTKAEKNIAYDNKLCSLLDGSTKWLIARAXHVGSKQLQDIRRGLRGDSVVLMGKNTLIQRCI

SEQ ID NO: 4144 - protein, 94 aa, Zea mays
  Clone ID: PAT_MRT4577_107366C.1.pep
RNLAEEEPEKYQSHFSKYIKKGIEADDMEALYKKVHAAIRADPSVVKSTKQPPKEHKRYNPKKLTYEQRKASLIERLNQLNSSGGADDDDEDDE

SEQ ID NO: 4145 - protein, 80 aa, Zea mays
  Clone ID: PAT_MRT4577_107370C.1.pep
FSEYIKKGIEADDMEALYKKVHAAIRADPSVVKSTKQPPKEHKRYNPKKLTYEQRKASLIERLNQLNSSGGANDDDEDDE

SEQ ID NO: 4146 - protein, 128 aa, Zea mays
  UNSURE (1)..(128): unsure at all Xaa locations
  Clone ID: PAT_MRT4577_107373C.1.pep
  unsure (1)..(128): unsure at all Xaa locations
FAGFKKDDKQLDADIHRKYIYGGHVADYMRNLAEEEPEKYQSHFSEYIKKGIEAIXMEALYKKVHAAIRADPSVVKSTKQPPKEHKRXNPKKLXIEQRKASLIXRLTNSLLGGADDDDEDTSKVCPIK

SEQ ID NO: 4147 - protein, 71 aa, Zea mays
  UNSURE (1)..(71): unsure at all Xaa locations
  Clone ID: PAT_MRT4577_107426C.1.pep
  unsure (1)..(71): unsure at all Xaa locations
MASPTQGQVITSKAAVAYDNNKPLVIEDVQVAPPQXGEVRVKILFTALCHTDHLSWSGKDPEGLFPCILGH

SEQ ID NO: 4148 - protein, 77 aa, Zea mays
  Clone ID: PAT_MRT4577_107482C.1.pep
LNYQAYSQQHQLPPFSRVAGVSPGALFTQPQLLSFYHRPAPNAGTLLQVRLLLPFNRLAFTNPAAFRQRPIIGGALF

SEQ ID NO: 4149 - protein, 94 aa, Zea mays
  Clone ID: PAT_MRT4577_107781C.1.pep
CNCGSSCGCGSSCKCGKKYLYLEKTSTPAQAAVVLGVAPDKKPAPEFVEPAAKSVESAHAYGSGNSCKFDPCNCCSHRSTTMDMIIIYLACGGG

SEQ ID NO: 4150 - protein, 77 aa, Zea mays
  UNSURE (1)..(77): unsure at all Xaa locations
  Clone ID: PAT_MRT4577_107783C.1.pep
  unsure (1)..(77): unsure at all Xaa locations
MSCNCGSSCGCGSSCKCDKKYPDLEEKSTXXAQATVVLGVAPKKKPAPKFVKPAAKSGEPAHGCSCGGNCKCDPCNC

SEQ ID NO: 4151 - protein, 181 aa, Zea mays
  Clone ID: PAT_MRT4577_107935C.1.pep
MAGATTPASGALVRLCLPSLLLFLYRCCRCEAVEMERTLAMIKPDGLSGKYTEAIKEVILDSGFHIVKETEVQLDAERASVFYAEHSQRSFFDSLVKYITSGPVLAMVLERPDAVAQWRTLIGPTDAKKAKTSHPNSIRAMCGLDSEKNCVHGSDSPESADREISFFFGEAESVTVEHDEL

SEQ ID NO: 4152 - protein, 187 aa, Zea mays
  Clone ID: PAT_MRT4577_107936C.1.pep
MAGATTPASGALVRLCLPSLLLFLYRCCRCEAVEMERTLAMIKPDGLSGKYTEAIKEVILDSGFHIVKETEVQLDAERASVFYAEHSQRSFFDSLVKYITSGPVLAMVLERPDAVAQWRTLIGPTDAKKAKTSHPNSTLCHFSIRAMCGLDSEKNCVHGSDSPESADRGISFFFGEAESVTVEHDEL

SEQ ID NO: 4153 - protein, 64 aa, Zea mays
  UNSURE (1)..(64): unsure at all Xaa locations
  Clone ID: PAT_MRT4577_107976C.1.pep
  unsure (1)..(64): unsure at all Xaa locations
MAAADVXYRCYVGWLAWATSNESLENAFSSYCEILDSKVITDRETGRSRGFSFLTFSSENFILY

SEQ ID NO: 4154 - protein, 81 aa, Zea mays
  Clone ID: PAT_MRT4577_108267C.1.pep
QTDELANGMEKVAVSEPEKHGHNEEEHEVVGEEKEGLLAKLHRTSSRSRSSGDEEEEAVGGDSEVIGRKKKEMGLEERLEE

SEQ ID NO: 4155 - protein, 123 aa, Zea mays
  UNSURE (1)..(123): unsure at all Xaa locations
  Clone ID: PAT_MRT4577_108332C.1.pep
  unsure (1)..(123): unsure at all Xaa locations
LADWSVNSPEGLHLSQEDLIXKFATGVFMGSFLSLAISYPTLASLPHMFINGYNNVLAFAVETNYSYPHADKIKEYLKDPNKFAVPAXAAGDSGASTASKEEEKASEPEKESDEEMGFNLFDD

SEQ ID NO: 4156 - protein, 74 aa, Zea mays
  UNSURE (1)..(74): unsure at all Xaa locations
  Clone ID: PAT_MRT4577_108376C.1.pep
  unsure (1)..(74): unsure at all Xaa locations
MRLRVLSAQPFLAFLSEVQSADRKIPFREKVIYTXISLLILLVCTQLPLYRIHSTTGADPFYWMRXILAXNRGT

SEQ ID NO: 4157 - protein, 76 aa, Zea mays
  UNSURE (1)..(76): unsure at all Xaa locations
  Clone ID: PAT_MRT4577_108660C.1.pep
  unsure (1)..(76): unsure at all Xaa locations
HSSDIGHFDNEIVLLVLETYPGVKRITIKSETVRXVFSETNTGIIVLDEGSLIYLGCAFAHPNLSCSWSFTNQIIV

SEQ ID NO: 4158 - protein, 124 aa, Zea mays
  UNSURE (1)..(124): unsure at all Xaa locations
  Clone ID: PAT_MRT4577_108691C.1.pep
  unsure (1)..(124): unsure at all Xaa locations
MAAKILCLLMLLGLSASAATATILPQCSQAPIAYLLTTYIXSAVYYDCENPIIQPYRIQQAISAGILAISRICLQQLSALLHQVPTAHLLAHNITAHQLQQLVLAKLAVYYHQQQNLAFYQLTA

SEQ ID NO: 4159 - protein, 244 aa, Zea mays
  UNSURE (1)..(244): unsure at all Xaa locations
  Clone ID: PAT_MRT4577_108742C.1.pep
  unsure (1)..(244): unsure at all Xaa locations
MAPLGDAVAPAAAAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAAMRAAKSAGILCSYDPNVRLPLWPSAQAARDGIMSIWKEADFIKVSDDEVAFLTQGDATDEKXVLSLWFEGLKLLIVTD

SEQ ID NO: 4160 - protein, 288 aa, Zea mays
  Clone ID: PAT_MRT4577_108770C.1.pep
MAKDIEASGPEAGEFSAKDYTDPPPAPLVDADELTKWSLYRAVIAEFIATLLFLYITVATVIGYKHQTDAAASGPDAACGGVGILGIAWAFGGMIFILVYCTAGISGGHINPAVTFGLFLARKVSLVRALLYIIAQCLGAICGVGLVKGFQSAYYVRYGGGANELSDGYSKGTGLAPEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 4161 - protein, 146 aa, Zea mays
  Clone ID: PAT_MRT4577_108771C.1.pep
PELSRSLVYRAVIAKFIATLLFLYITVATVIGYKHQTDASASGPDAACGGVGILGIAWAFGGMIFILVYCTAGISCGHINPAVTFGLFLARKVSLVRALLYIVAQCLGAICGVGLVKGFQSAYYVRYGGGANELSDGYSKGTGLAA

SEQ ID NO: 4162 - protein, 289 aa, Zea mays
  Clone ID: PAT_MRT4577_108772C.1.pep
MAKQDIEASGPEAGEFSAKDYTDPPPAPLIDADELTKWSLYRAVIAEFIATLLFLYITVATVIGYKHQTDAAASGPDAACGGVGILGIAWAFGGMIFILVYCTAGISGGHINPAVTFGLFLARKVSLVRALLYIIAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 4163 - protein, 293 aa, Zea mays
  UNSURE (1)..(293): unsure at all Xaa locations
  Clone ID: PAT_MRT4577_108774C.1.pep
  unsure (1)..(293): unsure at all Xaa locations
MAKQDIEASGPEAGEFSAKDYTDPPPAPLVDADELTKWSLYRAVIAEFIATLLFLYITVATVIGYKHQTDAAASGPDAACGGVGILGIAWAFGGMIFILVYCTAGISGGHINPAVTFGLFLARKVSLVRALLYIIAQCLGAICGVGLVKGFQSAYYVRYGGGANELSDGYSKGTGLAAEIIGTFVLVYTVFSATDPKRSARDSXHVPVLAPPSIFGFXAVFMVHLXATIPITGTGINPARSLGAAVIYNKDKAWDDQWIFWVGPLIGAAIAAAYHQYVLRASATKLGSYRSNA

SEQ ID NO: 4164 - protein, 71 aa, Zea mays
  Clone ID: PAT_MRT4577_108925C.1.pep
VCTVAINVWWCLLQSYSGDFCCVSAKSRKEPFFFILWRLSRVVVCTPRNLVCVCWFSWNRKSVWCRPRLPG

SEQ ID NO: 4165 - protein, 198 aa, Zea mays
  Clone ID: PAT_MRT4577_10894C.1.pep
MSALYLQVSIVSQALIFVTRSRSWSFVERPGLLLVTAFLLAQLVATFLAVYANWGFARIKGIGWGWAGVVWLYSIVFYFPLDLIKFFIRFVLSGRAWDNLLENKTAFTTKKDYGREEREAQWATAQRTLHGLQPPEAATNTLFNDKSSYRELSEIAEQAKRRAEIARLRELNTLKGHVESVVKLKGLDIDTIQQNYTV

SEQ ID NO: 4166 - protein, 134 aa, Zea mays
  Clone ID: PAT_MRT4577_108964C.1.pep
ITLEKPRWLIAAANIFVVVHVIGSYQIYAMPVFDMLETFLVKKLRFKPGMPLRLIARSLYVVLTALVGIAVPFFGGLLGFFGGFAFAPTTYYLPCILWLKIKKPKKFSLSWFINWFCIIVGVLLTVLAPIGGLR

SEQ ID NO: 4167 - protein, 591 aa, Zea mays
  Clone ID: PAT_MRT4577_10896C.1.pep
LAARASRTENQDAIDAAMVGMLADPKEARAGIREIHFLPFNPVDKRTALTYIDADGHWHRVSKGAPEQILDLCHCKEDLRRKVHGIIDKYAERGLRSLAVARQEVPERNKESPGGPWQFVGLLPLFDPPRHDSAETIRKALVLGVNVKMITGDQLAIGKETGRRLGMGTNMYPSSALLGQNKDATLEALPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFMLIALIWQYDFSPFMVLIIAILNDGTIMTISKDRVKPSPLPDSWKLKEIFATGIVLGSYLALMTVIFFWAMHKTDFFSDKFGVRSIRDSEHEMMSALYLQVSIVSQALIFVTRSRSWSFVERPGLLLVTAFLLAQLVATFLAVYANWGFARIKGIGWGWAGVVWLYSIVFYFPLDLIKFFIRFVLSGRAWDNLLENKTAFTTKKDYGREEREAQWATAQRTLHGLQPPEAATSTLFHDKNSYRELSEIAEQAKRRAEIARLRELNTLKGHVESVVKLKGLDIDTIQQNYTV

SEQ ID NO: 4168 - protein, 951 aa, Zea mays
  Clone ID: PAT_MRT4577_10899C.1.pep
MGGLEEIKNEAVDLENIPIEEVFEQLKCTREGLSSSEGQQRLEIFGPNRLEEKKESKILKFLGFMWNPLSWVMEMAAVMAIALANGGGKPPDWEDFVGIIVLLVINSTISFIEENNAGNAAAALMANLAPKTKVLRDGRWGEQEAAILVPGDIVSIKLGDIVPADARLLEGDPLKVDQSALTGESLPVTKGPGDEVFSGSTCKQGEIEAVVIATGVHTFFGKAAHLVDSTNQVGHFQQVLTAIGNFCICSIAVGIVVEIIVMFPIQHRRYRSGIENLLVLLIGGIPIAMPTVLSVTMAIGSHKLSQQGAITKRMTAIEEMAGMDVLCSDKTGTLTLNKLSVDKNLVEVFCKGVDKDHVLLLAARASRTENQDAIDAAMVGMLADPKEARAGIREIHFLPFNPVDKRTALTYIDADGHWHRVSKGAPEQILDLCHCKEDLRRKVHGIIDKYAERGLRSLAVARQEVPERNKESPGGPWQFVGLLPLFDPPRHDSAETIRKALVLGVNVKMITGDQLAIGKETGRRLGMGTNMYPSSALLGQNKDATLEALPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFMLIALIWQYDFSPFMVLIIAILNDGTIMTISKDRVKPSPLPDSWKLKEIFATGIVLGSYLALMTVIFFWAMHKTDFFSDKFGVRSIRDSEHEMMSALYLQVSIVSQALIFVTRSRSWSFVERPGLLLVTAFLLAQLVATFLAVYANWGFARIKGIGWGWAGVVWLYSIVFYFPLDLIKFFIRFVLSGRAWDNLLENKTAFTTKKDYGREEREAQWATAQRTLHGLQPPEAATSTLFHDKNSYRELSEIAEQAKRRAEIARLRELNTLKGHVESVVKLKGLDIDTIQQNYTV

SEQ ID NO: 4169 - protein, 951 aa, Zea mays
  Clone ID: PAT_MRT4577_10901C.1.pep
MGGLEEIKNEAVDLENIPIEEVFEQLKCTREGLSSSEGQQRLEIFGPNRLEEKKESKVLKFLGFMWNPLSWVMEMAAIMAIALANSGGKPPDWQDFVGIIVLLVINSTISFIEENNAGNAAAALMANLAPKTKVLRDGRWGEQEAAILVPGDIISIKLGDIIPADARLLEGDPLKVDQSALTGESLPVTKGPGDEVFSGSTCKQGEIEAVVIATGVHTFFGKAAHLVDSTNQVGHFQQVLTAIGNFCICSIGVGILVEIIVMFPIQHRRYRSGIENLLVLLIGGIPIAMPTVLSVTMPIGSHKLSQQGAITKRMTAIEEMAGMDVLCSDKTGTLTLNKLSVDKNLVEVFCKGVDKDHVLLLAARASRTENLDAIDAAMVGMLADPKEARAGIREIHFLPFNPVDKRTALTYIDADGNWHRVSKGAPEQILDLCHCKEDLRRKVHSIIDKYAERGLRSLAVARQEVPEKNKESPGGPWQFVGLLRVFDPPRHDSAETIRKALVLGVNVKMITGDQLAIGKETGRRLGMGTNMYPSSALLGQNKDRTLSALPVDELIEKADGFAGVFPEHKYEIVKRLQEKKHIVGMTGDGVNDAPALKKADIGIAVADATDAARSASDIVLTEPGLSVIISAVLTSRAIFQRMKNYTIYAVSITIRIVLGFMLIALIWQYDFSPFMVLIIAILNDGTIMTISKDRVKPSPLPDSWKLKEIFATGIVLGSYLALMTVIFFWAMHKTDFFSDKFGVRSIRDSEHEMMSALYLQVSIVSQALIFVTRSRSWSFVERPGLLLVTAFLLAQLVATFLAVYANWGFARIKGIGWGWAGVVWLYSIVFYFPLDLLKFFIRFVLSGRAWDNLLDTRIAFTRHQDLRKGEREAQWATAQRTLHGLQPPEASSNTLFNDKSSYRELSEIAEQAKRRAEIARLRELNTLKGHVESVVKLKGLDIDPIQQNYPV

SEQ ID NO: 4170 - protein, 951 aa, Zea mays
  Clone ID: PAT_MRT4577_10903C.1.pep
MGGLEEIKNEAVDLENIPIEEVFEQLKCTREGLSSSEGQQRLEIFGPNRLEEKKESKILKFLGFMWNPLSWVMEMAAIMAIALANGGGKPPDWQDFVGIIVLLVINSTISFIEENNAGNAAAALMANLAPKTKVLRDGRWGEQEAAILVPGDIISIKLGDIVPADARLLEGDALKVDQSALTGESLPVTKGPGDEVFSGSTCKQGEIEAVVIATGVHTFFGKAAHLVDSTNQVGHFQQVLTAIGNFCICSIGVGILVEIIVMFPIQHRKYRSGIENLLVLLIGGIPIAMPTVLSVTMAIGSHKLSQQGAITKRMTAIEEMAGMDVLCSDKTGTLTLNKLSVDKNLVEVFCKGVDKDHVLLLAARASRTENQDAIDAAMVGMLADPKEARAGIREIHFLPFNPVDKRTALTYIDADGNWHRVSKGAPEQILDLCHCKEDLRRKVHSIIDKYAERGLRSLAVARQEVPEKNKESPGGPWQFVGLLPLFDPPRHDSAETIRKALVLGVNVKMITGDQLAIGKETGRRLGMGTNMYPSSALLGQNKDATLEALPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFMLIALIWQYDFSPFMVLIIAILNDGTIMTISKDRVKPSPLPDSWKLKEIFATGIVLGSYLALMTVIFFWAMHKTDFFSDKFGVRSIRDSEHEMMSALYLQVSIVSQALIFVTRSRSWSFVERPGLLLVTAFLLAQLVATFLAVYANWGFARIKGIGWGWAGVVWLYSIVFYFPLDLLKFFIRFVLSGRAWDNLLENKTAFTTKKDYGREEREAQWATAQRTLHGLQPPEASSNTLFNDKSSYRELSEIAEQAKRRAEIARLRELNTLKGHVESVVKLKGLDIDTIQQNYTV

SEQ ID NO: 4171 - protein, 72 aa, Zea mays
  Clone ID: PAT_MRT4577_109104C.1.pep
SQHPKVSRIKATGYIHCALRHVLPNMPLEQRRQLPVDLPEGHLKALSPQTLGQGVDMHLGLAIDSPEATLAV

SEQ ID NO: 4172 - protein, 342 aa, Zea mays
  Clone ID: PAT_MRT4577_109142C.1.pep
MAASEGVLLGMGNPLLDISAVVDDAFLAKYDIKLNNAILAEEKHSPMYDELASNSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFYDAQEKVLPYADFIFGNETEAKIFAKVRGWETENVEEIALKISQLPLASGKQKRIAVITQGADPVVVAEDGKVKTFPVILLPKEKLVDTNGAGDAFVGGFLSRLVQGKSIEDCVTAGCYAANVVIQRPGCTYPEKPDFN

SEQ ID NO: 4173 - protein, 281 aa, Zea mays
  Clone ID: PAT_MRT4577_109144C.1.pep
MAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVCFLSV

SEQ ID NO: 4174 - protein, 342 aa, Zea mays
  Clone ID: PAT_MRT4577_109145C.1.pep
MAASEGVLLGMGNPLLDISAVVDDAFLAKYDIKLNNAILAEEKHLPMYDELASNSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFYDAQEKVLPYADFIFGNETEAKIFAKVRGWETENVEEIALKISQLPLASGKQKRTAVITQGADPVVVAEDGKVKTFPVILLPKEKLVDTNGAGDAFVGGFLSRLVQGKSIEDCVTAGCYAANVIIQRPGCTYPEKPDFN

SEQ ID NO: 4175 - protein, 342 aa, Zea mays
  Clone ID: PAT_MRT4577_109147C.1.pep
MAASEGVLLGMGNPLLDISAVVDDAFLAKYDIKLNNAILAEEKHLPMYDELASNSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFCDAQEKVLPYADFIFGNETEAKIFAKVRGWETENVEEIALKISQLPLASGKQKRTAVITQGADPVVVAEDGKVKTFPVILLPKEKLVDTNGAGDAFVGGFLSRLVQGKSIEDCVTAGCYAANVIIQRPGCTYPEKPDFN

SEQ ID NO: 4176 - protein, 458 aa, Zea mays
  Clone ID: PAT_MRT4577_109260C.1.pep
MECARELRVRSTFTAAAMASKKQVGPGGAVPAQEQMNGGDAARLVRKPMDTFPQPAAARGRRALVDVGNLMNGRPSLVNHQKQAVAAAATSHKPLNVGNKKPLVPQAAARGLRPLADVTNLMINDRAAPANRQKPLDAVFNRNGKAVKLKECKVKPEVIVSIPDSEKEKKSKFPGGQKVCRRVPTLFDNLTKCSRASDGITTPKKKNPYDIDAPDSCNELAVVEYVEDIYRFYKSTEGTCLPLSSYMSSQAEISERMRAILIDWIIEYLSMESVPRKELQLVGISAMLIASKYEEIWAPLVKDLMCLCDNAFTRDQILTKEKAILDMLHWNLTVPTMYMFIVRYLKAAMCDAELENMAFFYSELALVQYAMLVYPPSVTAAAAVYAARSTLGMNPPWTDILEHHTGLAEPQLLDCARRLISFHALAPESKQKAVYRKYSKPKLGSVALQSPDKKLLSG

SEQ ID NO: 4177 - protein, 487 aa, Zea mays
  Clone ID: PAT_MRT4577_109262C.1.pep
MECARELRVRSTFTAAAMASKKQVGPGGAVPAQEQMNGGDAARLVRKPMDTFPQPAAARGRRALVDVGNLMNGRPSLVNHQKQAVAAAATSHKPLNVGNKKPLVPQAAARGLRPLADVTNLMIKDRAAPANRQKPVDAVFNRNGKAVKLKECKVKPEVIVIIPDSEKEKKGKFPGGQRVCRRVPTLFDNLTKCSRYEHKQNSKASDGITTPKKKNPYDIDAPDSCNELAVVEYVEDIYRFYKSTEGTCLPLSSYMSSQAEISERMRAILIDWIIEVQYRLTLMPETLYLTVYIIDQYLSMESVPRKELQLVGISAMLIASKYEEIWAPLVKDLMCLCDNAFTRDQILTKEKAILDMLHWNLTVPTMYMFIVRYLKAAMCDAELENMTFFYSELALVQYAMLVYPPSVTAAAAVYAARSTLGMNPPWTDILEHHTGLAEPQLLDCARRLISFHALAPESKQKAVYRKYSKPKLGSVALQSPDKKLLSG

SEQ ID NO: 4178 - protein, 54 aa, Zea mays
  Clone ID: PAT_MRT4577_109267C.1.pep
TVVPVPSEEDKEAEAVLMHKISRLVVVIAKLSFLSPWPEVNALFIELVTACIPR

SEQ ID NO: 4179 - protein, 57 aa, Zea mays
  UNSURE (1)..(57): unsure at all Xaa locations
  Clone ID: PAT_MRT4577_109273C.1.pep
  unsure (1)..(57): unsure at all Xaa locations
PRVRPRFRLCFRKKKKKKKKENIKKKKKKKKKKKKKXKKKKNKKKKKKRVGLLKNQN

SEQ ID NO: 4180 - protein, 201 aa, Zea mays
  Clone ID: PAT_MRT4577_109470C.1.pep
TPSGVFVILMLIGYIIYAAWNRYDSVTEDCRKMKALKKRAEAADVAKSQFLATVSHEIRTPMNGVLGMLDMLLDTELKSTQRDFAQTAQICGKALISLINEVLDRAKIEAGKLELESVPFDLRSILDEVVSLFSSKSREKGIELAVYVSERVPEILLGDPGRFRQIITNLVGNSIKFTERGHIFVQVHLADHSNLATEPKV

SEQ ID NO: 4181 - protein, 122 aa, Zea mays
  UNSURE (1)..(122): unsure at all Xaa locations
  Clone ID: PAT_MRT4577_109586C.1.pep
  unsure (1)..(122): unsure at all Xaa locations
QHIKHNSVSTLAAKIFCLLVLVVLSPRAATATILPQXSQASIAYILHQYLSPEVYSLCENPTLXPYRIQHAITADILPLSXSFSNNYKXLLHHIPLLHLLAQNIRSQQLQQLVLTNLTVYSQ

SEQ ID NO: 4182 - protein, 62 aa, Zea mays
  UNSURE (1)..(62): unsure at all Xaa locations
  Clone ID: PAT_MRT4577_10969C.1.pep
  unsure (1)..(62): unsure at all Xaa locations
MPPIGGGDALPDGQXGWIDXENDQLQQVSVPALADGNKVILFGVPGAFTPKCRNQYVPGSIT

SEQ ID NO: 4183 - protein, 300 aa, Zea mays
  Clone ID: PAT_MRT4577_110073C.1.pep
MAPRPPRAYIHPSSYSYPATYSTTYYSAPDAQNSRERTRPPPPSVPIQMMLRVSASPAAAVANHLSGGAAATTAPARVTAQRSGVSLSAAAAAGKGKEVLSGVVFQPFEEIKGELALVPQSPDRSLARHKFVDDCEAAINEQINVEYNASYAYHSLFAYFDRDNVALKGFAKFFKESSDEEREHAEKLMEYQNKRGGRVRLQSIVAPLTEFDHPEKGDALYAMELTLALEKLVNEKLHSLHGVATRCNDPQLIDFIESEFLEEQVEAINKVSKYVAQLRRVGNKGHGVWHFDQMLLEEEA

SEQ ID NO: 4184 - protein, 310 aa, Zea mays
  Clone ID: PAT_MRT4577_110074C.1.pep
TPRGSPRDHENAHWLPRGRPGAAQSIHPSILQSTHSIPLPTPRIHANAHAPTRHIQMMLRVSPSPAAAVPTQLSGAPATPAPVVRVAAPRGVASPSAGAACRAAGKGKEVLSGVVFQPFEEIKGELALVPQSPDKSLARHKFVDDCEAALNEQINVEYNASYAYHSLFAYFDRDNVALKGFAKFFKESSDEEREHAEKLMEYQNKRGGRVRLQSIVTPLTEFDHPEKGDALYAMELALALEKLVNEKLHNLHGVATRCNDPQLTDFIESEFLEEQVEAINKISKYVAQLRRVGKGHGVWHFDQMLLEEEA

SEQ ID NO: 4185 - protein, 126 aa, Zea mays
  Clone ID: PAT_MRT4577_110079C.1.pep
IIKRVVGRIKMMPSDGAPRANGPCFTQQGSGNPRPRGDPKKGAYTHGLELFSFPPPRDVLFFLLSGKNGKRPPLAPLAGGSPPGLGGLWGGPLPTHQRPPPAPKLLFPLWSSSATIVIMPVWVMLD

SEQ ID NO: 4186 - protein, 107 aa, Zea mays
  UNSURE (1)..(107): unsure at all Xaa locations
  Clone ID: PAT_MRT4577_110208C.1.pep
  unsure (1)..(107): unsure at all Xaa locations
VGFSSRCGSGSSSRGSPGLGFVGERXREAASGVEYRCFVCGLTXDTDDHSLENTLITYGEVLESKIILDRKTQRSLDFGFGTFCTKEEMRNSIKDINGKELNGRNIP

SEQ ID NO: 4187 - protein, 580 aa, Zea mays
  UNSURE (1)..(580): unsure at all Xaa locations
  Clone ID: PAT_MRT4577_110225C.1.pep
  unsure (1)..(580): unsure at all Xaa locations
MEQRNVLALGEHVLKATVWKRKHKTAMEHPEGNDVMVFSQHDQRKHPVIFDDRAKCKKSKLISCGSGVILESYWNFXTSGLPVRVLFYQHGDWSDFPEDVVNLAQQDFQLKKPITTAVFQNKHILLDFIHMICIDYEMTIDKPLAWVDDNGKRFFPDLSAGLYTSKPSQHENGEADECDGTPTSVAESSSSVSVGEVVSHGKRINDIAEDNMRAHNILYEAVGENISGPSFHLNEYSSXPYKLLASQTIVDVLIXAVRNLLLKGLGQPFSEEDIIGIYRTPLLDQRGQVRCGLFQKEIEETRSRRGNANVRYAWLPCSRYTMEQMAMRGALEIAKPHKGSICGVGTCLAPANCTNSCARYSDFHEDGIIRMMLCRVIMGNVEVVLPGSKQFQPSNGSFDNGVDDLQNPQNYIVWDANVHKHIYAEYAVIVQAPLVTNECSGLKDSVPNISEIISSGSRDNLTKEDRFAPCGVEQEAPRLGRAPRAPSSPWMPFSMLFAAISTKVPRSDMELVIRYYEEFKRKRMSRSDLVVRMRQIVGDKILVSTIMRLHHQKKPPSMAAAAAGLARALARGEEGGGVAE

SEQ ID NO: 4188 - protein, 446 aa, Zea mays
  Clone ID: PAT_MRT4577_110243C.1.pep
MAAPSAATRRKLQRKFRLRGFTLKVDALEEAAAFLDRFPDAEDDALDLLLDELDKEPLQSSILDRDAVRRVVALLVEAEEALDVASPAATSARSALRVVDAFLVPRFHYDPIKKVFYEYVNADSSLWIWEILHGDLSIGSFFLGFSIEPGHTGRLAVHGEAGDKASLYRDRYQVLLQRLSRDKYFSKPAFDTVATEHCSCEVNTCGFPPLEDREASVSLLMGFDFFGGGVIPTEETLRLSSLEKKAVNDMFVILSDVWLDNPEYEITLSYVPPHRFQFGKLGEMIAARSRLKEHSRFLFIPGPDDAGPSKALPRCALPKYLIEELQKHIPNSIFVSNPCSYALCYFEISLHNHMMYNGIGVKFYTQEIVFFRQDLLYRMRRSCLIPPTTEETSDPFEHIVLGDKSEQKAFKYTGITCFNPGSFANDSTFAAYRPCTKEVELSALEG

SEQ ID NO: 4189 - protein, 352 aa, Zea mays
  Clone ID: PAT_MRT4577_110317C.1.pep
MAHAALLHCSQSSRSLAACRRGSHYRAPSHVPRHSRRRRRAVVSLRPMASSTAQAPATAPPGLKEGIAGLYDESSGLWENIWGDHMHHGFYDSSEAASMADHRRAQIRMIEEALAFAGVPASDDPEKTPKTIVDVGCGIGGSSRYLAKKYGAQCTGITLSPVQAERGNALAAAQGLSDQVTLQVADALEQPFPDGQFDLVWSMESGEHMPDKRKFVSELARVAAPGGTIIIVTWCHRNLDPSETSLKPDELSLLRRICDAYYLPDWCSPSDYVNIAKSLSLEDIKTADWSENVAPFWPAVIKSALTWKGFTSLLTTGWKTIRGAMVMPLMIQGYKKGLIKFTIITCRKPGAA

SEQ ID NO: 4190 - protein, 109 aa, Zea mays
  UNSURE (1)..(109): unsure at all Xaa locations
  Clone ID: PAT_MRT4577_110361C.1.pep
  unsure (1)..(109): unsure at all Xaa locations
MAAADVKHRSFISGLAXATSNESLENAFFFYGXMLDSXVITDRXTGRSRGFRFVTFYSENSMLDAIENMNXKELDGRNITVNHAQSRDGGGGCGGCVYSGGRGGCGYGG

SEQ ID NO: 4191 - protein, 154 aa, Zea mays
  Clone ID: PAT_MRT4577_110481C.1.pep
WDLEPAGRDSLSQQLQMADTRGIATVVRQLIQNQGIVRGLPSSTGIEMTVVTTGRQRARARRPQRQDNNASPSIHVAAQNMGNVASESSNQIQLPHSNGDNAAQMVLASPQQSSSVEQLSTSSTTALIVGEPRSTRRLRPLESPTIRRTRRRPL

SEQ ID NO: 4192 - protein, 719 aa, Zea mays
  UNSURE (1)..(719): unsure at all Xaa locations
  Clone ID: PAT_MRT4577_11048C.1.pep
  unsure (1)..(719): unsure at all Xaa locations
MEVNSSGEETVIKVRKPYTITKQRERWTEAEHKRFLEALKLYGRAWQRIEEHVGTKTAVQIRSHAQKFFTKLEKEAINNGTSPGQAHDIDIPPPRPKRKANSPYPRKSGLSSETPTKELPSDKSTKPNMPLSNENVLMAGDASLQKFQRKELSGKESCSEVLNLFRDAPSPSFSSVNKSSSNHGAPIEASKTKIRDMTIMENSSLNPNMQEDVKEINDQEMERLNGTQISSKCEHSHEGYLDISMQQMKLKPESVETTYVDKQTARASHSLAERTGTTSIPVTATEETHSVLTSDQVGINGSMNPSIHPMFPADPKFDSSATPQPFPHNYAAFAPMMQCNCNQDTHRSLVNMSSTFSSMLVSTLLSNPAIHAAARLAASYWPAAEGNTPIDPNQENLADGVQGRSIGSPPSMASIVAATVAAASAWWATQGLLPFXRPTHGFFICXPAPSAAFPTVDVPRPSEKDRDCPAENAQKECQEARKQGQFEGFRVAASSEYDGSGKGEVSVHTELKISPVQNADATSAAGADTTDAFMNKKKQDRSSCGSNTPSSSDVDVDNVPEKEGNGNEKAKQASCSNSSAGDTNHRRFRSSGSTSDSWKEVSEEGRLVFHALFSREKLPQSFSPPQAEGSKEVGKEEEDEVTTVAVDLNKSTTSIDHDLDTIGEPRASFPNELSPLKLKLRRTGFKPYKRCSVEAKENRVPASDEVGTKRIRLDSEAST

SEQ ID NO: 4193 - protein, 493 aa, Zea mays
  UNSURE (1)..(493): unsure at all Xaa locations
  Clone ID: PAT_MRT4577_110516C.1.pep
  unsure (1)..(493): unsure at all Xaa locations
SDAWADAWAGVRECLEEVGHITRLADPRDAWLPITESRSGNAYYAAFHNLSSGIGFQALVLPTAFASLGWTWAIICLTLAFGWQLYTLWLLVRLHEPVAGATRYSRYMHLATTVFGERWAKILALLPVMYLSAGICTALIIVGGGSMKLLFGIACGEPCPARPPTTVEWYLVFVCAAVLLSQLPNLNSIAGVSLVGATAAVAYCTMIWTVSVAKGRVPAVSYDPVKAPSDVDGALAILNGLGIIAFAFRGHNVVLEIQGTMPSTLKHPSHVPMWKGVKVAYAIIALCLYPVAIGGFWAYGNQVRVPHIYIHTHGLRTTSRVTDDLRCTXIPPNGILSALYKFHSRDTSRLVLGVTTTLVIVNCLTTFQIYAMPVYDNMEAGYVHKKNRPCPWWMRSGFRAFFGAVNFLIAVALPFLSQLAGLLGGISLPVTLAYPCFMWVAIKKPRKGTATWNVNWALGILGMSISLVLIVGNLWGLVEKGLRVKFFKPADSQ

SEQ ID NO: 4194 - protein, 718 aa, Zea mays
  UNSURE (1)..(718): unsure at all Xaa locations
  Clone ID: PAT_MRT4577_11058C.1.pep
  unsure (1)..(718): unsure at all Xaa locations
MEMNSSGEETVVKVRKPYTITKQRERWTEAEHKRFLEALKLYGRAWQRIEEHVGTKTAVQIRSHAQKFFTKLEKEAMNNGTSPGQAHDIDIPPPRPKRKPNSPYPRKSCLSSETQTKELPNDKSTKPNMPLSNGHVKMVGDASLQNFQRKELSEKGSRSEVLNLFRDAPSASFSSVNKSSSNHGAPRRTEASKTESRDMSIMENNSFNPNTQEDVKVISDQEMERLNGIQIRSKCEHSHEGYLDISTQQMKLMPKSVETTYVDEQTARASHTLAESNGTASIPVTVPEGTHPDQTSDQVGINGSMNPCIHPMVSADPKFGSSATPQTFPHNYAAFAPMMQCNCNQDTYRSFTNMSSTFSSMLVSTLLSNPAIHAAARLAASYWPAAEGNTPIDPNQENPADGVQGRNIGSPPSMASIVAATVAAASAWWATQGLLPFFAPPVAFPFVPAPSAAFPTVDVPRPSEKDRDCPVENAQNECQEARKQVQFEGLRVAASSESDGSGKXGVSPYGVKAISXRMLMPHLPXAGTNDAFRNKKKQDRSSCGSNTPSSSDVDAGNVPEEDNANEKAKQASCSNSSAGDTNHRRFRSNGSTSDSWKEVSEEGRLAFDALFSREKLPQSFSPPQAVDSKEVAKEEEDEVTTVAVDLNKNATSIDHDDLDTMDEPRASFPNELSHLKLKSRRTGFKPYKRCSVEAKENRVPTSDMVGTKRIRLDSEAST

SEQ ID NO: 4195 - protein, 65 aa, Zea mays
  Clone ID: PAT_MRT4577_110884C.1.pep
ADDMEALYKQVRAANRGDPSEVSTPSNHQREHKEVHPQPLPYEQRKASIIERNDQLNSSGGAHDD

SEQ ID NO: 4196 - protein, 101 aa, Zea mays
  UNSURE (1)..(101): unsure at all Xaa locations
  Clone ID: PAT_MRT4577_111062C.1.pep
  unsure (1)..(101): unsure at all Xaa locations
RESRAAGRNLASFTASAHAFFSLNYAAYLEGQHLLPESQLSLVSPASFXTQPQAPPIYQHAAPNXAGTVLQLQQLXLPFNQLALTNPAAFYQQPIIGGALF

SEQ ID NO: 4197 - protein, 117 aa, Zea mays
  Clone ID: PAT_MRT4577_11119C.1.pep
GDLSTSLLFARAQHHPPTSSKRRRPATCGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 4198 - protein, 103 aa, Zea mays; identical to SEQ ID NO: 3555
  Clone ID: PAT_MRT4577_11121C.1.pep

SEQ ID NO: 4199 - protein, 98 aa, Zea mays
  Clone ID: PAT_MRT4577_11122C.1.pep
MSGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 4200 - protein, 486 aa, Zea mays
  UNSURE (1)..(486): unsure at all Xaa locations
  Clone ID: PAT_MRT4577_11123C.1.pep
  unsure (1)..(486): unsure at all Xaa locations
MAHPSSAAAVSSTAPAANPSYGAREEGGARSPPSPSPSPSQRGRAKVVIVMGATGAGKSRLAVDLAAHFAGVEVVSADSMQLYRGLDVLTNKAPLHEQNGVPHHLLSVIDPSVEFTCRDFRDRALPIIQEIVDRGGLPVVVGGTNFYIQALVSPFLLDDMAEEMQGCTLRDHIDDGIGLTDEDEGNGFERLKEIDPVAAQRIHPNDHRKIKRYLELYATTGALPSDLFQGEAAKXTCWEFLVIMSEQKWGRPSNSRLYCCFLWVDADLQVLDSYVNKRVDCMMDGGLLDEVCSIYDADAVYTQGLRQAIGVREFDEFFRAYLARKESGEGSCASLLGMHDDQLKSLLDEFFSQLKANTRRLVRRQRRRLHRLSKDFGWNLHRVDATEAFFCATDDSWQKKVVEPCVDVVRRFLSDDSTVLPSTSASDPSSRELWTQYVCEACDNRVLRGAHEWEQHRQGRGHRKRVQRLKRKSLRPWPSLLPQDRS

SEQ ID NO: 4201 - protein, 108 aa, Zea mays
  UNSURE (1)..(108): unsure at all Xaa locations
  Clone ID: PAT_MRT4577_111398C.1.pep
  unsure (1)..(108): unsure at all Xaa locations
SRIPSCDGRPGPRSTRQRRXGARAPPQDQEGGPGGAARRLRRFPLPRAPRKKKGPQGPPGGRRRKKAPLFRLFDPPRTVAXPCPTRGCVRVIXERPPFCARVRMYALV

SEQ ID NO: 4202 - protein, 117 aa, Zea mays
  UNSURE (1)..(117): unsure at all Xaa locations
  Clone ID: PAT_MRT4577_111497C.1.pep
  unsure (1)..(117): unsure at all Xaa locations
MIPNDVHNVLIPKHTCMPWSDSQTYLLCCNEPAETFVRADGAFIPFAHDFDISTVTTXXRGVGDIGDVKVIDLQSPLNSLIGRQVCKIGRSSGHTTGTVVAYALEYNDEKGISFFTD

SEQ ID NO: 4203 - protein, 77 aa, Zea mays
  Clone ID: PAT_MRT4577_111499C.1.pep
CVGPYWLRPSYLIHLKDRVTVRFCHRVSVRSTFGLGVGTPVVPFVCPPYETSPKKNEQGFCSHPFLSNKIEKLFPRP

SEQ ID NO: 4204 - protein, 746 aa, Zea mays
  UNSURE (1)..(746): unsure at all Xaa locations
  Clone ID: PAT_MRT4577_111563C.1.pep
  unsure (1)..(746): unsure at all Xaa locations
MALTLRSSTSFLSPVDPTSKLLHKPADEAQPCCVAVPPAPGRRPRALRAAAAAAPSPATHRAPAEAAELLHGGGADQHHGLPRGGVPVYVMLPLDTVGPGGQLSRQRAVAASLMALRGAGVEGVMVDVWWGVVEREGPGRYDWEAYAELVRMVERAGLRLQAVMSFHQCGGNVGDTCNIPLPPWVLEEMSSNPDIVYTDRSGRRNPEYISLGCDTLPVLKGRTPIQVYTDYMRSFRERFRDYLGNVIAEIQVGMGPCGELRYPSYPEANGTWRFPGIGEFQCYDKYMRASXRVYLANLVNXDVGCSDVCSIPLPPWVLEEMSSNPNIVYTDRSGRRNPEYISLGCDTLPVLRGRTPIQVYTDYMRSFRQRFRDYLGNVIAVINQPPLLRSLNVAIAVDHKEAMPDVVILGQTTRVSLSQETSVGMGACGELRYPSHPQANVMGGFTGNRDFQCYDKVGARDSKGIRRCCDTLPELLCVGTVHAGXLEAAAVASGHEEWGRGGPHDAGEYKQMPDDTGFFRREGTWSTEYGHFFLEWYSGMLLEHGDRVMAAAEAVFGGTGATLSAKVAGIHWHYRTRSHAAELTAGYYNTRGHDGYAPIARMLAKRGAVLNFTCMEMKDEQQPQHASCSPELLVQQVKAATSAAGVQLAGENALERYDDAAFSQVVSTARGAGLAAFTYLRMNKTLFDGDNWGRFVSFVRAMADGGARPALPRCDTGHSDLYVGFVDAAKERKAAEAKGAATTAAL

SEQ ID NO: 4205 - protein, 348 aa, Zea mays
  UNSURE (1)..(348): unsure at all Xaa locations
  Clone ID: PAT_MRT4577_111565C.1.pep
  unsure (1)..(348): unsure at all Xaa locations
TGTGTPGLGCDTLPVLKGRXPIQVYTDYMRSFRERFRDYLGNVIAEIQVGMGPCGELRYPSYPEANGTWRFPGIGEFQCYDKYMRASLEAAAVAAGXQEWGRGGPHDAGEYKQMPDDTGFFRREGTWSTEYGHFFLAWYSGMLLEHGDRVLAAAEAVFGGTGATLSAKVAGIHWHYRTRSHAAELTAGYYNTRDRDGYAPIARMLAKRGAVLNFTCMEMKDEQQPKHASCSPELLVQQVKTAASAAGVELAGENALERYDEAAFSQVASTARGAGLAAFTYLRMNKTLFDGDNWRQFVSFVRAMADGGARPALPRCDTGHSDLYVGFLDAAKKSKAPEAEGAATAAAL

SEQ ID NO: 4206 - protein, 54 aa, Zea mays
  Clone ID: PAT_MRT4577_111657C.1.pep
APQAGGSTTGMVCLCVVTLASHQRRLLVPRLLFPMLSSTPNIVKMSVWVMFVCS

SEQ ID NO: 4207 - protein, 89 aa, Zea mays
  UNSURE (1)..(89): unsure at all Xaa locations
  Clone ID: PAT_MRT4577_111758C.1.pep
  unsure (1)..(89): unsure at all Xaa locations
NKVLFSREEGQQQGEQRLQESVIVEISKEQIRALSKRAKSSSRKTISSEDKPFNLRSRDPIYSNKLGKFFEITPEKNPKLXRDLDIFLS

SEQ ID NO: 4208 - protein, 308 aa, Zea mays
  Clone ID: PAT_MRT4577_11183C.1.pep
MAKLWTLLLAAVVVLSLLVSPIACTRKLNKPKPKPGSYRRPVKPKPKPVTGSYKPAPVAARRNHTATPTPSPTVYGPGGWLSGAGATYYGATNGDGSDGGACGYQTAVGKKPFDSMIAAGSTPLYRGGEGCGACYEVKCTTNAACSGQPVTIVITDQSPGGLFPGEVEHFDMSGTAMGAMARPGMADKLRAGGVLRILYRRVPCKYTGVNIAFKVDQGANPYYFDVLIEFEDDDGDLSAVDLMEAGSGVWTPMAHNWGATWRLNNGRKLKAPFGLRLTSDSRRVLVANNAIPAAWKPGKTYRSLVNYP

SEQ ID NO: 4209 - protein, 61 aa, Zea mays
  UNSURE (1)..(61): unsure at all Xaa locations
  Clone ID: PAT_MRT4577_112075C.1.pep
  unsure (1)..(61): unsure at all Xaa locations
MAVKIFCFLMLLGLSASAATATIFPHCSQAXIDSFFSPYLXPAVVSVCENPILLSYMIQHA

SEQ ID NO: 4210 - protein, 46 aa, Zea mays
  UNSURE (1)..(46): unsure at all Xaa locations
  Clone ID: PAT_MRT4577_112288C.1.pep
  unsure (1)..(46): unsure at all Xaa locations
LSRSISYADAPSLHMQMMLXVXPAPADTVPTQLFGAPATPAPVVRV

SEQ ID NO: 4211 - protein, 93 aa, Zea mays
  UNSURE (1)..(93): unsure at all Xaa locations
  Clone ID: PAT_MRT4577_112369C.1.pep
  unsure (1)..(93): unsure at all Xaa locations
MEYGQQGQRGHGATGHVDQYGNPVGGVEHGTGGMRHGTGTTGGMGQLGEHGGAGMGGGQLQPARXEHXTGGILHRFVSSSSSSLEDDCMCGRW

SEQ ID NO: 4212 - protein, 93 aa, Zea mays
  UNSURE (1)..(93): unsure at all Xaa locations
  Clone ID: PAT_MRT4577_112620C.1.pep
  unsure (1)..(93): unsure at all Xaa locations
HPLVTLGXPMVLEEPLLXTFXLPPFLVKGDYXALXXYXSTVANRALXTAEXLGLSREXACHNLLFXRXSXXXXGXXVXSXGLLXXVXXGGXKM

SEQ ID NO: 4213 - protein, 182 aa, Zea mays
  UNSURE (1)..(182): unsure at all Xaa locations
  Clone ID: PAT_MRT4577_112636C.1.pep
  unsure (1)..(182): unsure at all Xaa locations
IRHEEPVRAANLSNCTQSAIHCRRRSNLLRASSMASSDHGSTTALKDVPGSYCLPLVGGGRDXLFFYYLQGQDKYLEYRVERYRSTXVRMNLPSRHYMARDPRMDAVLDAKSLPGLFDMDKAENKDLFTATYMPCTSLTGGYRACWYLDPCEPTHTMEKQLIXSLLLYSXDKVIPTLRSNFS

SEQ ID NO: 4214 - protein, 91 aa, Zea mays
  UNSURE (1)..(91): unsure at all Xaa locations
  Clone ID: PAT_MRT4577_112665C.1.pep
  unsure (1)..(91): unsure at all Xaa locations
EILKVIRKNLVKKCIEMLFDDADNKDDYGKFYDAFSKNIKXGIHDVSDNRAKLTDLLLYHSTKSGXDQTTXSLKDYXTRMKDGHNDIYYIT

SEQ ID NO: 4215 - protein, 83 aa, Zea mays
  Clone ID: PAT_MRT4577_112678C.1.pep
PQAEPFCARCDLVSTSLPSPSREAAPVTASAVGDRTEASPAGRFQPCGVPICGERTRSSTPPSLIPEKATALSQVRSGLTGTL

SEQ ID NO: 4216 - protein, 79 aa, Zea mays
  Clone ID: PAT_MRT4577_112707C.1.pep
TVPIHPSPSSRPGQRNPSHERLLQEALPGRQVPRALRFSPLRPCRLGPHRRARHAHQLWQEDPSHRLLYPTTCRDPTMP

SEQ ID NO: 4217 - protein, 87 aa, Zea mays
  UNSURE (1)..(87): unsure at all Xaa locations
  Clone ID: PAT_MRT4577_112978C.1.pep
  unsure (1)..(87): unsure at all Xaa locations
AIAAGILPLLPLFLQQPGGLLQQLPLVHLLGQNIKAQQLQQLVLGNPGGYFXQQQFLSFNQMAALDPACYLQQQLPFNKEAGDYPQQ

SEQ ID NO: 4218 - protein, 77 aa, Zea mays
  Clone ID: PAT_MRT4577_113047C.1.pep
NVCQAFPFPVNVDPKVNMQLLSNLQPYWAFFGFSPCPPLKGPGGGSGVLFLDQGAYPNPPQTCDSKGFMLYNWPPTC

SEQ ID NO: 4219 - protein, 223 aa, Zea mays
  Clone ID: PAT_MRT4577_113066C.1.pep
MRVLLVALALLALAASATSTHTSGGCGCQPPPPVHLPPPVHLPPPVHLPPPVHLPPPVHLPPPVHLPPPVHVPPPVHLPPPPCHYPTQPPRPQPHPQPHPCPCQQPHPSPCQLQGTCGVGSTPILGQCVEFLRHQCSPTATPYCSPQCQSLRQQCCQQLRQVEPQHRYQAIFGLVLQSILQQQPQSGQVAGLLAAQIAQQLTAMCGLQQPTPCPYAAAGGVPH

SEQ ID NO: 4220 - protein, 63 aa, Zea mays
  Clone ID: PAT_MRT4577_113206C.1.pep
TLLSNSIKSYSEAVNLHYQLPAGAHRRKRCRSSSASTSGAGVDASWVARTFAARAEERRTLRA

SEQ ID NO: 4221 - protein, 50 aa, Zea mays
  Clone ID: PAT_MRT4577_113275C.1.pep
KDGRHRKHHVISTQTETYKKKVKHSYEAYKTLQQELGLREEPAWIVDNTG

SEQ ID NO: 4222 - protein, 488 aa, Zea mays
  Clone ID: PAT_MRT4577_11332C.1.pep
RVQSTVDRTANVLGHPTPSLRDHYALGRKLGQGQFGTTYLCTDLATGVDYACKSIAKRNVITNEDVEDVRREIQIMHHLAGHRNVVAIKGAYEDQLYVHIVMEFCAGGELFDRIIQRGHYSERKAAELTRIIVGVVEACHSLGVMHRDLKPENFLLSNKDDDMSLKAIDFGLSVFFKPGQIFTDVVGSPYYVAPEVLRKRYGPEADVWTAGVILYILLCGVPPFWAETQQGIFDAVLKGVIDFDLDPWPVISESAKDLIRRMLNPIPSERLTAHEVLCHPWICDHGVAPDRPLDPAVLSRIKQFSAMNKLKKMALQVIAESLSEEEIAGLKEMFMAMDTDNSGAITYDELKEGLRKYGSTLKDTEIRDLMEAADIDNSGTIDYIEFIAATLHLNKLEREEHLVAAFSYFDKDSSGYITVDELQQACKEHNMPAAFLDDVIKEADQDNDGRIDYGEFVAMMTKGNMGVGRRTMRNSLNISMRDTPAGAL

SEQ ID NO: 4223 - protein, 157 aa, Zea mays
  Clone ID: PAT_MRT4577_113655C.1.pep
MAASDVEYRCFVGGLAWATDDHSLNNAFSTYGEVLESKIILDRETQRSRGFGFVTFSTEDAMRSAIEGMNGKELDGRNITVNEAQSRGGRGGGGGGGYGGGRGGGGYGGGGRRDGGGGYGGGGGYGGGGGGYGGGGGGYGGGNRGGGYGNSDGNWRN

SEQ ID NO: 4224 - protein, 111 aa, Zea mays
  UNSURE (1)..(111): unsure at all Xaa locations
  Clone ID: PAT_MRT4577_113657C.1.pep
  unsure (1)..(111): unsure at all Xaa locations
LVGERIEMAASDVEYRCFVGGLAWATDDHSLHNAFSTYCEVLESKIILDRETQRSRGFGFVTFSTEEAMRNAIEGMNGKELDCRYITVNEDHSRCCRXGGCCGYCGGRGGC

SEQ ID NO: 4225 - protein, 102 aa, Zea mays
  Clone ID: PAT_MRT4577_113658C.1.pep
VVVKTTTVTTVSSATATLTATGVTERWGPHGQVILFATVMLTLVQRAYLRSSRLLLPICVFDCKVALCQLLVLCSSAAPADPCINQHGLWIDGCCYSCQDLF

SEQ ID NO: 4226 - protein, 126 aa, Zea mays
  UNSURE (1)..(126): unsure at all Xaa locations
  Clone ID: PAT_MRT4577_113661C.1.pep
  unsure (1)..(126): unsure at all Xaa locations
GSPGFGFGGERIEMAASDDEYRCFFGGLPWATDNHFPSTTPFSTXVEVPXSKIILDRETQRSRGFGFXTFSTEEAXMRNAIEGMNGKELDGRNITANEAQSRGGRGGCGRRKPWRPRRPRLPPLLS

SEQ ID NO: 4227 - protein, 108 aa, Zea mays
  UNSURE (1)..(108): unsure at all Xaa locations
  Clone ID: PAT_MRT4577_113663C.1.pep
  unsure (1)..(108): unsure at all Xaa locations
TEAPVKEGLEXAEAPVAAVPATPTGTEVTERWGPRGQVILFAKVMFTLVQRVYLSSCGVCCCPSVFLIARSLCARPQSCVHRWFQQTHASSSMGCGSMDAVTPVRLYV

SEQ ID NO: 4228 - protein, 72 aa, Zea mays
  UNSURE (1)..(72): unsure at all Xaa locations
  Clone ID: PAT_MRT4577_113664C.1.pep
  unsure (1)..(72): unsure at all Xaa locations
AQSPAVRGAAGVGYGGARAAAAXGGAGLRDGGGAYAGGVDYGGAAEYGGGADAYGGGNRGGGYGNSHGNCRN

SEQ ID NO: 4229 - protein, 100 aa, Zea mays
  UNSURE (1)..(100): unsure at all Xaa locations
  Clone ID: PAT_MRT4577_113665C.1.pep
  unsure (1)..(100): unsure at all Xaa locations
AGGYGGSREGAQYGGGGPHDGRGGYVGGVDAYGVGGXYGGGGGGYGGGNGGGGYGNSEGNWRNLPVGPARPSYPVCYRDVYPSPEGLFSFVSFVVAHLCF

SEQ ID NO: 4230 - protein, 105 aa, Zea mays
  UNSURE (1)..(105): unsure at all Xaa locations
  Clone ID: PAT_MRT4577_113668C.1.pep
  unsure (1)..(105): unsure at all Xaa locations
GSPGFGFEGERIETAASDVEYRCFVCSLACATDDHCLHNAFSTYGEVLESKIILDRXTHRSRGSGFDTFSTEEAMRNAIDGMNGKELDCRNITVNEAHSRGCRGS

SEQ ID NO: 4231 - protein, 170 aa, Zea mays
  UNSURE (1)..(170): unsure at all Xaa locations
  Clone ID: PAT_MRT4577_113693C.1.pep
  unsure (1)..(170): unsure at all Xaa locations
PTRPVSWVSGSRWQASDVEHRCLXVAGLGWATDDHSLHNAFSTYGEVLESKIMLDRETQMSRGFRFVTFCTEEAMRNAIEGMNGTEXLDGRNITVNEAQSRGGRGGGGGRGYRGGRGGGSYSSGRRRDGGGGYRGGSXXGGSGGYRGGGGGSEXGNRGGGYXNCDRNWRN

SEQ ID NO: 4232 - protein, 148 aa, Zea mays
  UNSURE (1)..(148): unsure at all Xaa locations
  Clone ID: PAT_MRT4577_113695C.1.pep
  unsure (1)..(148): unsure at all Xaa locations
RCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYRGGGGYGGGCGYGGGGGGYGGGNRGGGYGNSDGNXWRN

SEQ ID NO: 4233 - protein, 155 aa, Zea mays
  UNSURE (1)..(155): unsure at all Xaa locations
  Clone ID: PAT_MRT4577_113696C.1.pep
  unsure (1)..(155): unsure at all Xaa locations
MAASDVEYRCFVGGLAWATDDHSLHNTFSTYCDVLEXKIILHRETQRSRGFGFVTLSTEEAMPNPIDGMNGTELDGTNITVNEAQSRSGRRGSTGGYGGGRRGGDYGEGGRRDGRGDYRGGNGYGDGRGYRGGGVRYCGENRLHGYLNSDRNWMN

SEQ ID NO: 4234 - protein, 61 aa, Zea mays
  Clone ID: PAT_MRT4577_113698C.1.pep
GYGGARGDAGYGGGGRRDGAGGYGGGGGGYGGDGGYGGGGGGYGGGNRGGGYGNSDGNWRN

SEQ ID NO: 4235 - protein, 91 aa, Zea mays
  UNSURE (1)..(91): unsure at all Xaa locations
  Clone ID: PAT_MRT4577_113699C.1.pep
  unsure (1)..(91): unsure at all Xaa locations
GMTAKEADGXRTIPVKKAHSPAAREAAAAAGYVGAGEAGGYAGGGPRDAAAGYAGDAGYGGAADGYGGGGGGYAGGNRGGGYGNSDGNWRN

SEQ ID NO: 4236 - protein, 48 aa, Zea mays
  Clone ID: PAT_MRT4577_113701C.1.pep
YGGGGLRDGADGYDGVDAGYGAGGGSGGGGAGYDGDNRGGGYGNFDGN

SEQ ID NO: 4237 - protein, 88 aa, Zea mays
  Clone ID: PAT_MRT4577_113705C.1.pep
TGKKLNDPNITVNKAQSRADRGDDDVAGYGGGREVGGYDGGGPRDGGGGYGGGVGYGGGDGGYGGGVGGYGGGNRGGGYGNSDGNWRN

SEQ ID NO: 4238 - protein, 145 aa, Zea mays
  Clone ID: PAT_MRT4577_113706C.1.pep
MAASDVEYRRFVGGLAWATDDHSLHNAFSTYGEVLESKIILDRETQRSRGFGFVTFSTEEAMRNAIEGMNGKELDGRNITVNEAQSRGGRGGGGGGGYGGGRGGGGYGGGGRRDGGGGYGGGGGYGGRREGGGGGYGGGGGGWRD

SEQ ID NO: 4239 - protein, 75 aa, Zea mays
  UNSURE (1)..(75): unsure at all Xaa locations
  Clone ID: PAT_MRT4577_113723C.1.pep
  unsure (1)..(75): unsure at all Xaa locations
GYGGVREDGGYDGDGHRDDASGYDGGDGYGGAXDYGGGGGGYVGGNRGGGYGNSDGNWRKLNGGARAAKLSCSLP

SEQ ID NO: 4240 - protein, 165 aa, Zea mays
  Clone ID: PAT_MRT4577_113725C.1.pep
PHQHEPAPPLSPNSSPSSGNAVLIFRAERIREAAWDVEYRCFVGGLAWATDDHSLHNAFSTYGEVLESKIILDRKTQRSRGLGFVTFYTEEAMRNAIEGMNGKELDGRNITVNEAHSRGGRGGGGGGDYGGGRGGGGYGGGGRRDGGGGYGGGGSYGGGGGGYKG

SEQ ID NO: 4241 - protein, 155 aa, Zea mays
  Clone ID: PAT_MRT4577_113729C.1.pep
MAASNVENRCFVGGLAWATDDHSLHNAFRTYGEVLESKIILNRKTQRSRGFGFVTFSTEEAMRNAIEGMNGKELDGRNITVNEAQSRGGREGGGGGNGGAREGGVYGGGGRRDGGGGYGGGGGYGGGGGYGGGGGGYGGGNRGGGFGTSDGNWRY

SEQ ID NO: 4242 - protein, 164 aa, Zea mays
  UNSURE (1)..(164): unsure at all Xaa locations
  Clone ID: PAT_MRT4577_113739C.1.pep
  unsure (1)..(164): unsure at all Xaa locations
AIEGMNGRELNGRSITVKEAQYRGVRGXRAGGYGGHVQPLATAGGGSCDAGGGYAGGAGYGAGGAYGGGDAGYGGGICGGGYGNPVGNWRNRPVGPARPSYLVRYRDVYPSPEGLSSFSVVFVVAHLCLSDCKVALCQLLVRVFNHGSIRPMHQTAWTPDRWML

SEQ ID NO: 4243 - protein, 158 aa, Zea mays
  Clone ID: PAT_MRT4577_113764C.1.pep
MAASDVEYRCFVGGLAWATDDHSLHNAFSTYGEVLESKIILDRETQRSRGFGFVTFSTEEAMRNAIEGMNGKELDGRNITVNEAQSRGGRGGGGCGYCGGRGGGGYCGGGRRDGGGGSGGGGGGYGGGGGYGGGGGYGGRREGGGGGYGGGGGGGWRD

SEQ ID NO: 4244 - protein, 273 aa, Zea mays
  UNSURE (1)..(273): unsure at all Xaa locations
  Clone ID: PAT_MRT4577_113768C.1.pep
  unsure (1)..(273): unsure at all Xaa locations
MASTIMAATSRIVAAKTPFLGQGRAAAAAANASPLRDVAAAAAGGRITMGNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLVHAQSILAVLGFQVILMGXLVEGFRINGLDGVGEGNNLYPGGQYFDPLGLADDPVTFAELKVKEIKNGRLAMFSMFGFFVQAIVTGKGPLENLLDHLDDPVANNAWVYATKFAPGS

SEQ ID NO: 4245 - protein, 156 aa, Zea mays
  Clone ID: PAT_MRT4577_113770C.1.pep
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGGYGGGGGYGGGGGGYGGGNRGGGYGNSDGNWRN

SEQ ID NO: 4246 - protein, 297 aa, Zea mays
  UNSURE (1)..(297): unsure at all Xaa locations
  Clone ID: PAT_MRT4577_113817C.1.pep
  unsure (1)..(297): unsure at all Xaa locations
VKFVFWRGKIGAGPTASPSPSPWPPSCSAPALPCPHPARSGPAPSRRRPRPPRRGPRAPXPCAXPWPRPRCSAPPASPCPRWPAPSRPPSPRPPWSSPPPSPRTTRSPPRPGPWPPRPCPWRAPPPPRSGPWPPSPPPAPGPRPRVPPPWPAPSRAPPCPRPPAPRHASRSSLAPSPGTPCPRRPPPRPSPGPWPARPCPTPGPPRGRPCPAPCSSSPRPSSWRAPWRPRWRPSPPPPRPCTCPLFLSGLPARCRMPGTILAQPASRGGSRSLPAGAAEGSTPAWEEPACQQRCRYR

SEQ ID NO: 4247 - protein, 281 aa, Zea mays
  UNSURE (1)..(281): unsure at all Xaa locations
  Clone ID: PAT_MRT4577_113942C.1.pep
  unsure (1)..(281): unsure at all Xaa locations
MCKKAAIGTFEAGRNFVIPKLEKVIDEEKEVSHSSLMDDAEKAILDPLKVKVKLKPDNVDICYPPVFQSGGKFDLKPGASSNDEYLYYDSASIIICAIGSKYSSYCSNVARTYLIDATPTQNKAYETLRKAHEAAIQQVKPGNQMSAVYQAAVAVIERDAPELLPNLTKSAGTGIGLEFRESGLNLNAKNDRRIKKGMVFNVSLGLHNIQAETTSEKTKQFSLLLADTVLVNERGHEVLTAPCSRXFKDVAYSFNEDDDAVAAEVKIKSKDIDVMPTKATL

SEQ ID NO: 4248 - protein, 715 aa, Zea mays
  Clone ID: PAT_MRT4577_114301C.1.pep
MASADVHMAGGAETETFAFQAEINQLLSLIINTFYSNKEIFLRELISNASDALDKIRFESLTDKSKLDAQPELFIRLVPDKASKTLSIIDSGVGMTKSDLVNNLGTIARSGTKEFMEALAAGATDVSMIGQFGVGFYSAYLVADRVMVTTKHNDDEQYVWESQAGGSFTVTHDTTGEQLGRGTKITLFLKDDQLEYLEERRLKDLVKKHSEFISYPIYLWTEKTTEKEISDDEEEEDNKKEEEGDVEEVDDEDKDTKDKSKKKKKVKEVSHEWVQINKQKPIWLRKPEEITRDEYASFYKSLTNDWEDHLAVKHFSVEGQLEFKAILFVPRRAPFDLFDTRKKLNNIKLYVRRVFIMDNCEELIPEWLGFVKGVVDSDDLPLNISRETLQQNKILKVIRKNLVKKCIEMFFEIAENKDDYAKFYDAFSKNIKLGIHEDSQNRAKLADLLRYHSTKSGDETTSLKDYVTRMKEGQKDIYYITGESRKAVENSPFLERLKKKGYEVLFMVDAIDEYAVGQLKEYDGKKLVSATKEGLKLDDEDDEEAKKRREERKKRFEELCKVIKDILGDRVEKVVVSDRIVDSPCCLVTGEYGWTANMERIMKAQALRDSSMSAYMSSKKTMEINPDNGIMEELRKRAEADRNDKSVKDLVLLLFETALLTSGFSLDDPNTFAARIHRMLKLGLNIDEDAAGDEDADMPALDEGAAEESKMEEVD

SEQ ID NO: 4249 - protein, 256 aa, Zea mays
  Clone ID: PAT_MRT4577_114398C.1.pep
ICWNSYMKSHIASSDFEGIVQVWDVTRSQVFVGMREHERRVWSVDFSIVDPTKLVSGSDDGSVKLWDMNQAGSIGTIRTRANVCSVQFQPDTARSIAIGSADHKIYCYDLRNIRAPYCTLVGHTKTVSYVKYLDASTILSASTDNSLKLWDLSMNPGRIIDSPVQTFTGHTNTKNFVGLSISDGYIATGSETNEVFVYHKEFPMPVLAYKFSVTDPISGQEIDDQSQFISCVCWRGQSSTLLSANSSGNIKILEMD

SEQ ID NO: 4250 - protein, 106 aa, Zea mays
  Clone ID: PAT_MRT4577_114420C.1.pep
VFSEVLFFIYLLPPIIFNAGFQVKKKQFFRNFMTITLFGAVGTMISFFTISLGAIAIFSRMNIGTLDVGDFLAIGAIFSATDSVCTLQVLHQDETPFLYSLVFGEG

SEQ ID NO: 4251 - protein, 129 aa, Zea mays
  UNSURE (1)..(129): unsure at all Xaa locations
  Clone ID: PAT_MRT4577_114454C.1.pep
  unsure (1)..(129): unsure at all Xaa locations
PRPRPAPRAGKGGKXXXAAKTTAAKSTDKDKDRKKAPXXRSGGAGXQXPXXRTHRQRKAXAXAHGRXGATAAGXXAATREDPTAEGPEPAGXAGKDPXGKRXTPRHPQXAXRGDEEPDTPXKGTXAGGG

SEQ ID NO: 4252 - protein, 598 aa, Zea mays
  Clone ID: PAT_MRT4577_11460C.1.pep
MSEEDEDQPPPKRPCASPPADQVLDNVLETVLQFLDAPRDRSAASLVCRSWHRAESATRDSVAVRNLLAASATRAARRFPNARSLLLKGRPRFADFNLLPHGWDASAFRPWAAAVAAGSFPALTSLYLKRIPVTDADLDLLSRPLPASFRDLTLHLCDGFTSRGLASIASHCRGLRVLDVVECDMAEEQEVVDWVAAFPPEPTNLESLSFECYEPPVAFATLEALVARSPRLSRLGVNLHVSLGQLRRLMAHAPRLSHLGTGSFRPAEGGEEEAEFGEVVSAFVSAGRARTLVSLSGFRDLAQEYLPIIDVVCSHLKSLDLSYAAVTPNQILMFIGQCYNLETLWVLDSVRDEGLDAVGIYCKKLQTLRVLPLDAHEDADELVSEVGLTAIARGCPALRSILYFCQTMTNAAVVDMSLHCPELKVFRLCIMGRHQPDHATEEPMDEGFGAIVKNCRKLTRLSTSGQLTDRAFEYIGRHGKSLRTLSVAFAGNSDVALQYILRGCSKLEKLEIRDCPFGDAGLLSGMHHFYNMRFVWMSGCNLTLRGCKEVARGLPRMVVELINGQPDENERKESVDILYMYRSLDGPREDVPPFVKIL

SEQ ID NO: 4253 - protein, 598 aa, Zea mays
  Clone ID: PAT_MRT4577_11461C.1.pep
MSEEDEDQPPAKRPSPSPPADQVLDNVLETVLQFLDAPRDRSAASLVCRSWHSAESATRESVAVRNLLAASATRAARRFPNARSLLLKGRPRFADFNLLPHGWDASAFRPWAAAVAAGAFPALTSLYLKRIPVTDADLDLLSRSLPASFRDLTLHLCDGFTSRGLASIASHCRGLRVLDVVECDMAEEQEVVDWVAAFPQEPSNLESLSFECYEPPVAFAALEALVERSPRLRRLGVNLHVSLGQLCRLMAHAPRLSHLGTGSFRPADGGEEGAGFGEVVSAFVAAGRARTLVSLSGFRDLAQEYLPTIAVVCAHLKSLDLSYSAVTPNQILMFIGQCYNLETLWVLDSVRDEGLDAVGISCKKLQSLRVLPLNAHEDADELVSEVGLTAISRGCPALRSILYFCQTMTNAAVVDMSRNCPELKVFRLCIMGRHQPDHATGEPMDEGFGAIVQNCSKLTRLSTSGQLTDRAFEYIGRHGKSLRTLSVAFAGNSDVALQYILRGCSKLEKLEIRDCPFGDAGLLSGMHHFYNMRFVWMSGCNLTLQGCKEVAQVLPRMVVELINGQSDENERNESVDILYMYRSLDGPREDVPPFVKIL

SEQ ID NO: 4254 - protein, 152 aa, Zea mays
  Clone ID: PAT_MRT4577_114642C.1.pep
ARVRPRVRPRVRPRVRPRVRGAFGCELARFDPVEFLEFGRGKAVAFVGDLLARNHMPSVVWLLAQGGYSKGLAGNPLDQNKGYQFRAYNFTISMVWSAFLVRAREPEHEGPVHTGHWSLFLDEPDDQWVFQMARFDFLLVSAGHWFFRPFLF

SEQ ID NO: 4255 - protein, 45 aa, Zea mays
  Clone ID: PAT_MRT4577_114825C.1.pep
DHCHIRSTYYVFQRERKLPQHHDITWRVVALHITSPVDHWAYIIL

SEQ ID NO: 4256 - protein, 64 aa, Zea mays
  Clone ID: PAT_MRT4577_114846C.1.pep
MIAQPIKLHAWTAFPASEHYGIARMPASVYKAICLQKPRSKRTNDREATSFARRSDSTPRPPHA

SEQ ID NO: 4257 - protein, 144 aa, Zea mays
  Clone ID: PAT_MRT4577_115011C.1.pep
GLLGRAGLLRGACELIDTMPMKPDLCVWGALLNSCRIHGDAALAEAAMAKVLQAETATTGNRTLITNLYAACGMWDDSKRVRMTMKEAGLRKNPGQSWIEVRNKVFAFTAWSAPPSEAEEVFRVLDDLYGEMKDEKRSTAILLC

SEQ ID NO: 4258 - protein, 72 aa, Zea mays
  UNSURE (1)..(72): unsure at all Xaa locations
  Clone ID: PAT_MRT4577_115086C.1.pep
  unsure (1)..(72): unsure at all Xaa locations
MEGTVSSFPVENMVKLETDERATAMEVIRHSCXNWGFFLLVNHGISHELVDEVERLTKAHYSTFREAKFQEF

SEQ ID NO: 4259 - protein, 164 aa, Zea mays
  UNSURE (1)..(164): unsure at all Xaa locations
  Clone ID: PAT_MRT4577_115129C.1.pep
  unsure (1)..(164): unsure at all Xaa locations
PLLSPGVYRVXSMTRQIIAPNFDRGYGEPDEMLALTSFKNFKCERGENSGAHIIRIPFGPKEKHLAKENIWPFIQEFVDGALGHIVRMSKTLGEETGSVCPVWPAVIHGHYASAGVAAALLSGALNVPMVFTGHFLGKDKLEGLLKQGRQTREQINVTYKIMRP

SEQ ID NO: 4260 - protein, 857 aa, Zea mays
  Clone ID: PAT_MRT4577_115380C.1.pep
MAQQMASVHLNDTTVVDAKPLRTLTPMFPAPLGLHTFTPQNSPSVVCVTPFGPYAGGTELGMPAVPPMFAAPVPAAGAEPSQRQPHTANMNGGDTELGMPAVPPMFAAPAPAAGAEPNQGQPHTANMNGTAVNSSVTSLQTPPSAATQESGKRKRGRPKRVPDTTVSSAPSAPLAPTISPVPSLPVVTPVPSAPQELNTIVSLTPSSDAPQESGKRKRGRPKRIQDVPVMVPLTSQGDSTSVIQTLPGSSVHESGTRRGRPKRLQDSSDIVTPIDSKDSESSPQPPIAAPAESGKRKRGRPKRIDGSVTPSSHSVFSIDDDAVDTMKRGRPRKIDTKLLQFPSLFSDDPRQTADNVLMMFDALRRRLMQMDDVKQAAKQQPNLKAGSIMNNAELRVNKDKRIGEVPGVEVGDMFYFRIEMCLVGLNSQSMAGIDYMSAKFGNEEDPVAISVVSAGVYDNTGDDPDVLVYTGHGMSGKDDQKLERGNLALERSLHRGNPIRVIRSVKDLTCPTGKIYIYDGLYKIKEAWVEKGKSGFNVFKHKLLREPGQPDGIAVWKKTEKWRENPSSRDHVILLDISYGVENNPVCLVNEVDDEKGPSRFTYTTNLTYGNSLSSMRKMQGCKCISVCLPGDNNCSCTHRNAGDLPYSASGILVSRMPVLYECGDSCTCSQNCRNRVVQKGTQIRFEVFKTGDRGWGLRSWDPIRAGTFICEYAGEIIDINRVNGEDDYIFETSPLEQNLRWNYAPELLGEPSLSDSNETPKQLPIVISAKRTGNIARFMNHSCSPNVFWQPVLYDHGDEGYPHIAFFAIKHIPPMTELTYDYGQNQRNSIQMGTHSGFRKSKSCLCWSPKCRGSFG

SEQ ID NO: 4261 - protein, 288 aa, Zea mays
  Clone ID: PAT_MRT4577_115406C.1.pep
MAKDIEASGPEAGEFSAKDYTDPPPAPLVDAEELTQWSLYRAVIAEFIATLLFLYITVATVIGYKHQTDASASGPDAACGGVGILGIAWAFGGMIFILVYCTAGISGGHINPAVTFGLFLARKVSLVRALLYIVAQCLGAICGVGLVKGLQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 4262 - protein, 110 aa, Zea mays
  UNSURE (1)..(110): unsure at all Xaa locations
  Clone ID: PAT_MRT4577_115435C.1.pep
  unsure (1)..(110): unsure at all Xaa locations
HGEARHRSIGARGRRVSARTTRTSAGAPLDADEVTKWSLPRASPSSSPRCSSSNIYRGHRVIGYKHQRTGRRRARRGRGAWXPGIAWXFGGMIFILVTAPGISGGHQTRP

SEQ ID NO: 4263 - protein, 95 aa, Zea mays
  UNSURE (1)..(95): unsure at all Xaa locations
  Clone ID: PAT_MRT4577_11560C.1.pep
  unsure (1)..(95): unsure at all Xaa locations
RNITVNXAQSRGGRGGGGGGYGGGRGGGGYGGGGRRDGCGGYGGGGGXYCGGGXTGGGGSCYGGVNLCCGYCNSYLNWSNCTEGPAQPIFYCFLP

SEQ ID NO: 4264 - protein, 107 aa, Zea mays
  Clone ID: PAT_MRT4577_115738C.1.pep
ATVGAAPATPMGTGGTDRWGPLAQVILFAPGLFPQVQRVYLRTCHVCCCPSVFLIERPLCASCKSCVNPGLQQTHASNSMGCGSMDPVTPVRLYFKLILRKKMVFGG

SEQ ID NO: 4265 - protein, 94 aa, Zea mays
  Clone ID: PAT_MRT4577_115781C.1.pep
MGSGTVLKSYFLTKKSEWGATRQAAALRPSTVSMVVRAYDYADELFKTAKTIASSWRSILAMDEFYATCGKRLAYIGLENTEANRQAYRTLLVT

SEQ ID NO: 4266 - protein, 412 aa, Zea mays
  UNSURE (1)..(412): unsure at all Xaa locations
  Clone ID: PAT_MRT4577_115783C.1.pep
  unsure (1)..(412): unsure at all Xaa locations
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILVEQGIVPGIKVDKGLVPLAGSNNESWCQGLDGLASREAAYYQQGARFAKWRTVVSIPNGPSELAVKEAAWGLARYAAISQVGWFGFYSCHYYWLQPACHDLHAXDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 4267 - protein, 388 aa, Zea mays
  Clone ID: PAT_MRT4577_115786C.1.pep
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILAEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 4268 - protein, 389 aa, Zea mays
  UNSURE (1)..(389): unsure at all Xaa locations
  Clone ID: PAT_MRT4577_115789C.1.pep
  unsure (1)..(389): unsure at all Xaa locations
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILAEQGIVPGIKVDKGLVPLAGSNNESWCQGLDGLASREXAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 4269 - protein, 52 aa, Zea mays
  UNSURE (1)..(52): unsure at all Xaa locations
  Clone ID: PAT_MRT4577_11578C.1.pep
  unsure (1)..(52): unsure at all Xaa locations
AALRLLQRLLALDPNDRPTAAEALADPYFKGIAEVERXPSCQRITKMEFEFE

SEQ ID NO: 4270 - protein, 388 aa, Zea mays
  Clone ID: PAT_MRT4577_115791C.1.pep
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILVEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 4271 - protein, 642 aa, Zea mays
  UNSURE (1)..(642): unsure at all Xaa locations
  Clone ID: PAT_MRT4577_115857C.1.pep
  unsure (1)..(642): unsure at all Xaa locations
RPSAAASGPACVLSVTATNGLGGLGLGLPGAHYLQSALVIRCMSCNSNFLNTDLLYPHIVSDHSQQFRLLDVPQRPSGQSAQQTEGMSGLPLYDSHNVEDENGSQKFVCRLCGLKFDLLPDLGRHHKVAHMVSGAVGHIPLGRGKYQLNRGRHYYSAFKKSLRPTSTLKKSSSSGIDKNLKFQISGLTSQIVESETSSLGKLQDFQCSDVAQTLFSKIQKTRPHPSNFDVLSVARSVCCKTSLLAALEVKYGPLPENIFVKAAKLCSDNGVQIDWHQEGFICPKGCKSRYNSNALLPMQLTAVDFLEAPXIPVXDEMWGMEEYHYVLDSKHFGWKPKNESVVLCEDISFGREKVPIVCVIDVDAKDSLGMKPEELLPHGSSLPWEGFHYITNRVMDSSLIDSENSMPGCACSHPECSPENCGHVSLFDGVYNSLVDINGTPMHGRFAYDEDSKIILQEGYPIYECNSSCICDSSCQNKVLQKGLLVKLELFRSENKGWAIRAAEPILQGTFVCEYIGEVVKADKAMKNAESVSSKGGCSYLFSIASQIDRERVRTVGAIEYFIDATRSGNVSRYISHSCSPNLSTRLVLVESKDCQLAHIGLFANQDIAVGEELAYDYRQKLVAGDGCPCHCGTTNCRGRVY

SEQ ID NO: 4272 - protein, 575 aa, Zea mays
  UNSURE (1)..(575): unsure at all Xaa locations
  Clone ID: PAT_MRT4577_115917C.1.pep
  unsure (1)..(575): unsure at all Xaa locations
METSRRPKPIHPQGGIHDPVRSSPRELLQTLAMSTAAAAKTPIKTLGSAAAGVITPTKSQAPAAAKTPCTSRARSSHASENSNPNIPGTPPPPQSTPSKPSLKSXRRAREPGPPPRRKSPPRPRPPRHRXRERRFLVAKKGARRRRNVGTMGGGGGGRGGEIDFDKCREAAREALRASQGEFFRKEVAASTATGEGQLGQEEEGKPLAEEDVKGGAFEERQEEETDAELEGSSKVRAMRTKAMAKAMSSVPNPGSGRVKHMVQAFESLLNISGATSDAERAGEGSWALPGLQLWKEDDKGXWGSHQCRCSLLLISRMQGLIDSAXLNGNTVRSSWDSRTSTGECSRRNSSESLRSRTSAGGRRSRRNQSSESLRSSWNKKLKVTSQHPFKLRTEQRGKFKEQQFVQKVQEMLAEEEKKRIHIAQGLPWTTDEPECLIKPAVKERTEPIDLVLHSDVRALERAEFDQHVLDRNKFAEQQRLEWERQQELEEEERIRQLRRTELVPKAQPMPYFDRPFIPKRSTKPATVPMEPKFHLRPEKISCYCRQQCMELGKLNPQQQCQHPLWQSRSTEHQHT

SEQ ID NO: 4273 - protein, 473 aa, Zea mays
  Clone ID: PAT_MRT4577_115921C.1.pep
MAGEEAAEGSGTRRHMDLNLYLGLPPLPRPPVWLDPTLMPNLTGAAPESSITGEPEESLALGAAAYSPSNALSTPEEHPMLDPIVYSWLDGNRTDGEEDTDAPEPGPVDGANVSRSQLVVAATGLEGDDDLPLVRFVRPSQMVVAGGMETVNTSILQQSIQRAAAIEARTPELRFQRVIQISQQHRIVRPASVNRSQGAASTDADRLVWAIQRTHNSLEATRRQKLDDNNLCGNGSAKKDESCDCNSSFECNICLDPAKQPVVTPCGHLFCWPCLYQWLHAHSPHSECPVCKGEVLELNVTPIYGRGGEEGNSTNPDFPPRPRANRRESLRQQLQMTDTRGIATVVRQLIQNQGIISVLPSPTGIEMSVVPAGRQRARARRQQRQDNNASSSIHVVAQNMGNVAPESSNQIQLSHSNGDNAAQMVLAAPQQSSSVEQLSTSSTTAVILGEPGSSRRSRPSESPTIRRTRRRPQ

SEQ ID NO: 4274 - protein, 475 aa, Zea mays
  Clone ID: PAT_MRT4577_115927C.1.pep
MAGEQAPEGSGTSRRMDLNLYLGLPPLPRPPVWLGTAMIAPTLMPNSTAPEAPRTGEPDESLAPAAAAYSPSNALSTPEEQPMLDPIVYSWLDGNSTDGEEHTDASEPGPVDGVNVPRSQLLVAATGLEGDDIPVVRFLRPSQVAAGGMEMVSTSILRRSNQGAAAIESGTPELRFQRVIQISQQHSIVRPASANHSQGAASTDADRLVWAIQRTHNSYEAARRQKLDGDNNLCGNGAAKKDESCDCNSSFECNICLDPAKQPVVTPCGHLFCWPCLYQWLHAHSPHSECPVCKGEVLELNVTPIYGRGGEEGNSTNPDFPPRPRANRRESLRQQLQMTDTRGIATVVRQLIQNQGIISVLPSPTGIEMSVVPAGRQRARARRQQRQDNNASSSIHVVAQNMGNVAPESSNQIQLSHSNGDNAAQMVLAAPQQSSSVEQLSTSSTTAVILGEPGSSRRSRPSESPTIRRTRRRPQ

SEQ ID NO: 4275 - protein, 62 aa, Zea mays
  UNSURE (1)..(62): unsure at all Xaa locations
  Clone ID: PAT_MRT4577_115969C.1.pep
  unsure (1)..(62): unsure at all Xaa locations
MAAEGEKKMITLKSXDGEEFEVEEAVAFXSQAIRHMIXDDCSXQGIPFPTSTPKSLSTVIEY

SEQ ID NO: 4276 - protein, 55 aa, Zea mays
  Clone ID: PAT_MRT4577_115970C.1.pep
VFKPGPTRGAFPVTIGRNLFYGSARFKSANKKIPLWFPKGPFYWQNTQPPWIFEK

SEQ ID NO: 4277 - protein, 482 aa, Zea mays
  Clone ID: PAT_MRT4577_115998C.1.pep
MATETETFAFQAEINQLLSLIINTFYSNKEIFLRELISNSSDALDKIRFESLTDKSKLDAQPELFIHIIPDKATSTLTIVDSGIGMTKSDLVNNLGTIARSGTKEFMEALAAGADVSMIGQFGVGFYSAYLVAERVVVTTKHNDDEQYVWESQAGGSFTVTRDTSGEQLGRGTKMVLYLKDDQMEYLEERRIKDLVKKHSEFISYPISLWTEKTTEKEISDDEDEEEKKDTEEGKVEDVDEEKEEKEKKKKKIKEVSHEWNLVNKQKPIWMRKPEEINKEEYAAFYKSLTNDWEEHLAVKHFSVEGQLEFKAVLFVPKRAPFDLFDNKKKANNIKLYVRRVFIMDNCEELIPEYLSFVKGIVDSEDLPLNISRETLQQNKILKVIRKNLVKKCIELFFEIAENKEDYNKFYEAFSKNLKLGIHEDSQNRTKIAELPRYHSTKSGDELTSLKDYVTRMKEGQNEIYYITGESKKAVEHSPFLE

SEQ ID NO: 4278 - protein, 335 aa, Zea mays
  Clone ID: PAT_MRT4577_116090C.1.pep
MAGNDNWINSYLDAILDAGKAAIGGDRPSLLLRERGHFSPARYFVEEVITGYDETDLYKTWLRANAMRSPQERNTRLENMTWRIWNLARKKKEFEKEEACRMSKRQPETEKTRADATADMSEDLFEGEKGEDAGDPSVAYGDSTTGSSPKTSSIDKLYIVLISLHGLVRGENMELGRDSDTGGQIKYVVELAKALSSSPGVYRVDLLTRQILAPNFDRSYGEPKELLVSTSGKNYKQEKGENSGAYIIRIPFGPKDKYLAKEHLWPFIQEFVDGALSHIVRMSKAIGEETGRGHPVWPAVIHGHYASAGIAAALLSGALNLPMAFTGHFLGKDKF

SEQ ID NO: 4279 - protein, 229 aa, Zea mays
  Clone ID: PAT_MRT4577_116175C.1.pep
MAWRGPLGAGEEALDSGLELSLGLPAYFARPSGLDAAREEPAEASAYAIQAASGSNVSKARVRPAGAAPVVGWPPVRSFRRNLAASSSRPSSGKHTRQEGSAKDGLFVKINMDGVPIGRKVDLTAYGGYADLSAAVGKLFRGLLAAQRDRAATAGGEEEEEGEGPVIGGDYTLVYEDDEGDRVLAGDVPWEMFVATAKRLRVLKSSDVPASSVTLGAGGPERSAADCCC

SEQ ID NO: 4280 - protein, 195 aa, Zea mays
  UNSURE (1)..(195): unsure at all Xaa locations
  Clone ID: PAT_MRT4577_116192C.1.pep
  unsure (1)..(195): unsure at all Xaa locations
LLMLLGLSAXAAAATMLPQCSQAPIASLLPPHLYQRSPXVCENPSLQPYRIQQAIGAWDLTCYHXLMLQQSLTPIXQELPLEHLLAHNIRAQRLQQLVLANLAAYFQTQQILTFNHLAEXNSGSXATLSKLPFSQLSADYPQNLLPFNQLTGLNSPAYLQQQQLLPFMQLAGVSPATFLTQPQSLXFYQHAAPNA

SEQ ID NO: 4281 - protein, 161 aa, Zea mays
  Clone ID: PAT_MRT4577_116302C.1.pep
MAAKIFCLLMLLGLSARAATATIVPLCSQAPIASLLAPYLSPAASWACENPVLQPYRLHQALAAVILPLSPLFLQHSSPLLHLFPLVHLLPHIMTPQLLQRLVLANLAAYSQQLQFLFFNQLGSLYSASYSLHPHLPFSQLPAVYPQQFVSFYHLAALYSP

SEQ ID NO: 4282 - protein, 125 aa, Zea mays
  Clone ID: PAT_MRT4577_116335C.1.pep
AYSQGRQFLPFNQRAALNSAAYLQQQLPFSQLVAAYPQQLLPFNQLAALNFPAYFQQQQLPPFTQLANVSPGAFFTQQQLLSFPSHAGPNGGPLLQLHQLLPFNQLALTNPGGFFQQPIIGGAPF

SEQ ID NO: 4283 - protein, 78 aa, Zea mays
  Clone ID: PAT_MRT4577_116680C.1.pep
FIFFFFYLEKGQFWIWSKLPQVFPCTALLLSAKRHYSFFSSYIYTWTLARAGQPLHIYIHFSPRVPPNTLDLGARGTG

SEQ ID NO: 4284 - protein, 699 aa, Zea mays
  UNSURE (1)..(699): unsure at all Xaa locations
  Clone ID: PAT_MRT4577_116788C.1.pep
  unsure (1)..(699): unsure at all Xaa locations
MASETETFAFQAEINQLLSLIINTFYSNKEIFLRELISNSSDALDKIRFESLTDKTKLDAQPELFIHIVPDKANNTLTIIDSGIGMTKSDLVNNLGTIARSGTKEFMEALAAGADVSMIGQFGVGFYSAYLVAERVVVTTKHNDDEQYVWESQAGGSFTVARDTSGEQLGRGTKMTLYLKDDQLEYLEERRLKDLIKKHSEFISYPISLWIEKTTEKEISDDEDEEDKKDEEGKVEDVDDEKEEKEKKKKKIKEVSHEWQLVNKQKPIWMRKPEEITKEEYAAFYKSLTNDWEEHLAVKHFSVEGQLEFKAVLFVPKRAPFDLFDTRKKQNNIKLYVRRVFIMDNCEELIPEWLSFVKGIVDSEDLPLNISRETLQQNKILKVIRKNLVKKCVELFFEIAENKEDYNKFYEAFSKNLKLGIHEDSTNRTKIAELLRYHSTKSGDELTSLKDYVTRMKEGQNDIYYITGESKKAVENSPFLEKLKKKGYEVLFMVDAIDEYSIGQLKEFEGKKLVSATKEGLKLDESEDEKKRKEELKEKFEGLCKVIKEVLGDKVEKVVVSDRVVDSPCCLVTGEYGWTANMERIMKAQALRDSSMSGYMSSKKTMEINPENAIMVXLRKRAEADPNDKSVKDLVMLLFETALLTSGFSLDDPNTFGSRIHRMLKLGLSIDEDEEAPEADTDMPPLEDDAGESKMEEVD

SEQ ID NO: 4285 - protein, 116 aa, Zea mays
  UNSURE (1)..(116): unsure at all Xaa locations
  Clone ID: PAT_MRT4577_116827C.1.pep
  unsure (1)..(116): unsure at all Xaa locations
PTRPVKLVLLSLFTVCITFAFQLSCLTANGPVILPAEAITIVVVLGLTFYTFWXAANKGYEFEFLGPFLVSVCLIHMLFXTXRIICVLGKTRTMVXRCIAQLVFSGFMIYXTDNRI

SEQ ID NO: 4286 - protein, 112 aa, Zea mays
  Clone ID: PAT_MRT4577_116932C.1.pep
MLRAFFMASSDHGSTTGPKDVPGSYCLPLEGAVRDRLDFYYFQGHDKYWESPVERYGSTVVRMNLPPGPFMVRDQGEVAVLDAQSFPVLCDMDKADKKDLIAVTYMPSTFLT

SEQ ID NO: 4287 - protein, 746 aa, Zea mays
  Clone ID: PAT_MRT4577_116976C.1.pep
MSGAVLVAIVASIGNLLQGWDNATIAAAVLYIKKEFQLQNEPTVEGLIVSMSLIGATIVTTFSGPLSDSIGRRPMLILSSILYFFSGLIMLWSPNVYVLLLARFVDGFGIGLAVTLVPLYISEIAPSEIRGLLNTLPQFSGSGGMFLSYCMVFGMSLSPSPDWRIMLGVLAIPSLFFFGLTIFYLPESPRWLVSKGRMAEAKKVLQKLRGKDDVSGELSLLLEGLEVGGDTSIEEYIIGPATEAADDLVTDGDKEQITLYGPEEGQSWIARPSKGPSMLGSVLSLASRHGSMVNQSVPLMDPIVTLFGSVHENMPQAGGSMRSTLFPNFGSMFSVTDQHAKNEQWDEENLHRDDEEYASDGAGGDYEDNLHSPLLSRQATGAEGKDIVHHGHRGSALSMRRQSLLGEGGDGVSSTDIGGGWQLAWKWSEKEGENGRKEGGFKRVYLHQEGVPGSRRGSIVSLPGGGDVLEGSEFVHAAALVSQSALFSKGLAEPRMSDAAMVHPSEVAAKGSRWKDLFEPGVRRALLVGVGIQILQQFAGINGVLYYTPQILEQAGVAVILSKFGLSSASASILISSLTTLLMLPCIGFAMLLMDLSGRRFLLLGTIPILIASLVILVVSNLIDLGTLAHALLSTVSVIVYFCCFVMGFGPIPNILCAEIFPTRVRGLCIAICAFTFWIGDIIVTYGSLPVMLNAIGLAGVFSIYAVVCLISFVFVFLKVPETKGMPLEVITEFFAVGAKQAAAKA

SEQ ID NO: 4288 - protein, 120 aa, Zea mays
  UNSURE (1)..(120): unsure at all Xaa locations
  Clone ID: PAT_MRT4577_11701C.1.pep
  unsure (1)..(120): unsure at all Xaa locations
CGSRCPLPDVEYRCSAGGLAWATDDHSLHNAFSTYGXALETKIILDRXTHRTHLFGFVTFSTEEAMRNAIEGMNGKEXLDGQNITDNEAHPRRGRGGGGGGYXCGRPGRPYRTGWRLDGG

SEQ ID NO: 4289 - protein, 95 aa, Zea mays
  UNSURE (1)..(95): unsure at all Xaa locations
  Clone ID: PAT_MRT4577_117083C.1.pep
  unsure (1)..(95): unsure at all Xaa locations
VYATTADPKNGSLGTIGPIAICFIVGAKVLSAGRFSRGSMNPXARAFCPGVAAGDVGGNWGYWIVPLVFGSLAGLVYVDVFIGCSXQQVSDHDYA

SEQ ID NO: 4290 - protein, 80 aa, Zea mays
  UNSURE (1)..(80): unsure at all Xaa locations
  Clone ID: PAT_MRT4577_117102C.1.pep
  unsure (1)..(80): unsure at all Xaa locations
MADKMLALFALQALCASATSATHIPGHLPPVMPXGTMNPCMQYCMMQQGLANLMACTLLMLQRLVSLPLXSKPVMMPQMM

SEQ ID NO: 4291 - protein, 378 aa, Zea mays
  Clone ID: PAT_MRT4577_117128C.1.pep
MAAAHLLAALSSSTALRPPLRLRSPQHPPHIRFNCTGRRPFPVVRAAETDAKNAKANAKAPNKAPAADGSSFNQLLGIKGAKQESDIWKIRLQLTKPVTWPPLVWGVLCGAAASGNFHWTVEDVAKSIVCMIMSGPCLTGYTQTLNDWYDRDIDAINEPYRPIPSGAISENEVITQIWVLLLGGLGLGALLDVWAGHDFPIVFYLAVGGSLLSYIYSAPPLKLKQNGWIGNFALGASYISLPWWAGQALFGTLTPDIIVLTTLYSIAGLGIAIVNDFKSIEGDRTLGLQSLPVAFGMETAKWICVGAIDITQLSVAGYLLSTGKLYYALVLLGLTIPQVFFQFQYFLKDPVKYDVKYQASAQPFFVLGLLVTALATSH

SEQ ID NO: 4292 - protein, 221 aa, Zea mays
  Clone ID: PAT_MRT4577_117130C.1.pep
VYVIPDSLDTDENDSLQVITQIWVLLLGGLGLGALLDVWAGHDFPIVFYLAVGGSLLSYIYSAPPLKLKQNGWIGNFALGASYISLPWWAGQALFGTLTPDIIVLTTLYSIAGLGIAIVNDFKSIEGDRTLGLQSLPVAFGMETAKWICVGAIDITQLSVAGYLLSTGKLYYALVLLGLTIPQVFFQFQYFLKDPVKYDVKYQHWQPAINEGKLKQNEQPF

SEQ ID NO: 4293 - protein, 137 aa, Zea mays
  UNSURE (1)..(137): unsure at all Xaa locations
  Clone ID: PAT_MRT4577_117161C.1.pep
  unsure (1)..(137): unsure at all Xaa locations
LSTAQIISARGACEMGLASAHSDEWPRPGLQVGLTNDAAAYCTGLLLGRRVLKTRGLDKEYEGNVEATGEDFCVEPADERRPFRALLDVGLXRTTTGNRVYGALKGAXMDGGLHIPDTEKRHAGFKHDDKQVDADIH

SEQ ID NO: 4294 - protein, 93 aa, Zea mays
  Clone ID: PAT_MRT4577_117310C.1.pep
QHCHLVRGNRSPKQMIIYFKTINTPFKKMQNSKFTLVASTTSKGKRLHDCLKEPRAPKSLKTRALLGCKSILFYKKKFPFGPLRFLHGGANFW

SEQ ID NO: 4295 - protein, 95 aa, Zea mays
  Clone ID: PAT_MRT4577_117382C.1.pep
MATPAVNVYCWAISPFVSRALLALADAGVDYDLVHMNRHDGDHRRPEHLARNPFRNVPVLEDGDFTLFESRAIAKHVLRKHKPALLGGSKLEQTV

SEQ ID NO: 4296 - protein, 441 aa, Zea mays
  Clone ID: PAT_MRT4577_117391C.1.pep
MAGSRFGSFKSEKGDSASAAAAAGGAAQRRDPYEVLGVGRTATDQEIKSAFRRMALKYHPDKNGDDPVASDRFQEVTFSYNILSDPDKRRQYDTSGFDAIESDSQELELDLSSLNTVNTVFAALFSKLGVPIKTTVSATVLEEALNGSVMVSQLQLGNSVQRKVEKQSAHFYSVDITEKQAKMGLVCRVHSNDKSKFKLLYFELEENGGLSLALQEDSVKVGKVTAAGMYFLGFPVYRFEQNNLAAAAKDSDGAFFKRLDSFQPCDIHELKPGTHFFAVYGDNFFKSASYTIEVVCGESFPAEKEMLRNVEAKILTKRAELSKFESEYREVLAKFTEMTSKYTQEMQAIDGLLKERNEIHASYTNNPPLKRSSSRNKAKSPSKVAKTGTEKHHQKEKKVKDHCMEGCGSDSDNSSEKKSKERFPRKKWLNLPFKLDRRKTC

SEQ ID NO: 4297 - protein, 93 aa, Zea mays
  Clone ID: PAT_MRT4577_117490C.1.pep
NSRADPRVHPRVRVSTAFCAEIVESADAYLFAGPIFNDYSSVGYSFLLKKEKAIIVQPERVIVGNGPAFGCVMMKEFLSELAKKVNKNTTAYE

SEQ ID NO: 4298 - protein, 101 aa, Zea mays
  Clone ID: PAT_MRT4577_117564C.1.pep
AVGARVVPPTMKPVGFTAVGPKVVVADTEGSGGGLKEFICWPLPGFGQGYLIYQKNGVTVGFCHRVSVRSTFGLGVGTPVVPFVCSRYETSREKNDPGSRL

SEQ ID NO: 4299 - protein, 343 aa, Zea mays
  UNSURE (1)..(343): unsure at all Xaa locations
  Clone ID: PAT_MRT4577_117709C.1.pep
  unsure (1)..(343): unsure at all Xaa locations
MIMMPSETRRFRSTGSSAPPTTVRPSVLPATPIRRPVPSHHTLPPLAAMSPSEPTREESVYMAKLAEQAERYEEMVEFMERVARSAGGAGGGDELSVEERNLLSVAYKNVIGARRASWRIISSIEQKEEGRGNEAHAASIRAYRSKIEAELARICDGILALLDSHLVPSAGGAESKVFYLKMKGDYHRYLAEFKSGAERKDAAESTMNAYKAAQXDHCVHTDRMTVHILLIVVLSCWLLVXDIALADLAPTHPIRLGLALNFSVFYYEILNSPDRACNLAKQAFDEAISELDSLGEESYKDSTLIMQLLRDNLTLWTSDTNEDGGDEIKEAAAAPKESAPEGQ

SEQ ID NO: 4300 - protein, 269 aa, Zea mays
  UNSURE (1)..(269): unsure at all Xaa locations
  Clone ID: PAT_MRT4577_117710C.1.pep
  unsure (1)..(269): unsure at all Xaa locations
MSPSEPTREESVYMAKLAEQAERYEEMVEFMERVARYAGGXAGGGEELSVEERNLLSVAYKNVIGARRASWRIISSIEQKEEGRGNEAHAASIRAYRSKIEAELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKEAAAAPKESAPEGQ

SEQ ID NO: 4301 - protein, 719 aa, Zea mays
  Clone ID: PAT_MRT4577_117732C.1.pep
MALSTFSVPRGFLGVPAQDSHFASAVELHVNKLLQARPINLKPRRRPACVSASLSSEREAEYYSQRPPTPLLDTINYPVHMKNLSVKELRQLADELRSDVIFHVSKTGGHLGSSLGVVELTVALHYVFNAPQDRILWDVGHQSYPHKILTGRRDKMPTMRQTNGLAGFTKRAESEYDSFGTGHSSTTISAALGMAVGRDLKGGKNNVVAVIGDGAMTAGQAYEAMNNAGYLDSDMIVILNDNKQVSLPTATLDGPVPPVGALSSALSKLQSSRPLRELREVAKGVTKQIGGSVHELAAKVDEYARGMISGPGSSLFEELGLYYIGPVDGHNIDDLITILNDVKSTKTTGPVLIHVVTEKGRGYPYAERAADKYHGVAKFDPATGKQFKSPAKTLSYTNYFAEALIAEAEQDSKIVAIHAAMGGGTGLNYFLRRFPSRCFDVGIAEQHAVTFAAGLACEGLKPFCAIYSSFLQRGYDQVVHDVDLQKLPVRFAMDRAGLVGADGPTHCGAFDVAYMACLPNMVVMAPSDEAELCHMVATAAAIDDRPSCFRYPRGNGVGVPLPPNYKGTPLEVGKGRILLEGDRVALLGYGSAVQYCLTAASLVQRHGLKVTVADARFCKPLDHALIRSLAKSHEVLITVEEGSIGGFGSHVAQFMALDGLLDGKLKWRPLVLPDRYIDHGSPADQLAEAGLTPSHIAASVFNILGQNREALAIMAVPNA

SEQ ID NO: 4302 - protein, 150 aa, Zea mays
  UNSURE (1)..(150): unsure at all Xaa locations
  Clone ID: PAT_MRT4577_117733C.1.pep
  unsure (1)..(150): unsure at all Xaa locations
EVGKGRILLEGDRXVALPRDRSAVQYCLTAASLVQRHGLKVTVADARFCKPLDHALIRSLAKSHEVLITVEEGSIGGFGSHVAQFMALDGLLDGKLKWRPLVLPDRYIDHGSPADQLAEAGLTPSHIAASVFNILGQNREALAIMAVPNA

SEQ ID NO: 4303 - protein, 300 aa, Zea mays
  Clone ID: PAT_MRT4577_117774C.1.pep
MGALDLHLDFASAQHGQAKLKEYAKSSLLSDGNYNTDKINGSNPDDYEKFEKGIMHYGCPHYRRRCRIRAPCCNEIFDCRHCHNETKNSIKIDKMKRHELPRHEVQQVVCSLCGTEQEVRQVCINCGVCMGKYFCGLCKLFDDDVSKQQYHCNGCGICRIGGRENFFHCSKCGCCYSIALKNSHACVEGAMHHDCPICFEYLFDSTNDVSVLPCGHTIHVKCLKEMEEHCQFACPLCSKSVCDMSKAWERLDMELATLSDSCDHKMVRILCNDCGAISDVQFHLIAHKCQNCKSYNTRQI

SEQ ID NO: 4304 - protein, 300 aa, Zea mays; identical to SEQ ID NO: 4303
  Clone ID: PAT_MRT4577_117777C.1.pep

SEQ ID NO: 4305 - protein, 318 aa, Zea mays
  Clone ID: PAT_MRT4577_11786C.1.pep
SKEYWDYEALTVQWGEQDNYEVVRKVGRGKYSEVFEGINVNNNEKCIIKILKPVKKKKIKREIKILQNLYGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNVYLNKYRIELDPQLEALVGRHSRKPWTKFINADNQHLVSHEAIDFLDKLLRYDHQDRLTAREAMTHPYFQQVRAAENSRTRA

SEQ ID NO: 4306 - protein, 332 aa, Zea mays
  Clone ID: PAT_MRT4577_11789C.1.pep
MSKARVYTDVNVLRPKEYWDYEALTVQWGEQDNYEVVRKVGRGKYSEVFEGINVNNNEKCIIKILKPVKKKKIKREIKILQNLYGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNVYLNKYRIELDPQLEALVGRHSRKPWTKFINADNQHLVSHEAIDFLDKLLRYDHQDRLTAREAMTHPYFQQVRAAENSRTRA

SEQ ID NO: 4307 - protein, 94 aa, Zea mays
  Clone ID: PAT_MRT4577_117985C.1.pep
RIAAPPAVWIVLETPVTAMMTCASGAVTSHGYTSSTHYTFPLRTATPMLSSSCRTCSLMAPRMSVCRSRLSDDRGALEDGMAVAAVNTTHFRVL

SEQ ID NO: 4308 - protein, 278 aa, Zea mays
  Clone ID: PAT_MRT4577_118142C.1.pep
MTMATKAACVLAVWVLVASGLCDLGSARAPLGSKPQREFDYFALSLQWPGTICASTRHCCATNGCCRSEPLQTFTIHGLWPDYDDGTWPSCCRRTQFEMDKILPLKEVLDKYWPSLYCSKSGTCFSGKGLFWAHEWEKHGTCSAPVVQDELQYFTLALDLYSKYNVTEMLSSGGIQVSNGKEYALSDVIDTIKHAFGGSPQIVCKRGSIEELRLCFDKELKPRDCLTTSLANGSVSKSKHCPRYITLPTYDPLVLANSTVEIMTQFDEFEVPAALYTA

SEQ ID NO: 4309 - protein, 66 aa, Zea mays
  UNSURE (1)..(66): unsure at all Xaa locations
  Clone ID: PAT_MRT4577_118357C.1.pep
  unsure (1)..(66): unsure at all Xaa locations
MASATVLKSSFLPKKSEWGATXHAAAPRPTTVSMVARACVYADELEKTAKTIASSSRGILAMDESN

SEQ ID NO: 4310 - protein, 459 aa, Zea mays
  Clone ID: PAT_MRT4577_118397C.1.pep
WVPRAGPEAHIYTRGGGQIHLGIHVIYIHARWAAPAAVARASWRARCWARRRRASLGNTGIQVFAYGLMLGMGSAVETLCGQAYGAHKYDMLGIYLQRSTVLLMATGVPLAALYAFSRPVLLLLGESPEIASAAAVFVYGLVPQIFAYAANFPIQKFMQAQSIMGPSAYISAAALAAHLALSYLVVYRLGLGLLGASLTLSASWWAIVAAQFAYIVTSSRCRLTWRGFSWQAFSGLPSFFRLSLASAVMLCLETWYFQILVLIAGLLKDPELALASLSVCMTISGWVFMISVGFNAAASVRVSNELGAGNPRAAAFSVVVVTLLSFVLSVIISVVILLCRDYISYIFTEGDDVSRAVAQLSPLLAVTLILNGIQPVLSGVAVGCGWQALVAYVNVGCYYIVGIPLGCLLGFYFDLGAAGIWSGMIGGTLMQTMILVWVTFRTNWNKEIRKLMQGCNSVS

SEQ ID NO: 4311 - protein, 126 aa, Zea mays
  UNSURE (1)..(126): unsure at all Xaa locations
  Clone ID: PAT_MRT4577_118552C.1.pep
  unsure (1)..(126): unsure at all Xaa locations
DPHLLDMRDMLIGPYNPGAVLTGGTRVVLSLDTQVEEHARVKTLIMDLLHRSVRTCSADFRASVGAMLDAEDADFXRTTAXKKPSASYLLPLHQCMFXRLLCKAFVGANPFTDWLVDNFRFTILDI

SEQ ID NO: 4312 - protein, 267 aa, Zea mays
  Clone ID: PAT_MRT4577_118564C.1.pep
MDPKMTEVTQMFARFKAAYARNDLNTCVTLLSQLKVHLTQFPSLPPLFQQTPNIVEELKLARDIYEHAVVLSVKLEDQDAFERDFCQLKPYYMDTCGIIPASPEEYPILGLNLLRLLVQNRIAEFHTELELLPAKALEHPCIKHAVELEQSFMEGAYNRVLSARQAVPHETYVYFIDLLAKTVRGEIAGCSEKGYDSLSVSDAKQMLMFSSDQDLHEYITEEHPEWEIKNGAVFFQKAKESQPCKEIPSLQLINQTLSYARELERIV

SEQ ID NO: 4313 - protein, 270 aa, Zea mays
  UNSURE (1)..(270): unsure at all Xaa locations
  Clone ID: PAT_MRT4577_118567C.1.pep
  unsure (1)..(270): unsure at all Xaa locations
MDPKMTEVTQMFARFKAAYTRNDLDACVTLLSQLKVHLTKFPSLPPSFEQTPKAVEELKLARDIYEHAVVLSVKLEDQDAFERDFCQLKPYYMDTCGIIPPSPEEYPILGLNLLRLLVQNRIAEFHTELELLPVKALEHPCIKHAVELEQSFMEGAYNRVLSARQAVPHETYVYFMDLLAKTVRDEIAGCSEKGYDSLSVSDAKQMLMFSSDQDLHEYITEEHPEWELXELKNGAVFFQKAKESQPYKEIPSLQLINQTLSYARELERIV

SEQ ID NO: 4314 - protein, 54 aa, Zea mays
  UNSURE (1)..(54): unsure at all Xaa locations
  Clone ID: PAT_MRT4577_118732C.1.pep
  unsure (1)..(54): unsure at all Xaa locations
HRYLAEFKSGAXRKDASGRTLNAYKAXQDIALADLASTHPIRLGLALNCSIFYY

SEQ ID NO: 4315 - protein, 86 aa, Zea mays
  UNSURE (1)..(86): unsure at all Xaa locations
  Clone ID: PAT_MRT4577_118915C.1.pep
  unsure (1)..(86): unsure at all Xaa locations
MDKDRKKAPVSRSSRAGLQFPVGRIHRQLKSRASAHGRVGATAAVYSAAILEYLTAEVLXLTDNSSKDLRGKLITPRHLCLGIHDY

SEQ ID NO: 4316 - protein, 48 aa, Zea mays
  Clone ID: PAT_MRT4577_119034C.1.pep
GGGHRDDGDGNDGDDDYGDGGGNGGGGDGYGGGNRGGGYGNSDGNWRN

SEQ ID NO: 4317 - protein, 71 aa, Zea mays
  UNSURE (1)..(71): unsure at all Xaa locations
  Clone ID: PAT_MRT4577_11925C.1.pep
  unsure (1)..(71): unsure at all Xaa locations
SQADFGRLDIDLAFVEMPGLGGCLAEFGPSNPFVGARILGSIYMXTIQTXAVLIETFTPLGAEVRWCXSCN

SEQ ID NO: 4318 - protein, 42 aa, Zea mays
  Clone ID: PAT_MRT4577_119501C.1.pep
VTFLHITYSLLPLAASSPVASTAALFLASDGSSTIGSVSTTT

SEQ ID NO: 4319 - protein, 75 aa, Zea mays
  Clone ID: PAT_MRT4577_119533C.1.pep
SPVFGFVVGRIDISASYVEYRCFVVSVSWTTDDHSLQNAFINYCDVLEFKIIRDLETQMSRGFVFVTFSTEDAML

SEQ ID NO: 4320 - protein, 448 aa, Zea mays
  Clone ID: PAT_MRT4577_119594C.1.pep
MPFRSIVRDVRDGFGSLSRRGFEVRFLSHRRGKSHGAVHELHDPVLVVQSSCWASLPPELLRDVIERLETSEDTWPSRKHVVACAAVCRTWREMCREIVKSPEFSGKITFPVSLKQPGPRDGTIQCFIKRDKSTQIYSLYLSFSSAVPVENGKFLLSAKRNCRATYTEYIISINSGDTSRCTSNNTYIGKLRSNFLGTKFVIYDTHPPYNGTSQTVAGKTSQRFYSKKGSTKVSCRWYSIAQISYELNVLGTRGPRRMNCVMHSIPASCLEAGGSVPCQPDSIAAHSVGGSFSSVSLSKSSTMDHSMHFTSSRLSDAITGDGIVNRGQALNDADDEECKDMPLILRNKAPRWHEQLQCWCLNFRGRVTVASVKNFQLVAATQPAAGALTPSQAAPQPAPPPPPDQEKVILQFGKVGKDIFTMDYCYPLSAFQAFAICLSSFDTKLACE

SEQ ID NO: 4321 - protein, 213 aa, Zea mays
  UNSURE (1)..(213): unsure at all Xaa locations
  Clone ID: PAT_MRT4577_119602C.1.pep
  unsure (1)..(213): unsure at all Xaa locations
PRVRPRVRSDGLSDKLNLLLRPYQLALSSXRHKHCSKAVLYHLEAIMNQVMFQDFENPAFQRNGSPRCLDPAEDSRQSFAAFVALRNLSWNEVLRKGTKYYSEDFSRFCDRKMSVVVATLAWSRPWPEQLLQCFFVAAKCVWLLHLLAFSFGPPLTILRVQDGRAFDELYMEDILHDRQPVQSPCQVKIMVTPGFYVQDRVLKCRVLKTRSAA

SEQ ID NO: 4322 - protein, 98 aa, Zea mays
  UNSURE (1)..(98): unsure at all Xaa locations
  Clone ID: PAT_MRT4577_119628C.1.pep
  unsure (1)..(98): unsure at all Xaa locations
MEAKXGRGSSSRRSMMYEAPLGYSIEDVRPAGGVKKFQSVAYSNCAKRGGWYPFWLPHSSRLGFLFWPFDSDQSLWPAASCCSSRSPVLAPCAPSSVS

SEQ ID NO: 4323 - protein, 126 aa, Zea mays
  Clone ID: PAT_MRT4577_119804C.1.pep
HACVHACAHACDHAYGRGSRGFCFGTFSTEEATRNAIKGMNGKELDGRNITDNEAQSHSSRGGGGRGYSGGRGGCGYCGSGRRDGGGRYGGGGRYGGRRRYGGGGGGYGTSNRRGCYSNCDGNWKN

SEQ ID NO: 4324 - protein, 535 aa, Zea mays
  Clone ID: PAT_MRT4577_119841C.1.pep
PRVRPRVRPRVREVDVEVPTDEDETSEEEDSTPETTEEETEEDEDEEKEKKPKTKTIKETTSEWELLNDMKAVWLRSPKEVTDEEYSKFYHSLAKDFGDDKPMGWSHFTAEGDVEFKALLFIPPKAPHDLYESYYNSNKSNLKLYVRRVFISDEFDDLLPKYLSFLRGIVDSDTLPLNVSREMLQQHSSLKTIKKKLIRKALDMIRKLAEEDPDEYSNKDKTDEEKNEMEEKKGQYAKFWNEFGKSIKLGIIEDATNRNRLAKLLRFESTKSDGKLASLDEYISRMKPGQKDIFYLTGSSKDQLEKSPFLERLTKKNYEVIFFTDPMDEYLMQYLMDYEDRKFQNVSKEGLKLGKDSRLKDLKESFKELTEWWKKALESESVDSVKVSSRLHDTPCVVVTSKYGWSANMEKIMQAQTLSDSSKQAYMRGKRVLEINPRHPIIKELRDKVAQDNESEELKQTARLVYQTALMESGFNLPDPKEFASSIYKSVHKSLDLSPDAAVEEEDEAEEQPEVEEKEPAAKEGSEPSFDKDEL

SEQ ID NO: 4325 - protein, 809 aa, Zea mays
  Clone ID: PAT_MRT4577_119850C.1.pep
MRKWALSSALLLLLFLLTTLPDPAKKLQVNAEESSDDLANPPKVEEKLGAVPHGLSTDSEVAQREAESISRKTLRSSAEKFEFQAEVSRLMDIIINSLYSNKDIFLRELISNASDALDKIRFLSLTDKEVLGEGDTAKLEIQIKLDKEKKILSIRDRGIGMTKEDLINNLGTIAKSGTSAFVEKMQSGGDLNLIGQFGVGFYSVYLVADYVEVVSKHNDDKQYVWESKADGSFAISEDTWNEPLGRGTEIRLHLRDEAKEYLEEDKLKDLVKKYSEFINFPIYLWSTKEVDVEVPTDEDETSEEEDSTPETTEEETEEDEEKEKKPKTKTIKETTSEWELLNDVKAVWLRSPKEVTDEEYSKFYHSLAKDFGDDKPMGWSHFTAEGDVEFKALLFIPPKAPHDLYESYYNSNKSNLKLYVRRVFISDEFDDLLPKYLSFLKGIVDSDTLPLNVSREMLQQHSSLKTIKKKLIRKALDMIRKLAEEDPDEYSNKDKTDEEKSEMEEKKGQYAKFWNEFGKSIKLGIIEDATNRNRLAKLLRFESTKSDGKLASLDEYISRMKSGQKDIFYITGSSKEQLEKSPFLERLTKKNYEVIFFTDPVDEYLMQYLMDYEDKKFQNVSKEGLKLGKDSKLKELKESFKELTDWWKKALESENVDSVKISNRLHDTPCVVVTSKYGWSANMEKIMQAQTLSDSSKQAYMRGKRVLEINPRHPIIKELRDKVAQDNESEELKQTARLVYQTALMESGFNLPDPKEFASSIYKSVHKSLDLSPDAAVEEEDEAEEQPEVEEKEPAAKEGSEPSFDKDEL

SEQ ID NO: 4326 - protein, 181 aa, Zea mays
  UNSURE (1)..(181): unsure at all Xaa locations
  Clone ID: PAT_MRT4577_119851C.1.pep
  unsure (1)..(181): unsure at all Xaa locations
MDSRLKDLNXFFKELTEWWKKALESESVDSVKVSSRLHDTPCVVVTSKYGWSANMEKIMQAQTLSDSSKQAYMRGKRVLEINPRHPIIKELRDKVAQDNESEELKQTARLVYQTALMESGFNLPDPKEFASSIYKSVHKSLDLSPDAAVEEEDEAEEQPEVEEKEPAAKEGSEPSFDKDEL

SEQ ID NO: 4327 - protein, 391 aa, Zea mays
  Clone ID: PAT_MRT4577_119950C.1.pep
MVQIPKVSRLRGFGLLLQTPGMAAGAGGGELEALEGVRSIVLKPSESLDESRFTRIAGADFNDPAIGLQGLLASLASTGFQASNLGDAIDVVNQMLDWRLSHEKPSEDCDEAELDPKYRASVKCKIFLGFTSNLVSSGIRDIIRFLAQHHMVDVIVTSAGGIEEDLIKCLAPTYRGDFSLPGALLRSKGLNRIGNLLVPNDNYCKFENWIMPLFDQMLQEQSTENVWTPSKVIARLGKEINDESSYLYWAYKNNIPVYCPALTDGSLGDMLFCHAVRNPGLIIDIVQDIRLMNGEAIHATPRKTGIIVLGGGLPKHHICNANMFRNGADYAVYINTAQEFDGSDSGAHPDEAVSWGKIKGSAKPVKVHCDASIAFPLLVAATFARKVHNSK

SEQ ID NO: 4328 - protein, 292 aa, Zea mays
  Clone ID: PAT_MRT4577_119971C.1.pep
MAIATESRGSEDRASAHANEEKRWVLSDFEVGKPLGRGKFGHVYLAREKRSNQIVALKVLFKSQLKQSQVEHQLRREVEIQSHLRHPNILRLYGYFYDQTRVYLILEYAAKGELYKELTRCKHFSERRSATYIASLARALIYLHGKHVIHRDIKPENLLVGAQGEIKIADFGWSVHTFNRRRTMCGTLDYLPPEMVEKTEHDYHVDIWSLGILCYEFLYGVPPFEAKEHSETYRRIVKVDLKFPLKPFVSPAAKDLISQMLVKNSAQRLPLHKVLEHPWIVQNADPSGVCRG

SEQ ID NO: 4329 - protein, 296 aa, Zea mays
  Clone ID: PAT_MRT4577_119972C.1.pep
MAVATESRGSEDRASAHANQEKRWVLSDFEVGKPLGRGKFGHVYLAREKRSSEIVALKVLFKSQLKQSQVEHQLRREVEIQSHLRHPNILRLYGYFYDQTRVYLILEYAAKGELYKELTRCKHFSERRTATYVASLARALIYLHGKHVIHRDIKPENLLVGVQGEIKIADFGWSVHTFNRRRTMCGTLDYLPPEMVEKAEHDYHVDIWSLGVLCYEFLYGVPPFEAKEHSETYRRIVKVDLKFPLKPFVSPAAKDLISQMLVKSSAQRLPLHKVLEHPWIVQNADPSGVYREGRSI

SEQ ID NO: 4330 - protein, 96 aa, Zea mays
  UNSURE (1)..(96): unsure at all Xaa locations
  Clone ID: PAT_MRT4577_120168C.1.pep
  unsure (1)..(96): unsure at all Xaa locations
PAESSVCENPILQPYRVQQAITGGIAPISPLFLQHSSALLHLLPLVHLLAQNMRAQQLQQLVLANXLAAYSQQPRILTFNLLAALNSGSYLQHQQL

SEQ ID NO: 4331 - protein, 166 aa, Zea mays
  UNSURE (1)..(166): unsure at all Xaa locations
  Clone ID: PAT_MRT4577_120187C.1.pep
  unsure (1)..(166): unsure at all Xaa locations
VENRFCLSHGRGLRALSRXQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHVFYATEYPEQPMVNLEMCMTGLD

SEQ ID NO: 4332 - protein, 127 aa, Zea mays
  UNSURE (1)..(127): unsure at all Xaa locations
  Clone ID: PAT_MRT4577_120189C.1.pep
  unsure (1)..(127): unsure at all Xaa locations
MAVLSAADASPVSAIGFEGYEKRLEITFSEAPVFVDPHGXXGLRALSRAQIDSVLDLARCTIVSELSNKDFDSYVLSESSLFIYPLKIVIKTCGTAKLLLTIPRILELAEELSMPLAAVKYSRGTFI

SEQ ID NO: 4333 - protein, 370 aa, Zea mays
  UNSURE (1)..(370): unsure at all Xaa locations
  Clone ID: PAT_MRT4577_120192C.1.pep
  unsure (1)..(370): unsure at all Xaa locations
MAVLSAADAPPASAIGFEGYEKRLEITFSEAPVFVDPHGSGLRALSRSQIDSVLDLARKIVIKTCGTTKLLLTIPRXILELAEELSMPLAAVKYSRGTFIFPGAQPAPHRSFSEEVAVLNRYFGGLKSGGNAYVIGDAARPGQKWHIYYATEYPEQPMVNLEMCMTGLDTKKASVFFKTNADGNTTCAKEMTKLSGISEIIPEMEICDFDFEPCGYSMNAIHGSAFSTIHVTPEDGFSYASYEVMGLDATALSYGDLVKRVLGCFGPSEFSVAVTIFGGRCQSGTWGKELGAEAYDCNNMVEQELPGGGLLIYQSFCAAEDAVASSPKSVLRCFDGENASPFVKDCKLANLVCLEEXLDAIEERXGVLDE

SEQ ID NO: 4334 - protein, 447 aa, Zea mays
  UNSURE (1)..(447): unsure at all Xaa locations
  Clone ID: PAT_MRT4577_120193C.1.pep
  unsure (1)..(447): unsure at all Xaa locations
MAVLSAAGAPPASAIGFEGYEKRLEITFSEAPVFVDPHGSGLRALSRSQIDSVLDLARCTIVSELSNKDFDSYVLSESSLFIYPLKIVIKTCGTTKLLLTIPRILELAEELSMPLAAVKYSRGTFIFPGAQPAPHRSFSEEVAVLNRYFGGLKSGGNAYVIGDAARPGQKWHIYYATEYPEQPMVNLEMCMTGLDTKKASVFFKTNADGNTTCAKEMTKLSGISEIIPEMEICDFDFEPCGYSMNAIHGSAFSTIHVTPEDGFSYASYEVMGLDATALSYGDLVKRVLGCFGPSEFSVAVTIFGGRGQAGTWGKELGAEAYDCNNMVEQELPGGGILIYQSFCAAEDAVASSPKSVLRCFDGENAAPFAKDCKLANLVCLEEXLDAIEEKDGVLDMSKTGFWCRFASEFFFLFISLRSRGCRLVSSQARLLVRRMSSINMCSYVATC

SEQ ID NO: 4335 - protein, 224 aa, Zea mays
  UNSURE (1)..(224): unsure at all Xaa locations
  Clone ID: PAT_MRT4577_120194C.1.pep
  unsure (1)..(224): unsure at all Xaa locations
MESKGGKKSSSSRSMMYEAPLGYSIEDVRPAGGVKKFQSAAYSNCXRSHPDIPFGFLILVVXISFLTLXLTNLSDLLLPDNRPVPQSCSLHSSLLHLQHXSDSPAPMAVLSAADASPVSAIGFEGYEKRLEITFSEAPVFXDPHGRGVLRALXRAKIDSVLDLARGTIVSELSXKDFDSYVLSESSLVIYPLKIVIMTCGTTMLLLTIPRILSLLKXLSMPLLL

SEQ ID NO: 4336 - protein, 86 aa, Zea mays
  Clone ID: PAT_MRT4577_120207C.1.pep
PLDHERIKSHWPGAKALGEMQEHNFRKNRPDGSFHFSPPRGGWIQEEQIPMAFATLLVFVSNSWSLPFGPVYPPDQKSRFGVSPVL

SEQ ID NO: 4337 - protein, 242 aa, Zea mays
  Clone ID: PAT_MRT4577_120229C.1.pep
MTVPDAESRFHVLAVDDSLVDRKLIEMLLKTSSYQVTTVDSGSKALELLGLRDASSPSPSSPDHQEIDVNLIITDYCMPGMTGYDLLKRVKGSSSLKDIPVVIMSSENVPARISRCLQDGAEEFFLKPVKLADMKKLKSHLLKRKQPKEAQAQAQAQAQQGQAVELEPEQQLDPRTQPAHDAEETAAEPPPAASNGTTDGGNKRKAAAMEEEGMLAVMTVAAPESSTKPRLSTTTSSLAVET

SEQ ID NO: 4338 - protein, 238 aa, Zea mays
  Clone ID: PAT_MRT4577_120230C.1.pep
MTVPDAESRFHVLAVDDSLVDRKLIEMLLKTSSYQVTTVDSGSKALELLGLRDASSPSPSSPDHQEIDVNLIITDYCMPGMTGYDLLKRVKGSSSLKDIPVVIMSSENVPARISRCLQDGAEEFFLKPVKLADMKKLKSHLLKRKQPKEAQAQAQQGQAVELEPEQQLDPRAQPAHDAEETAAEPPPAASNGTADGGNKRKAAAMEEEGMLAVMTVAAPESSTKPRLSTTSNSLAVET

SEQ ID NO: 4339 - protein, 318 aa, Zea mays
  Clone ID: PAT_MRT4577_120420C.1.pep
MCIEVLADFDTRPFLKQLNVLGRYEPIKRNVYCTKRYIEDYGISCHCKPSPGSSVVCGRDCYCSMLFSCCSSQCECDIACTNKSFQHRPLTKTKLIKTEKCGHGLVAEDEIKKGEFVIEYVGEVIDDRTCENRLWTMKRLDDTDFYLCEVSSNMVIDATNKGNLSRFINHSCEPNTAMQKWTVDGETRVGIFALRDIKIGEELTYDYNIMYRFVQFGAAQVCHCGSSNCRKMLGTTKYSGSSQNHHAKKKKRKTSCENCIQQFLRLWHPHKKMYVGCWIIDFDQETKMHTLKFNDLHTEKFNLKEEEWHFLEVDFDED

SEQ ID NO: 4340 - protein, 342 aa, Zea mays
  Clone ID: PAT_MRT4577_120422C.1.pep
MVRMSSSSSASGVNLTEQIENVFDQLISKIEQADPDFDPRPFLKQLNVLGRYEPIKRNVYFTKRYIEDYGISCHCKPSPGSSVVCGRDCYCSMLFSCCSSQCECDIACTNKSFQHRPLTKTKLIKTEKCGHGLVAEDEIKKGEFVIEYVGEVIDDRTCENRLWTMKRLDDTDFYLCEVSSNMVIDATNKGNLSRFINHSCEPNTAMQKWTVDGETRVGIFALRDIKIGEELTYDYKFVQFGAAQVCHCGSSKCRKMLGTTKYSGSSQNHRTKKKKRKTSCENCIQQFLRLWHPRQKMYVGCWIVDFDQGTKMHTLQFIDHHTEKFDLKEEEWHFLEVDSDED

SEQ ID NO: 4341 - protein, 162 aa, Zea mays
  Clone ID: PAT_MRT4577_120660C.1.pep
MSAAEGAVVFSEEKEALVLKSWAIMKKDSANLGLRFFLKIFEIAPSARQMFPFLRDSDVPLETNPKLKTHAVSVFVMTCEAAAQLRKAGKITVRETTLKRLGGTHLKYGVADGHFEVTRFALLETIKEALPADMWGPEMRNAWGEAYDQLVAAIKQEMKPSE

SEQ ID NO: 4342 - protein, 169 aa, Zea mays
  UNSURE (1)..(169): unsure at all Xaa locations
  Clone ID: PAT_MRT4577_120664C.1.pep
  unsure (1)..(169): unsure at all Xaa locations
MALAEADDGAVVFGEEQEALVLKSWAVMKKDAANLGLRFFLXKVFEXXAPSAXXQCXSFLRXSDVPLXEKNPKLKTHAMSVFVMTCEAAAQLRKAGKVTVRETTLKRLGATHLRYGVADGHFEVTGFALLETIKEALPADMWSLEMKKAWAEAYSQLVAAIKREMKPDA

SEQ ID NO: 4343 - protein, 162 aa, Zea mays; identical to SEQ ID NO: 4341
  Clone ID: PAT_MRT4577_120666C.1.pep

SEQ ID NO: 4344 - protein, 126 aa, Zea mays
  UNSURE (1)..(126): unsure at all Xaa locations
  Clone ID: PAT_MRT4577_120668C.1.pep
  unsure (1)..(126): unsure at all Xaa locations
MAARSSSQQLAAAADLAAALLLLAARAETTSAAESCREVTATVAPCLGXQRAARRSPPRACCXGLRSLNSRASSTARTYFTCNCLNSMTGRISGGDSMTNAANIPGKCGGSVSATISPTDNCTKIN

SEQ ID NO: 4345 - protein, 107 aa, Zea mays
  UNSURE (1)..(107): unsure at all Xaa locations
  Clone ID: PAT_MRT4577_120776C.1.pep
  unsure (1)..(107): unsure at all Xaa locations
MAAKIFCLLMLLAVSASAATATIFPXCSQAPIASLLPSYLSPAMSSACENPILQPYRIQQAIAPGILPLYPLYVQQSSAILQQHTLXYLLQQNIGSPQIPPLVLANP

SEQ ID NO: 4346 - protein, 140 aa, Zea mays
  UNSURE (1)..(140): unsure at all Xaa locations
  Clone ID: PAT_MRT4577_120809C.1.pep
  unsure (1)..(140): unsure at all Xaa locations
YACGEMAPTLGLVGPTSLVPMIETAIGIVDSTGGXSHVLVIXVADGQVTLRVVAQYGQWTPQEPDTIGAVARASQFPLAIDFVGVGDGPWDMMHQVEDNIPVRSFHSFQXVNLTEINDESFTTDRKEAEFALSALVEMPS

SEQ ID NO: 4347 - protein, 104 aa, Zea mays
  UNSURE (1)..(104): unsure at all Xaa locations
  Clone ID: PAT_MRT4577_12083C.1.pep
  unsure (1)..(104): unsure at all Xaa locations
GSPAFGFEGERIEMEKTDGEYRXFIGGLCWAKXDHSLQNAFMTYFEGLKSEIILDRXTHRYRGFGFDTFSTEEAMXNAIECMNSEEMYGRNITDNEVQSRGDRG

SEQ ID NO: 4348 - protein, 178 aa, Zea mays
  UNSURE (1)..(178): unsure at all Xaa locations
  Clone ID: PAT_MRT4577_120886C.1.pep
  unsure (1)..(178): unsure at all Xaa locations
GSTSCARDMTPLSGVSDIIPTMGICESDCAPCGYFMNAIHGSAFSTVHATPDDGYNYASDEVVGLDATGLTYGDLVXRALECFGPLDYFDAGTIFCVRGLAGTWGKALGAXDYDCNNMVEQELPVCGLLQNHIFCAAENAVATFSKSDVHCFDRENVESAPTAMKKDYTVPNLLCWEE

SEQ ID NO: 4349 - protein, 45 aa, Zea mays
  UNSURE (1)..(45): unsure at all Xaa locations
  Clone ID: PAT_MRT4577_120955C.1.pep
  unsure (1)..(45): unsure at all Xaa locations
AASRRGQPARRRRRRRRCYGSGTASSSRNPPLSQGHQQRSGHPLX

SEQ ID NO: 4350 - protein, 53 aa, Zea mays
  Clone ID: PAT_MRT4577_121027C.1.pep
TVNQQHSSLIHTTSKVTHMPTSMGGLVLDLTTVFSPSQCRACPPRGGLPPTAL

SEQ ID NO: 4351 - protein, 355 aa, Zea mays
  Clone ID: PAT_MRT4577_121045C.1.pep
MVGTAEGGAERAVRRWVDAAGGRLVLDGGLATELEANGADLNDPLWSAKCLLSSPHLIRKVHMDYLEAGANIIITASYQATIQGFESKGFSKEQSENLLTKSVQIALEAREMFLKEHLEKSTPIQHPILVAAALGSYGAYLADGSEYSGDYGEAGTKEFLKDFHRRRLQVLAEAGPDLIAFETIPNKLEAQAYVELLEECNINIPSWLSFNSKDGVHVVSGDSLIECATIADKCAKVGAVGINCTPPRFIHGLILSIRKVTDKPILIYPNSGERYDGEKKEWVESTGVSDGDFVSYVNEWCKDGAALIGGCCRTTPNTIRAIHRTLNQGCHKHQLPVGCSIDLCSTPDALLPAVP

SEQ ID NO: 4352 - protein, 521 aa, Zea mays
  UNSURE (1)..(521): unsure at all Xaa locations
  Clone ID: PAT_MRT4577_121053C.1.pep
  unsure (1)..(521): unsure at all Xaa locations
MPGAVIVHHHTRYKTYPGEVTGIAIFSCFIASVAGCIFGYDIGLTSGLTSTEPFLVKFFPSIYEEMKRQVVVNQYCKFDSQVLTLFSSSLFLAATVATFFAGPMTRAFGRKWTLFAAASAYVVGACIGGVSVNFPMLLTGRVLVGSGVGISIQAAPLYISEVAPAQQRGMLNILFQLMITVGILTANMTNYLASKVSGGWGWRTPVTFGAIPAAVIALGALAIPDTPASLVERGDTATARKTLSQIRGVGDVREEFDDLAAASEDAKAVQCPWRXLLRRXKYKPQLTFALLIPFFQQLTGINVIMFYAPVLFKTVGFKQNATLVSSVITGLVNVFSTFVAIATADKIGRRALFLQGGTQMIISQILVGTFIGLQFGMSGTGDISEQYAMCIVLFVCVYVAGFAWSWGPMGWLVPSEIYPLAVRSAAMSVTVAVNMFFTAFIGQIFLTLLCHLRFGLFYFFGAWVLLMTLFIAMLLPETKSVPVEEMAHVWKKHWFWRKFVIDTGNDARNAEMRKRIALEMS

SEQ ID NO: 4353 - protein, 119 aa, Zea mays
  UNSURE (1)..(119): unsure at all Xaa locations
  Clone ID: PAT_MRT4577_121091C.1.pep
  unsure (1)..(119): unsure at all Xaa locations
LAAAYHQQFIPFSHLKALSFPAYLQQQHMLPFSQLDGVSLAAFLTQPQXLPFYQHAAPNAGTLLQVQQLLPFSQLALTNPTVLYQQPIIGGAFFRFLMSYSSNNKVFVFDVCGFPEIRK

SEQ ID NO: 4354 - protein, 145 aa, Zea mays
  UNSURE (1)..(145): unsure at all Xaa locations
  Clone ID: PAT_MRT4577_121092C.1.pep
  unsure (1)..(145): unsure at all Xaa locations
LAQIIKAHVLHQLVLAGLAAYFQEHQFLPFXQLAALIYASYLHHRQMPLTXLAAAYXQQFLPFSHLKALGSPAYLQHQQLLPFSQLVGVSLAAFLTHPQLLPFYQHAAPNAGTLLQLQQLLPFSQLALANPTVLYQQPIIGGAFF

SEQ ID NO: 4355 - protein, 619 aa, Zea mays
  Clone ID: PAT_MRT4577_121097C.1.pep
MPKHYRPAGKKKEGNAAKYITRTKAVNYLQVSLAIFRKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRLSHEWQAYISRTHSLRKTFISVKGIYYQAEVQGQKITWLTPHALQQVLTDDVDFNVMLSFLEFYETLLGFVNFKLYHSINVNYPPILDPRLEALAAELYALCRYMSAGSRRMIGNSQTDEVMEDKDEKSKAEEVIKEEKVVKNKASSKADESELRLAQLQHQLPTNEPGALMNLVEESTADDADDDDTKDCKGLFKNLKFYLSREVPRESLLFIIPAFGGTVSWEGEGAPFKEIDEDITHQIVDRPTQSHVFLSRDYVQPQWVFDCVNARIILPTEGYLVGRVPPPHLSPFVDNDAEGYMPEYAETIKRLQAAARNEVLPLPGIGDEDLDNSLVAAMMDRTASNEAAEKKRKLEMLEKQYIDELKKEIDGVAFSSLSNKEADKSPNAKDDTQSDREEDASKQEEDDDDDIGTALMSRKQRGLYKAMKMGKEKKKEKVELLKKRKKNADSGASSKKRH

SEQ ID NO: 4356 - protein, 45 aa, Zea mays
  Clone ID: PAT_MRT4577_121167C.1.pep
PFPPHPSTFAFLRWNSRALGIKESFGYILRLNLFYLFCKSNDTYI

SEQ ID NO: 4357 - protein, 86 aa, Zea mays
  Clone ID: PAT_MRT4577_121283C.1.pep
ALRAIPTGTWGGAQEALSLVGTMGGHNREVTAIATPIDNSPFIGSSSRDKSVLVGDATNWVHFTPESGATADYGVPFRRLTGHSHF

SEQ ID NO: 4358 - protein, 90 aa, Zea mays
  UNSURE (1)..(90): unsure at all Xaa locations
  Clone ID: PAT_MRT4577_121297C.1.pep
  unsure (1)..(90): unsure at all Xaa locations
MAAADVEYHXLVSGLAWATSNEXMENAFIFYGEILDCKVMTNRETGRYGGIRFITLLFKNYMLDAIDNKNCMELDCRNITVDTTQSPCSC

SEQ ID NO: 4359 - protein, 89 aa, Zea mays
  Clone ID: PAT_MRT4577_121344C.1.pep
QLQLASVFFTFHLGTKTHYYGRTILHGGAKYRATGRGFVVRHAKFAENYRMYSRSHFVKALELLILLVVYLAYGSSYRSSSLYLYVTVS

SEQ ID NO: 4360 - protein, 77 aa, Zea mays
  Clone ID: PAT_MRT4577_121449C.1.pep
TNSSNIFWVRILINLSATATTPTIFPQCSQAPITTLLPPILSPSSSSICQNPILQPYSIHQPIATHILPLSPLLLQQ

SEQ ID NO: 4361 - protein, 161 aa, Zea mays
  Clone ID: PAT_MRT4577_121699C.1.pep
MTSSSSPSRKALSKIACNRLQKELAEWQQNPPAGFKHKVSDNLQRWVIEVTGAAGTLYAGEAYQLQVDFPEHYPMEAPQVIFLNPAPMHPHIYSNGHICLDILYDSWSPAMTVSSVCISILSMLSSSPAKQRPADNDRYVRNCRNGRSPKETRWWFHDDTV

SEQ ID NO: 4362 - protein, 161 aa, Zea mays
  Clone ID: PAT_MRT4577_121701C.1.pep
MTSSSSPSRKALSKIACNRLQKELAEWQQNPPAGFKHKVSDNLQRWVIEVTGAAGTLYAGETYQLQVDFPEHYPMEAPQVIFLNPAPMHPHIYSNGHICLDILYDSWSPAMTVSSVCISILSMLSSSPAKQRPVDNDRYVRNCRNGRSPKETRWWFHDDTV

SEQ ID NO: 4363 - protein, 161 aa, Zea mays
  Clone ID: PAT_MRT4577_121705C.1.pep
MTSSSSPSRKALSKIACNRLQKELAEWQLSPPAGFKHKVSDNLQRWVIEVTGAAGTLYAGETYQLQVDFPEHYPMEAPQVIFLNPAPMHPHIYSNGHICLDILYDSWSPAMTVSSVCISILSMLSSSPAKQRPVDNDRYVRNCRNGRSPKETRWWFHDDTV

SEQ ID NO: 4364 - protein, 92 aa, Zea mays
  UNSURE (1)..(92): unsure at all Xaa locations
  Clone ID: PAT_MRT4577_121749C.1.pep
  unsure (1)..(92): unsure at all Xaa locations
DAQPELFIHIIPDKATNTLTIVDSGIGMTKSDLVNNLGTIARSGTKEFMEALAAGADVSMIGQFGVGFYSAYLVAERVVVXTKHNDDEQYVW

SEQ ID NO: 4365 - protein, 244 aa, Zea mays
  Clone ID: PAT_MRT4577_121828C.1.pep
MGRGRVELKRIENKINRQVTFAKRRNGLLKKAYELSVLCDAEVALIVFSNRGKLYEFCSGPSITRTLERYEKNSYAGPDTAVQNKENELVQNSRNEYLKLKAKVDNLQRTQRNLLGEDLGSLGVKELDQLEKQIDSSLSHIRSTRTQHMLDQLTDLQRREQMMCEANKCLRRKLEETSNQVHGQVWEHGANLLLGYERHSSPQQAPSHVGNGLFFHPLEAAAEPTLQIGFAPEHMNNFMPAWLP

SEQ ID NO: 4366 - protein, 339 aa, Zea mays
  Clone ID: PAT_MRT4577_121831C.1.pep
MVGTAAGSAEEAVRRWVDAAGGRLVLDGGLATELEANGADLNDPLWSAKCLLSSPHLIRKVHMDYLEAGANIIITASYQATIQGFESKGFSKEQSENLLTKSVEIALEAREMFLKEHLEKSTPIQHPVLVAASLGSYGAYLADGSEYSGDYGEAGTKEFLKDFHRRRLQVLAEAGPDLIAFETIPNKLEAEAYVELLEECNINIPAWFSFNSKDGVHIVSGDSLIECTTIADKCAKVGAVGINCTPPRFIHGLILSIRKVTDKPILIYPNSGERYDGEKKEWVESTGVSDGDFVSYVNEWCKDGAVLIGGCCRTTPNTIRAIHRTLNKSPNKQQLPAVE

SEQ ID NO: 4367 - protein, 140 aa, Zea mays
  UNSURE (1)..(140): unsure at all Xaa locations
  Clone ID: PAT_MRT4577_121923C.1.pep
  unsure (1)..(140): unsure at all Xaa locations
MFCQHVKSHLQKYRTARYRPELSEGSSEKKVASKEDIPSIDLKGSFDLTEALRLQLELQKRLHEQLEIQRSLQLRIEEQGKXFQMMLEQQCIPGGRKRRRMPSTAGQMEFEVTFWRFPESSTVKEVSRKPSKWDPPSQPN

SEQ ID NO: 4368 - protein, 171 aa, Zea mays
  UNSURE (1)..(171): unsure at all Xaa locations
  Clone ID: PAT_MRT4577_121990C.1.pep
  unsure (1)..(171): unsure at all Xaa locations
GSPWFGFAGGRIEMAGSDVEYRCFDGGLNWATDDHSVHNAXTTYGXCSHSKIIXLDRETDRSRGLRFVTLXSREEAIPERHLRALNGKELDCLNITINEGQSRGGRXADEAXGGGRGCGGYRGGRRRDGGGDYCGGDGGYGGGGGYGCGGGGYRGGNRGGGYGNSDGNWRN

SEQ ID NO: 4369 - protein, 50 aa, Zea mays
  Clone ID: PAT_MRT4577_122082C.1.pep
CYNSDTPVVERGHSRLQFFLPTHGCLAVSPKSSPKSSDHKLSFSSDWSLT

SEQ ID NO: 4370 - protein, 124 aa, Zea mays
  UNSURE (1)..(124): unsure at all Xaa locations
  Clone ID: PAT_MRT4577_12220C.1.pep
  unsure (1)..(124): unsure at all Xaa locations
MAASYVEYRCFVGGLSWATYDHSLHNAFITYGEVLEFXIILDRETQRSRGFGLVTFSTEEAMPNAIDGMNGKDLDGRNITVNEAHSCXGRGGGCGGYGGGRACGGYRGGGRRDGSGSYCGGGCC

SEQ ID NO: 4371 - protein, 132 aa, Zea mays
  Clone ID: PAT_MRT4577_122249C.1.pep
MAQVRGSARGTGSGSSAAALALVLLCALLRGEFAESAVYTVGDRGGWSFNTASWPNGKRFRAGDVLVFRYDARAHNVVPVSAAGYSSCSAPEGARALATGNDRVTLRRGANYFICSFPGHCQAGMKVAVTAA

SEQ ID NO: 4372 - protein, 117 aa, Zea mays
  UNSURE (1)..(117): unsure at all Xaa locations
  Clone ID: PAT_MRT4577_122255C.1.pep
  unsure (1)..(117): unsure at all Xaa locations
MAAKILCLXMLLGLFGSAATASILPQCSQAPIAYILPSYLLPAMTSEXENPILVPYKIQHAIGASMLPLSPLFLQQSXALLQQLPLVHXLAQNIRAQHLQQLVLSYLGAYYQQQQIP

SEQ ID NO: 4373 - protein, 234 aa, Zea mays
  Clone ID: PAT_MRT4577_122271C.1.pep
MSANVGESTSGVSSSDAAGGSFECNICFELPQEPIVTLCGHLFCWPCLYRWLHIHAHSPECPVCKALVEEDKLVPLYGRGKDRVDPRSKNMPEGEIPHRPTGQRPATAPRAHANSNFANANANPWFPGAGVPLANARWGNYAFSAAFGGLFPMLSFQVHGFPDAAAYAQPAGFHYGYGHGHGHGFHHGGHMGQAQAHGVHRQAPLGQQQQQADIYLKALLFMIVILVLASLLAF

SEQ ID NO: 4374 - protein, 697 aa, Zea mays
  Clone ID: PAT_MRT4577_122410C.1.pep
MASETETFAFQAEINQLLSLIINTFYSNKEIFLRELISNSSDALDKIRFESLTDKSKLDAQPELFIHIVPDKANNTLTIIDSGIGMTKSDLVNNLGTIARSGTKEFMEALAAGADVSMIGQFGVGFYSAYLVAERVVVTTKHNDDEQYVWESQAGGSFTVTRDTSGEQLGRGTKMTLYLKDDQLEYLEERRLKDLIKKHSEFISYPISLWTEKTTEKEISDDEDEEDKKDEEGKVEDVDEKEEKEKKKKKIKEVSHEWQLVNKQKPIWMRKPEDITKEEYAAFYKSLTNDWEEHLAVKHFSVEGQLEFKAVLFVPKRAPFDLFDTRKKPNNIKLYVRRVFIMDNCEELIPEWLSFVKGIVDSEDLPLNISRETLQQNKILKVIRKNLVKKCIELFFEIAENKEDYNKFYESFSKNLKLGIHEDSTNRNKIAELLRYHSTKSGDELTSLKDYVTRMKEGQNDIYYITGESKKAVENSPFLEKLKKKGYEVLYMVDAIDEYAIGQLKEFEGKKLVSATKEGLKLDESEDEKKRKEELKEKFEGLCKVIKEVLGDKVEKVVVSDRVVDSPCCLVTGEYGWTANMERIMKAQALRDSSMSGYMSSKKTMEINPENAIMEELRKRAEADKNDKSVKDLVMLLFETALLTSGFSLDDPNTFGSRIHRMLKLGLSIDEDEAPEADTDMPPLEDDAGESKMEEVD

SEQ ID NO: 4375 - protein, 698 aa, Zea mays
  UNSURE (1)..(698): unsure at all Xaa locations
  Clone ID: PAT_MRT4577_122412C.1.pep
  unsure (1)..(698): unsure at all Xaa locations
MASETETFAFQAEINQLLSLIINTFYSNKEIFLRELISNSSDALDKIRFESLTDKSKLDAQPELFIHIVPDKANNTLTIIDSGIGMTKSDLVNNLGTIARSGTKEFMEALAAGADVSMIGQFGVGFYSAYLVAERVVVTTKHNDDEQYVWESQAGGSFTVTRDTSGEQLGXRGTKMTLYLKDDQLEYLEERRLKDLIKKHSEFISYPISLWIEKTTEKEISDDEDEEDKKDEEGKVEDVDEKEEKEKKKKKIKEVSHEWQLVNKQKPIWMRKPEEITKEEYAAFYKSLTNDWEEHLAVKHFSVEGQLEFKAVLFVPKRAPFDLFDTRKKLNNIKLYVRRVFIMDNCEELIPEWLSFVKGIVDSEDLPLNISRETLQQNKILKVIRKNLVKKCIELFFEIAENKEDYNKFYEAFSKNLKLGIHEDSTNRNKIAELLRYHSTKSGDELTSLKDYVTRMKEGQNDIYYITGESKKAVENSPFLEKLKKKGYEVLYMVDAIDEYAIGQLKEFEGKKLVSATKEGLKLDESEDEKKRKEELKEKFEGLCKVIKEVLGDKVEKVVVSDRVVDSPCCLVTGEYGWTANMERIMKAQALRDSSMSGYMSSKKTMEINPDNAIMEELRKRAEADKNDKSVKDLVMLLFETALLTSGFSLDDPNTFGGRIHRMLKLGLSIDEDEAPEADTDMPPLEDDAGESKMEEVD

SEQ ID NO: 4376 - protein, 48 aa, Zea mays
  Clone ID: PAT_MRT4577_12247C.1.pep
ATRIVSWITRLVVRIRLVPAHVRGSPEEPLDRAISSCSSMTALRKKGV

SEQ ID NO: 4377 - protein, 137 aa, Zea mays
  UNSURE (1)..(137): unsure at all Xaa locations
  Clone ID: PAT_MRT4577_122615C.1.pep
  unsure (1)..(137): unsure at all Xaa locations
MGAIISCLAMLPGLSASAVASAIFPQCXRSYRLTFLPPXLSPAVLVVWENPTFXPYMIQQAIEAGILPLSRLFLQQSSAVLQQLPLVHVLAQNIKAQQLQQLVLAYLAAYSKKQQSLPLNQLAVLNSASYLQQQQLP

SEQ ID NO: 4378 - protein, 82 aa, Zea mays
  Clone ID: PAT_MRT4577_122667C.1.pep
FVKQRKQINHRDAKGDTQSDREEDESKQEDDDDDIGTALMSRKQRGLYKAMKMGKEKKKEKVELLKKRKKNADSGASSKKRH

SEQ ID NO: 4379 - protein, 380 aa, Zea mays
  UNSURE (1)..(380): unsure at all Xaa locations
  Clone ID: PAT_MRT4577_122922C.1.pep
  unsure (1)..(380): unsure at all Xaa locations
MKVERDLHMSRGDGEDSYASNSRLQEKSILKTRPVLHKAVAAAHALSLSSGGPGGGAMVVADLGCSSGPNTLLVVSEVLAAVAMVAGGSAQPQHVQFFLNDLPGNDFNLVFRSLDLXEQEAGRQGQAGGVAXPPYYVAGLPGSFYTRLFPDHCVHLFHSSYCLMWRSKVPDELAGGAVLNEGHMYIWETTPQAVVALYRRQFQEDMSLFLRLRHRELVPGGHMVLAFLGRKKSKDVLRGEVSYTWGLLAQALQSLVKQGRVKKDKLDSFNLPFYAPSMDEVRDVITRSQAFDITHIQLFESNWDPHDDDXGDEDGXDVAAVQSGVNVARSIRAVIGPLIARHFGEHILDDLFELHAKNVAVHLQKVKTKYPVIVVSLQAK

SEQ ID NO: 4380 - protein, 51 aa, Zea mays
  Clone ID: PAT_MRT4577_122969C.1.pep
LYFPVPIEVKQFQIIEGSVTVSQSEEDPRFLGVYLECFAVGQTLVKACAIR

SEQ ID NO: 4381 - protein, 225 aa, Zea mays
  Clone ID: PAT_MRT4577_122972C.1.pep
MICILEPYFNGPNFFLCQKKKKSQPPSPLLGSTRRPSASLRPRELAEMVAHRFHQYQVVGRALPTPTDEHPKIYRMKLWATNEVRAKSKFWYFLRKLKKVKKSNGQMLAINEIFERNPTTIKNYGIWLRYQSRTGYHNMYKEYRDTTLNGAVEQMYNEMASRHRVRSPCIQIIKTATVHFKLCKRDNTKQFHNSEIKFPLVYRKVRPPTRKLRTTFKASRPNLFM

SEQ ID NO: 4382 - protein, 348 aa, Zea mays
  Clone ID: PAT_MRT4577_12310C.1.pep
MAKYGEGDKRWIVEERADGTNVHNWHWAERDCLEWSRARLSSLLAGLTILDGEGGLSLRTVALDKLDGEAYVNIRKGKVIPGYELSLTLSWEAEAASESGAAKVTGTAEVPYLADENADEDPDLRVTVRGDETPLALRAKDAFLSRGKPMVLEKIREFVAAMAKGGPAKDELDSKKTPTKVAGSAPAKEAVLAPAPAVEKKKAKGKDKEGFKTIEMTEKFYCRSKDIYEILMDENRWKGFTQSNARISREVGGEFSLFDGSITGVNEELQEGKLIAQKWRFGSWPDGLYSSVRLVFDEPESGVTIIKLKQTDVPEEDKYGNSTVVENTERGWRELIFQRIRGVFGFGI

SEQ ID NO: 4383 - protein, 353 aa, Zea mays
  Clone ID: PAT_MRT4577_12313C.1.pep
MAKYGEGDKRWIVEERADGTNVHNWHWAERDCIEWSRARLSSLLAGLTVLDGEDGLTLRTVALDNLDGEAYVNIRKGKVIPGYELSLTLSWEAEAASESGAVKVAGTAEVPYLADENADEDPDLHITVRGDETPLALRAKDAFLSRGKPMVLEKIREFVAAMAKGGPAKDELDSKKTPAKVAAAAPGAAPAKKEEVVAPAPAAGKKKAKGKDKEGFKTIKMTETFYCRSKDIYEILMDENRWKGFTQSNAKISREVGGEFSLFDGCITGVNEDLQEGKLIAQKWRFGSWPDGLYSSVRLMLDEPESGVTVIKLKQTGVPEEDKYGNSTVVENTERGWRDLIFQRIRGMFGFGI

SEQ ID NO: 4384 - protein, 663 aa, Zea mays
  Clone ID: PAT_MRT4577_123163C.1.pep
MSREAQKLDCATGGGGGVGIGVLSLDLLGQVLDRLREPRDRKACRLVSRAFERSEAAHRRALRVLRREPLPRLLRAFPALERLDLSACASLDDASLAAAVAGAGGGLAGLRSVCLARANGVGWRGLEALVAACPKLEAVDLSHCVSAGDREAAALAAAAGLRELRLDKCLAVTDMGLAKVAVGCPRLEKLSLKWCREISDIGIDLLAKKCPELRSLNISYLKVGNGSLRSISSLERLEELAMVCCSCIDDEGLELLSKGSDSLQSVDVSRCDHVTSHGLASLIDGRNFLQKLYAADCLHEIGQRFVSKLATLKETLTTLKLDGLEVSDSLLEAIGESCNKLVEIGLSKCSGVTDEGISSLVARCSDLRTIDLTCCNLSTNNALDSIAGNCKMLECLRLESCSLINEKGLKRIATCCPNLKEIDLTDCGVDDAALEHLAKCSELRVLKLGLCSSISDKGIAFISSNCGKLVELDLYRCSSITDDGLAALANGCKRIKLLNLCYCNKITDTGLGHLGSLEELTNLELRCLVRITGIGISSVAIGCKNLIELDLKRCYSVDDAGLWALARYALNLRQLTISYCQVTGLGLCHLLSSLRCLQDIKMVHLSWVSIEGFEIALRAACGRLKKLKMLCGLKTVLSPELIQMLQACGCRIRWVNKPLVYKD

SEQ ID NO: 4385 - protein, 660 aa, Zea mays
  Clone ID: PAT_MRT4577_123164C.1.pep
MSREAQKLDCTAAGGGIGVLSLDLLGQVLEHLREPRDRKTCRLVSRAFERAEAAHRRALRVLRREPLPRLLRAFPALERLDLSACASLDDASLAAAVADAGGGLAGLRSVCLARTNGVGWRGLEALVAACPKLAAVDLSHCVSAGDREAAALAAATELRELRLDKCLAVTDMGLAKVAVGCPKLEKLSLKWCREISDIGIDLLAKKCPELRSLNISYLKVGNGSLGSISSLERLEELAMVCCSCIDDEGLELLSKGSDSLQSVDVSRCDHVTSQGLASLIDGRNFLQKLYAADCLHEIGQRFLSKLARLKETLTSLKLDGLEVSDSLLQAIGESCNKLVEIGLSKCSGVTDEGISSLVARCSDLRTIDLTCCNLSTNNALDSIAGNCKMLECLRLESCSLINEKGLKRIATCCPNLKEIDLTDCGVDDAALQHLAKCSELRILKLGLCSSISDRGIAFISSNCGKLVELDLYRCNSITDDGLAALANGCKRIKLLNLCYCNKITDTGLGHLGSLEELTNLELRCLVRVTGIGISSVAIGCKNLIELDLKRCYSVDDAGLWALARYALNLRQLTISYCQVTGLGLCHLLSSLRCLQDIKMVHLSWVSIEGFEMALRAACGRLKKLKMLCGLKTVLSPELLQMLQACGCRIRWVNKPLVYKD

SEQ ID NO: 4386 - protein, 524 aa, Zea mays
  UNSURE (1)..(524): unsure at all Xaa locations
  Clone ID: PAT_MRT4577_12327C.1.pep
  unsure (1)..(524): unsure at all Xaa locations
MGAFAKEEHQFLAELGLAQRNPGAFACGAWGGSGPTVTSTSPTNNQVIAEVVEASVHDYEEGMRACFDAAKTWMAIPAPKRGEIVRQIGDALRAKLHHLGRLVSLEMGKILPEGIGEVQEIIDMCDYAVGLSRQLNGSIIPSERPNHMMMEVWNPLGVVGVITAFNFPCAVLGWNACIALVCGNCVVWKGAPTTPLITIAMTKIVASVLEKNNLPGAIFTSFCGGTEIGQAIAXDIRIPLVSFTXGSTRAGLMVHSXLGTGGGRPXEVLEVXSLGYSHDDHSEQNAIIVMDATPRKIEGLSVGCTSVFRAGXLQQRTTQRSLILHITPRLRFLDQLVEVYKQVRIGDPLEKGTLLGPLHTPASKENFLKGIQTIKSQGGKILFGGSAIESEGNFVQPTIVEITPSAPVVKEELFGPVLYAMKFQTLKEAIEINNSVPQGLSSSIFTKRPDIIFKWLGPHGSDCGIVNVNIPTNGAEIGGAFGGEKATGGGREAGSDSWKQYMRRATCTINYGSELPLAQGINFG

SEQ ID NO: 4387 - protein, 138 aa, Zea mays
  Clone ID: PAT_MRT4577_123298C.1.pep
MAEEKHHHHHLFHHKKDEEQAAAGGYGESAEYTEATVTEVVSTGENEYDEYKKEEKQHKHKQHLGEAGAIAAGAFALYEKHEAKKDPEHAHRHKIEEEVAAAAAVGSGGFAFHEHHEKKKDHKDAEEAGGEKKHHFFG

SEQ ID NO: 4388 - protein, 145 aa, Zea mays
  Clone ID: PAT_MRT4577_123299C.1.pep
MAEEKHHHHHLFHHKKDEEQLEQPVAGGGYGYGEAAEYTETTVTEVVSTGGEDEYDTYKKEEKEHKHKQHLGEAGAIAAGAFALYEKHEAKKDPEHAHRHKIEEEIAAAAAVGSGGFAFHEHHEKKKDHKEAEEAAGEKKHHFFG

SEQ ID NO: 4389 - protein, 89 aa, Zea mays
  Clone ID: PAT_MRT4577_123323C.1.pep
PQQFLQFIQLKALNFPAYLKKEQLVPFSQLGGVSRDTFLTQQQLFRFYQHVGPNDGTLLQVQQLLPFNQLVLTKPAAFYQEPIIGGALF

SEQ ID NO: 4390 - protein, 66 aa, Zea mays
  Clone ID: PAT_MRT4577_123326C.1.pep
VVLTGRPLAKATQTADHRYARTAATEAHGRRTTRISSASTSARPGSRPAHPAWRSTASSRASSTMG

SEQ ID NO: 4391 - protein, 51 aa, Zea mays
  Clone ID: PAT_MRT4577_123379C.1.pep
KELSTVRKQSRVSSTRYLVVAVTYRVCSLELLTHERDRESLTVYFQKQLYS

SEQ ID NO: 4392 - protein, 744 aa, Zea mays
  Clone ID: PAT_MRT4577_123397C.1.pep
MAGQERRTIDLEEGWAFMQKGITKLKNILEGKPEPQFSSEDYMMLYTTIYNMCTQKPPQDYSQQLYDKYRESFEEYIASMVLPSLREKHDEFMLRELVQRWSNHKVMVRWLSRFFYYLDRYFISRRSLTPLKEVGLTCFRELIYQEIKGQVKDAVIALIDKEREGEQIDRALLKNVLDIFVEIGLGQMECYENDFEDFLLKDTTEYYSVKAQSWILEDSCPDYMIKAEECLKREKERVGHYLHISSEQKLLEKVQNELLAQYATPLLEKEHSGCSALLRDDKVEDLSRMYRLFSKISRGLEPISNMFKTHVTSEGTALVKQAEDSASNKKPEKKDMVGMQEQVFVWKIIELHDKYVAYVTECFQGHTLFHKALKEAFEVFCNKGVSGSSSAELLATFCDNILKKGCSEKLSDEAIEDALEKVVRLLAYISDKDLFAEFYRKKLARRLLFDKSANDEHERSILTKLKQQCGGQFTSKMEGMVTDLTVARDHQTKFEEFVAGHPELNPGIDLAVTVLTTGFWPSYKTFDINLPAEMVKCVEVFKEFYQTRTKHRKLTWIYSLGTCNINAKFDAKPIELIVTTYQAALLLLFNGSDRLSYSEIVTQLNLSDDDVVRLLHSLSCAKYKILNKEPANRSISPNDVFEFNSKFTDRMRRIKIPLPPVDEKKKVVEDVDKDRRYAIDASIVRIMKSRKVMGHQQLVAECVEQLSRMFKPDFKAIKKRIEDLITRDYLERDKDNANTYKYLA

SEQ ID NO: 4393 - protein, 82 aa, Zea mays
  UNSURE (1)..(82): unsure at all Xaa locations
  Clone ID: PAT_MRT4577_123473C.1.pep
  unsure (1)..(82): unsure at all Xaa locations
GSPGFGFVGGLIEMAASDVEYRWFVVELGWDTDEQSLHDALSSYGEVLDSKMILDRXMQRSRCFGFVSFSTDEAMRXAIDGM

SEQ ID NO: 4394 - protein, 53 aa, Zea mays
  Clone ID: PAT_MRT4577_123484C.1.pep
LVSVSVADEKHHHHHLFQHKKDEEQLAARGYRESAEYTEATVTEVVSTGQNHF

SEQ ID NO: 4395 - protein, 93 aa, Zea mays
  Clone ID: PAT_MRT4577_123502C.1.pep
MVSGGLAAASEVAVVFLIRPVLAIAFVFTLILLSWYVAWRTVLVHVPLVQEIAGLRPKKPSKPKPANRGRFAKFYQNQAEAAQRNSKSEGASS

SEQ ID NO: 4396 - protein, 72 aa, Zea mays
  UNSURE (1)..(72): unsure at all Xaa locations
  Clone ID: PAT_MRT4577_123508C.1.pep
  unsure (1)..(72): unsure at all Xaa locations
MAAADVEYRCLVGGLAWATMNESVENAFASYGEILDYKVITDRKTGRSHGFGFVTLYYXNLMLDAIQNMNGK

SEQ ID NO: 4397 - protein, 545 aa, Zea mays
  Clone ID: PAT_MRT4577_12375C.1.pep
MPIKFALENMSTQASNRSYRYPDRTQLPYHNGNPMHVGGNGNYCVQQNHDDVNYISSDDGSQSSSSRVQDFQAQFCTLDSSSANCVYPAHSSTSSQSISGSPLSQQESHSDHAYGSSPSASCITQVPTWTLKDLENVMLGPDSDIGSPDSSFLLDTALHGNNWRELLGIQTGDLRQVIVACGKAVDENAVYMDALMSELREMVSVSGEPMQRLGAYMLEGLIARLSFTGHALYKSLKCKEPVATSSELLSYMHLLYEICPFFKFGYMSANGAIAEAVKGEDIIHIIDFQIAQGSQWMTMIQALASRPGRRPYLRITGIDDSNSAHARGGGLDMVGQRLHRMAQSCGLPFEFNAVPAASHEVVFEDLCLRSGEAIVVNFAYQLHHTPDESVGIENHRDRILRMVKSLSPKVVTLVEQEANTNTAPFFLRYMETLDYYTAMFEAIDVACPRDDKKRISTEQHCVARDIVNLIACEGAERIERHEPFGKWRARLVMAGFRPYPLSPVVNRTIKTLLDSYHSHYRLEERDGILYLGWKNRKLVVSSAWC

SEQ ID NO: 4398 - protein, 44 aa, Zea mays
  Clone ID: PAT_MRT4577_123928C.1.pep
VENDDLIAYGLIPEFIGRLPITVGLTNLSEEQLVQVVNFFDFII

SEQ ID NO: 4399 - protein, 235 aa, Zea mays
  UNSURE (1)..(235): unsure at all Xaa locations
  Clone ID: PAT_MRT4577_124010C.1.pep
  unsure (1)..(235): unsure at all Xaa locations
MAKDEVMETGGGGDFAAKDYTDPPPAPLIDAAELASWSLYRAVIAEFIATLLFLYITVATVIGYKHQTDPAVNTAADAACGGVGVLGIAWAFGGMIFVLVYCTAGISGGHINPAVTFGLFLARKVSLVRALLYMVAQCLGAMCGVGLVKAFXRAPTSSGXTAAAPTRSPPATPRAPASPRRSXGTFVLVYTVFSATDPKRSARDSHVPGLAPLPIGFAVFMGHLXTIPITGTGIN

SEQ ID NO: 4400 - protein, 285 aa, Zea mays
  Clone ID: PAT_MRT4577_124012C.1.pep
MAKDIEAAAAHEGKDYSDPPPAPLVDAEELTKWSLYRAVIAEFVATLLFLYITVATVIGYKHQTDAAASGPDAACGGVGVLGIAWAFGGMIFILVYCTAGVSGGHINPAVTFGLFLARKVSLVRALLYIVAQCLGAICGVGLVKGFQSAFYVRYGGGANELSAGYSKGTGLAAEIIGTFVLVYTVFSATDPKRNARDSHVPVLAPLPIGFAVFMVHLATIPITGTGINPARSLGAAVIYNNDKAWDDHWIFWVGPFIGAAIAAAYHQYVLRASAAKLGSSASFSR

SEQ ID NO: 4401 - protein, 290 aa, Zea mays
  Clone ID: PAT_MRT4577_124015C.1.pep
MGKDDVVESGAGGGEFAAKDYTDPPPAPLVDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVVYNKDKPWDDHWIFWVGPLLGAAIAAFYHQYILRAGAIKALGSFRSNA

SEQ ID NO: 4402 - protein, 547 aa, Zea mays
  Clone ID: PAT_MRT4577_124085C.1.pep
TITTVIKKMMRCAATGGGCVASWSGDRRLPAVNPCSVRMPTGNDGWCAGLRSRAADLAGLEMANLRGGVGGLFRASPRYGRLQATAAVDPEDIPLEKVQVKSSGHVLPYVGVACLGAILFGYHLGVVNGALEYLAKDLGIAENAVLQGWVVSTSLAGATLGSFTGGSLADKFGRTRTFILDAVPLALGAFLSATAQDIRTMIIGRLLAGIGIGVSSALVPLYISEISPTEIRGTLGTVNQLFICIGILAALLAGLPLAGNPAWWRTMFGIAVVPSILLAVGMAFSPESPRWLFQQGKVTQAELAVKRLYGKEMVTEIMFDLRASGQSSSESEAGWFDLFSKRYWKVVSVGAALFLFQQLAGINAVVYYSTSVFRSAGIASDVAASALVGAANVFGTMVASSLMDKQGRKSLLITSFSGMGASMLLLALSFTWKALAPYSGTLAVVGTVLYVLSFALGAGPVPALLLPEIFASRIRAKAVALSLGMHWVSNFFIGLYFLSVVSKFGISNVYLGFASVCALAVLYIAGNVVETKGRSLEEIERELSVAE

SEQ ID NO: 4403 - protein, 64 aa, Zea mays
  Clone ID: PAT_MRT4577_124209C.1.pep
LSLVGTRNGSFWSPVSMITPSLGKPKRCQRTSLMHLTWLMGPRSSLKPGRAPRYLIPFGRAPSC

SEQ ID NO: 4404 - protein, 103 aa, Zea mays; identical to SEQ ID NO: 3995
  Clone ID: PAT_MRT4577_124368C.1.pep

SEQ ID NO: 4405 - protein, 103 aa, Zea mays; identical to SEQ ID NO: 3995
  Clone ID: PAT_MRT4577_124370C.1.pep

SEQ ID NO: 4406 - protein, 103 aa, Zea mays
  Clone ID: PAT_MRT4577_1243C.1.pep
TLRYVSTTRIRMKGAKFKGAAKADAKLAVKSKGAVNPAKARMGKAGMDPNKPKRAPSACFVIMEELRKESKEKNPMNKTVAAAGKAAGDRWQSLGEWDMAPYV

SEQ ID NO: 4407 - protein, 54 aa, Zea mays
  Clone ID: PAT_MRT4577_124450C.1.pep
RRRRECFMSNTGFGGRFAFELFILNRHNFVVVVWLLCEPAKPGYCYENLSSVRM

SEQ ID NO: 4408 - protein, 122 aa, Zea mays
  UNSURE (1)..(122): unsure at all Xaa locations
  Clone ID: PAT_MRT4577_12447C.1.pep
  unsure (1)..(122): unsure at all Xaa locations
RLVRSGLSYHYGSGSDSGGSSSFGFVGERIEMAXASDVEYRCYICGLSWATDDHCVHNAFSTYGEVLEYKIILDRXTQTSSSFGFVTFFTDEAMRNAIAGMNGKDLDGRTITANDAQSRCGL

SEQ ID NO: 4409 - protein, 446 aa, Zea mays
  Clone ID: PAT_MRT4577_12449C.1.pep
MGAGAQEDEEEITTVAEGGVGEEEQAAAEGAGEEEQLEQGAGGEGEGGEEKAPAVMLCSICLDTVVAGGEERSTARLQCGHEFHLDCIGSAFNAKGIMQCPNCRTIEMGNWLYANGSRSSQDVNNDEWGYDDLYDHGHSELATFVPLRIQWCPMGRLELQSLFDDGESPPPSTFHDFTGQFNSEPMVPVPATPHPGPYLAYFQPALPPVSSSSLVAERTMDGAAYHDHWNTLAGLSDGRRPWAYYPQPNSDNGIAEQQGLPLGAMAVGGVDSESQQRGSLSLFYGNGSGRPRIPGVPPMAPQFTRAHGNINDQFQQTASLFAGSQQSGGMRPLGAVGPSVPPPPENTSFCLFPPASSVPSTMEAEDVNRANQFYAWERDRLAPYPLMPVNSEGTWWSSSQQQPPPEPAASASRRLSGQWIGRLPLPPPENRSPDGSSFRPLHIPRM

SEQ ID NO: 4410 - protein, 151 aa, Zea mays
  Clone ID: PAT_MRT4577_124572C.1.pep
VPFSPEEAIGNALQGINGKELDGPNIPVKEAQSPPAPENGGGGGYGGGRGGGGYGGGGPRDGGGGFGGGGGYGGGGGGSGGGGGGFGGGNRGGGFGNSDGNWRKLTVGPARPSYPVCYRVVSPSPKGLFSFVPGLVLPLCVFDLRSLCVSC

SEQ ID NO: 4411 - protein, 181 aa, Zea mays
  Clone ID: PAT_MRT4577_124601C.1.pep
MANDSLTRGHIIGDVLDPFTSSVSLSVLYDGRPVFDGMEFRASAVSVKPRVEIEGDDFRVAYTLVMVDPDAPNPSNPSLREYLHWMVTDIPASTDDSFGRELIPYESPSPTMGIHRLVLVLYQQLGRGTVFAPQVRQNFNLRNFARRFNLGKPVAATYFNCQRQTGTGWEKVHLSNGPTYP

SEQ ID NO: 4412 - protein, 123 aa, Zea mays
  Clone ID: PAT_MRT4577_124603C.1.pep
VMVDPDAPNPSNPSLREYLHWMVTDIPASTDDSFGRELIPYESPSPTMGIHRLVLVLYQQLGRGTVFAPQVRQNFNLRNFARRFNLGKPVAATYFNCQRQTGTGGRRFTCVFDHVVQGEGRQA

SEQ ID NO: 4413 - protein, 64 aa, Zea mays
  UNSURE (1)..(64): unsure at all Xaa locations
  Clone ID: PAT_MRT4577_124769C.1.pep
  unsure (1)..(64): unsure at all Xaa locations
MAVAQESLSVVGTMRGHNGEVTAIATPIDNXPFIVSSSRDKCLLVWDLTNPVHYTPEFGATVYY

SEQ ID NO: 4414 - protein, 430 aa, Zea mays
  Clone ID: PAT_MRT4577_124783C.1.pep
MRSTMKAQHANGRGSRSPFLTSYALTLAFITFVSVLYFKDFSSTLHRPFLHRPRRHAAPDKSQAGRRAAAERLPFAVGAAPAGCDVGRGEWVYDDAARPWYQEEECPYIQPQLTCQAHGRPDRAYQHWRWQPRGCSLPSFNATLMLEMLRGKRMLFVGDSLNRGQYVSLVCLLHRIIPESSKSMETVDSLTVFKAKDYNATIEFYWAPFLAESNSDDAVVHRIADRIVRGTSIEKHAKFWKGADILVFNTYLWWMTGQKMKILRNSFEDKSKDIIEMETEEAYEMVLNAVLKWVESNMNPRTSRTFFVTMSPTHTRSRDWGDDTDGNCYNQTAPIEDLSYWGPDTSKGLMRVIGEVFSASKSRIPVGVVNITQLSEYRKDAHTQIYKKQWNPLTPEQVADPKSYADCTHWCLPGLQDTWNELLYSKLFFP

SEQ ID NO: 4415 - protein, 526 aa, Zea mays
  Clone ID: PAT_MRT4577_124848C.1.pep
MICAISGEVPDEPVVSKKSGLLFERRLIERYIEDHGKCPITKDELTMDDIVPVNTNKVVKPRPLQAASIPGLLGIFQNEWDALMLSNFALEQQLHTARQELSHALYQHDAACRVIARLKKERDEARALLAQAERQIPASVAGAAPAAVVSNGKRAMEDEIGPDGKKIRPGINPVMIDELTECNTMLSAQRKKRQVPPTLAPLDALERYTQISSHPLHKTNKPGILSMDVHPSKDVVATGGIDTNAVIFDRSSGQILCTLTGHSKKITTLKFVPRDQLFVTGSADKTVRIWQENENGNYNCVHTLKDHTAEVEAVTVHATQKYFVSASKDNSWCFYDISTGSCLTQVGEASGQEGYTSASFHPDGLILGTGTTDAVVKIWDVKTQSNVAKFEGHVGPVTAMSFSENGYFLATAAHDGVKLWDLRKLRNFRTFSPYDSDTPTNTVEFDFSGNYLAIGGSDIRVYQVANVKAEWNLIKTLPDLSGTGKVTSVKFGADAKYIAVGSMDRNLRIFGLPGDDQMEESTTAAE

SEQ ID NO: 4416 - protein, 588 aa, Zea mays
  Clone ID: PAT_MRT4577_124849C.1.pep
MRGVKFLLSKNPSGKTFAPSRRRLLPSRRRRCHPHLPRGSPPGRLLAVPRSLPRPTLALPSSMICAISGEVPDEPVVSKKSGLLFERRLIERYIEDHGKCPVTKEDLTMDDIVPVKTNKIVKPRPLQAASIPGLLGIFQNEWDALMLSNFALEQQLHTARQELSHALYQHDAACRVIARLKKERDDARALLAQAERQIPASVAGAAPAAVVSNGKRAIEDEIGPDGKKIRPGINPVMIDELTECNAMLSAQRKKRQVPPTLAPIDALERYTQISSHPLHKTNKPGILSMDIHPSKDIVATGGIDTNAVIFDRSSGQILCTLTGHSKKITTLKFVPRDQLFVTGSADKTVRIWQENENGNYNCVHTLKDHTAEVEAVTVHATQKYFVSASKDNSWCFYDISTGSCLTQVGEASGQEGYTSASFHPDGLILGTGTTDAVVKIWDVKAQSNVAKFEGHVGPVTAMSFSENGYFLATAAHDGVKLWDLRKLRNFRTFSPYDSDTPTNTVEFDFSGNYLAIGGSDIRVYQVANVKAEWNLIKTLPDLSGTGKVTSVKFGVDAKYIAIGSMDRNLRIFGLPGDDQMEESNTAAE

SEQ ID NO: 4417 - protein, 250 aa, Zea mays
  Clone ID: PAT_MRT4577_124955C.1.pep
LRRKSSGFSRGASIYRGVTRHHQHGRWQARIGRVSGNKDLYLGTFSTQEEAAEAYDVAAIKFRGLSAVTNFDITRYDVDKIMESSTLLPGEQVRRRKEGADAAVSEAAAALVQAGNCMTDTWKIQAALPAAARADERGAGQQQRQDLLSSEAFSLLHDIVSVDAAAGTGTGTGGMSNASSSLAPSVSNSREQSPDRGGASLAMLFAKPVAAPKLACPLPLGSWVSPSAVSARPPGVSIAHLPVFAAWTDA

SEQ ID NO: 4418 - protein, 310 aa, Zea mays
  Clone ID: PAT_MRT4577_124970C.1.pep
MSCEGLLSLSSLKPSSARRHHTKIYVRINRSKSSPAPAAPKSGNPLLRMDSGYNPRTVEEVFRDFKGRRAGIIRALTTDAEDFFKQCDPEKENLCLYGFPNESWEVNLPAEEVPPDLPEPALGINFARDGMQEKEWLSMVAAHSDAWLLSVAFYFGARFGFNKNDRKRLYSLIDDLPMAFEIVSGKSETKAPAPPSSSNHSNIKPKSNNKKKPPEPKVKQPKPRAPAEEGEEEDGSASEGEHGETLCGACKESYGPDEFWICCDLCEKWFHGKCVKITAAKAEHIKQYKCPSCTGGGGVGNSGTKRARPS

SEQ ID NO: 4419 - protein, 179 aa, Zea mays
  UNSURE (1)..(179): unsure at all Xaa locations
  Clone ID: PAT_MRT4577_124977C.1.pep
  unsure (1)..(179): unsure at all Xaa locations
AILFAHCTSHTIGYTTRAQSSQVSQRRLLANGAAPRQPLXRSAASAPXVELDDDGHAARTGNLWTCFAHIITAVIGCGVLALSWSVAQLGWVGGPVAMLCFAFVTYLSAFLLSHCYRSPASDDGSLKRQRNYTYMDAVRTHLXYLNMYGTAIAYTITTATCLRAIVRANCYHSQGHSAP

SEQ ID NO: 4420 - protein, 539 aa, Zea mays
  UNSURE (1)..(539): unsure at all Xaa locations
  Clone ID: PAT_MRT4577_124979C.1.pep
  unsure (1)..(539): unsure at all Xaa locations
AILFAHCTSHTIGYTTRAQSSQVSQRRLLANGAAPRQPLXRSAASAPXVELDDDGHAARTGNLWTCFAHIITAVIGCGVLALSWSVAQLGWVGGPVAMLCFAFVTYLSAFLLSHCYRSPGSDDGSLKRQRNYTYMDAVRTHLGXLLLHPCSCSYPTYRXRISLWWRLHLRELARATRAGEKRTWLCGLFQYLNMYGTAIAYTITTATCLRAIVRANCYHSQGHSAPCGAGGDHLYMLLFGAAQAVLSLIPNFHSMAWLSAVAAVMSFTYATIGLGLGLAKTIENGAIKGSVAGVPMSTAPQKVWRVAQAIGDIAFAYPYTIVLLEIQDTLKSPPPESETMQKGNVLAVLATTFFYLAVGCFGYAAFGNAAPGNLLTGFGFYEPYWLIDFANACIVLHLLGGYQMFSQQIFTFADRSLAARFPNSAFVNKSYAVKVPGAPASWSYSLNLQRLCFRTAYVASTTGLALLFPYFNEVLGVLGAVVFWPLAIYLPVEMYCVQRGVLPWTRTWVALQAFSVVCFVVGTFAFVGSVEGVIRKRLG

SEQ ID NO: 4421 - protein, 511 aa, Zea mays
  UNSURE (1)..(511): unsure at all Xaa locations
  Clone ID: PAT_MRT4577_124982C.1.pep
  unsure (1)..(511): unsure at all Xaa locations
AILFAHCTSHTIGYTTRAQSSQVSQRRLLANGAAPRQPLXRSAASAPXVELDDDGHAARTGNLWTCFAHIITAVIGCGVLALSWSVAQLGWVGGPVAMLCFAFVTYLSAFLLSHCYRSPASDDGSLKRQRNYTYMDAVRTHLARATRPGEKRTWLCGLFQYLNMYGTAIAYTITTATCLRAIVRANCYHSQGHSAPCGAGGDHLYMLLFGAAXQAVLSLIPNFHSMAWXLSVVAAVMSFTYATIGLGLGLAKTIENGAIKGSVAGVPMSTAPQKVWRVAQAIGDIAFAYPYTIVLLEIQDTLKSPPPESETMQKGNVLAVLATTFFYLAVGCFGYAAFGNAAPGNLLTGFGFYEPYWLIDFANACIVLHLLGGYQMFSQQIFTFADRSLAARFPNSAFVNKSYAVKVPGAPASWSYSLNLQRLCFRTAYVASTTGLALLFPYFNEVLGVLGAVVFWPLAIYLPVEMYCVQRGVLPWTRTWVALQAFSVVCFVVGTFAFVGSVEGVIRKRLG

SEQ ID NO: 4422 - protein, 122 aa, Zea mays
  UNSURE (1)..(122): unsure at all Xaa locations
  Clone ID: PAT_MRT4577_125022C.1.pep
  unsure (1)..(122): unsure at all Xaa locations
GFSCPYGSGSGSRGSTLFGSGVERIEMAASDVEYRCFAGGLTWATDDHFVHNALSTYGEVLXSNIILDRETHRSERSCFITFSTDEARHNAINGMNSTELDGRNITVNDAHARGVRGGGCGG

SEQ ID NO: 4423 - protein, 95 aa, Zea mays
  UNSURE (1)..(95): unsure at all Xaa locations
  Clone ID: PAT_MRT4577_12507C.1.pep
  unsure (1)..(95): unsure at all Xaa locations
GSPGFGFVGERIEMAASDVEYRCFHGGLHXTTDDHSLHNAFSTYGEVLEFKIILDRETQKLHGYCFTTFSTEDAMQNAIKGMNSEELDRRNITVN

SEQ ID NO: 4424 - protein, 152 aa, Zea mays
  Clone ID: PAT_MRT4577_125103C.1.pep
MEYSNLQQQAASLKKNLFDQGYLDEQFCQIEDLQDEASPNFTEEVVSLFFKNSTRLMTNIEQAMDRNPRDFSKWDVNMQQLKGTCSSIGACRMKNECTSFRNRCGDENVEGCMRSFQNLKREHGVLRQKLESYFQLLRQAGPAVTATRPRGM

SEQ ID NO: 4425 - protein, 204 aa, Zea mays
  Clone ID: PAT_MRT4577_125324C.1.pep
MSFTGTQDKCKACDKTVHIIDLLTADGVSYHKTCFKCSHCKGVLSISSYSSMDGVLYCKTHFEQLFKETGTFSKNFQGGASSNKNDQAKAPSKLSSAFSGTQDKCAACQKTVYPLEKMTLEGESYHKSCFKCSHGGCILTTSSYAALNGVLYCKIHFSQLFKEKGSYNHLIETAQTKKNEAAEAGPEPPADAGAGEPEAPAQSA

SEQ ID NO: 4426 - protein, 207 aa, Zea mays
  Clone ID: PAT_MRT4577_125327C.1.pep
MSFTGTQDKCKACDKTVHFIDLLTADGVSYHKTCFKCSHCKGVLSISSYSSMDGVLYCKTHFEQLFKETGNFSKKFQGGGGASSNKNDPAKAPSKLSSAFSGTQDKCAACQKTVYPLEKMTLEGESYHKGCFKCSHGGCILTTSSYAALNGILYCKIHFSQLFKEKGSYNHLIETAQTKKNEGAEAAEEPSVDAGAAAEAEAPAESA

SEQ ID NO: 4427 - protein, 79 aa, Zea mays
  Clone ID: PAT_MRT4577_125341C.1.pep
TVTTTTTVVVPASTTVTSVTSNPAALSGSEQTDRSGPNDRVILFATVMFTRVHRLYLRSCRVCCCPFVFLTARSHCGSC

SEQ ID NO: 4428 - protein, 160 aa, Zea mays
  UNSURE (1)..(160): unsure at all Xaa locations
  Clone ID: PAT_MRT4577_125744C.1.pep
  unsure (1)..(160): unsure at all Xaa locations
MSRHPEEKWAQMIDRVYITEQXLMPXDAKAYLDTHYGDYTFSGRAGTNLYELKLDVNDEVNDEASDNNCGXGTLLWIEQKAEAKWRNKLGPHDQRAPHFEKVDWDXWDDEDDDGVDDYLDGMDFSNFDAMGGMRGMVDMAGLXGLAGMSVMGMDDSEDDS

SEQ ID NO: 4429 - protein, 286 aa, Zea mays
  Clone ID: PAT_MRT4577_125748C.1.pep
MGAPKQRWTSEEEAALRAGVARHGVGNWRMILNDPELSSTLRYRSNVDLKDKWRNMNVIVTSSSTRDRGRTSTRRTRAAPKNNDQLLAMSTITSEVDDEIVDVKPIVSMSVEGWNTSNSKKSHSRLDNIIMEAIKNLNEPTGSHRTTIANYIEEQYWPPSDFDHLLSAKLKYLATSGKLLKVNRKYRIAPSLLEDVQREPLKLGSDASRTLTRSQVDAELVRMATMTVEAAAAAAAHAVAEAEAIMAEAEAAAREAEAAEAEARAAQAFAEAAVLTLKNRNAAKLV

SEQ ID NO: 4430 - protein, 872 aa, Zea mays
  UNSURE (1)..(872): unsure at all Xaa locations
  Clone ID: PAT_MRT4577_125772C.1.pep
  unsure (1)..(872): unsure at all Xaa locations
LRIASLLTHGQVKQLRPWACLLLRHCRCGRRRDAVHGRRRQWLERAHRRRRALQHLGGEDEVSDRRLPSVRVPQGPGLGAAGGAGGLQRLRHVVVREEVRRRRHRGHARPLRPALLHQRRRGQLPRQREAHRHGPRRPQQRQRHRRRRAGSEHGAAAGVTGGIAPSRQLDPAPAVVARSQGRVAAPGLCSHNVTGYDAAPCSERVVACSGGERDADEETRNQMMQNLFGDQSEDEDDADDDDGQQQQLQSPPHHHHEIEDDADEDGDDARSDAPARHGGYHSEEVDGEAENGGEGEGESEGQVEMEEESEGEAHRADLDQGESDGDKVHSSPERELHDQRMESDAKGXLDSEDEGYQQRTVSGRRRGVIASESEGSEDSYYAAGAQEDEEPRQTRKQSSPLEEERDHEVVRDVFGDSDEDEPAPYRVRHEIDEDSHRSHMEDEGHYEKDMQPDEVVADEDMRYESDDNRELKPKEKPVGPPLGSAAPFGRPPARPRRGLVCVGPDILGVDPKPFDPKTYVEEDVFVTDESGTKKRIRLEDNIVRWRTIRNADGTTSCESNARFVKWKDGTMQLLIGNEVLDISVHEAHHDQSHLFLRHGKGILQSQGRLLHKMRFMPSSLSSKSHRLLTALVDSQNKKTVKMQKWFETKDPEKAKMEKERVLGQNIRAHSILQRKREKVNRKYTQPARPRRQLSPGFLEDALDEDDEPGYDSRRMPGRRRFEDELEAEALAERRIINAKKSNMSRNVPHKPPYPPARPPRRQADEYSGSEREESEYETDGEDIEHSPPRGRREDELDEEEEYEEDVEEEEAPLSDEEMEAPKRKRESGGGGQRREELVSEEEDEDHDDSPPRKQPAVSHRRKAVVFDDSDED

SEQ ID NO: 4431 - protein, 106 aa, Zea mays
  Clone ID: PAT_MRT4577_125823C.1.pep
FPCQLNTVLACVRILLVNNSVYMLLLFYSSCHYYIIFGSSCLITVKGRTQCRRLPALCGVWRRVSLSAKPYPHNMQRLGLKPGTFRLQTVDSTTAPGPPFILFNNS

SEQ ID NO: 4432 - protein, 159 aa, Zea mays
  UNSURE (1)..(159): unsure at all Xaa locations
  Clone ID: PAT_MRT4577_125903C.1.pep
  unsure (1)..(159): unsure at all Xaa locations
MAAKXFCFLMLLGLSASVATATIFPQCSQAPIASFFSPYLSPAVSSVCETPIVEPCRIQQALATGILPFSPLFLQQPSVLLQQFPLVHLVAHNIRAQQLHQLVLAYLAAYCXLLHFLSFNQLAALXSVVYLLQQLPFHPXLVAASPPLFLPFXLLAAFN

SEQ ID NO: 4433 - protein, 103 aa, Zea mays
  UNSURE (1)..(103): unsure at all Xaa locations
  Clone ID: PAT_MRT4577_126100C.1.pep
  unsure (1)..(103): unsure at all Xaa locations
MAXADVEYRCFVGGLAWATNNETLEQAFANFGQVIDSKVITDRETGRSRGSGLVTFSSEQSMINAIENMNGKELDGRNITVNQAQSRGGGGGGGGYGGGGGGY

SEQ ID NO: 4434 - protein, 79 aa, Zea mays
  Clone ID: PAT_MRT4577_126197C.1.pep
LSASAATATIFPQCSQAPISFLLSPYLSTGGSSGCENPILQPYRVQQGITAGILTLLTLVLPTLLALLHQVPLGDLLGQ

SEQ ID NO: 4435 - protein, 436 aa, Zea mays
  UNSURE (1)..(436): unsure at all Xaa locations
  Clone ID: PAT_MRT4577_126268C.1.pep
  unsure (1)..(436): unsure at all Xaa locations
MRGRGSSGARMSXGXAAEAAXGAVGCGYDLTGXLRLGRAKPGGRLVDLDGAGKWAGTSPSPRELAFPGGAAVAGVPAGVVAGKGERARFRSDVLPFAQMAEEVNRSLSLPASKIPSGAFNAMFDYRGCWHRDAAATRSLCFDARLVELYSVEAVRASLALRDHVRRDLPPVWDPAALAEFIDKYGTHVIVGVKMGGKDVVCVKQLKGSSLTQSDVQARLKELADDRFSEDSTASSNSSTAGGGRLSQGLNVGPGSAAWQSFRSPVVSHKDDMVCIHVRRGGVDSGQGHGKWLSTITGFPDVISMSFVPITSLLTGVRGSGFLNHAVNLYLRYKPPIEELQQFLEFQVPRLWAPEFGQLPLSLQRRKNILPSLQFTLMGPKLHVNTAKVDSCLRPVTGIRLFLEGKKSDQLGVHLQHLSATPSAITVLSEAASSADD

SEQ ID NO: 4436 - protein, 96 aa, Zea mays
  UNSURE (1)..(96): unsure at all Xaa locations
  Clone ID: PAT_MRT4577_126272C.1.pep
  unsure (1)..(96): unsure at all Xaa locations
TLHSVSSLEYDMKGAKYKGAVKVDAKLAVKSKGAEKPAMGRKGKAGXDPNKPKRASSAFFVFMREYRKEFKXEKNPNNKSVAWVGKADGDRLKSLN

SEQ ID NO: 4437 - protein, 73 aa, Zea mays
  UNSURE (1)..(73): unsure at all Xaa locations
  Clone ID: PAT_MRT4577_126415C.1.pep
  unsure (1)..(73): unsure at all Xaa locations
QLFNELQKYYLRRPRTGARAXKQEKRDLFPMNREGYHAGFQDFQYLLTTFTQYRRLLVIAELKHGDLFNFANI

SEQ ID NO: 4438 - protein, 561 aa, Zea mays
  Clone ID: PAT_MRT4577_126568C.1.pep
MSFVRQADPSASCAETTYIHKFVPPGPVFPAQRFVSGTDLLHHGPQPYNAEGYKQSGFNGTAPHAFQSFYNTDSYAESHFNEAPYSPAIFDISQQNSQSLSDNQASDLVEFDEDEMRVKLQELEHALLDDGDEIFFDLSGSINDEWNDNIKTNNEWVNTMKNIVSPDSPKEASPESSICCLDNNVGEARNPKQLLFDCAEAISENSIDEAQSIIAELRQKVAIQGEPSQRLAAYLVEGLAATLQSSGKGIYRALRCKEAPTLYQLSAMQILFEICPCFRLGFMAANYAILEACKGEDVVHIIDFDINQGSQYITLIQFLKNNSNKPRLLRITGVDDPESVHRAVGGLNVVGQRLEKLAEDCEVRFEFRAVAANIEDLTAGMLGRRPGEALIVNFAFLLHHLPDESVSIMNQRDRLLRMVKGLRPKLVTLVEQDANTNTTPFPSRFREVYDYYSALFDSLDATLPRESPDRMNVERQCLAREIVNILACEGPDRVERYEVAGKWRARMAMAGFVSSPFNSGAIDGIRSLLKSYCDKYRFEKVQDGLHFGWGDKTLVFSSAWQ

SEQ ID NO: 4439 - protein, 28 aa, Zea mays
  Clone ID: PAT_MRT4577_126700C.1.pep
AHLCGISKKWFNGPINGVSHCFIPTSMC

SEQ ID NO: 4440 - protein, 132 aa, Zea mays
  UNSURE (1)..(132): unsure at all Xaa locations
  Clone ID: PAT_MRT4577_126775C.1.pep
  unsure (1)..(132): unsure at all Xaa locations
MAGEIFSLLMLPGLSASAATETIFPKCSHASIASLFPPYLXPAESLCCENPILQPYRIQQAITAGILPLSPLFLQQLXSLLHQVPLLHLLAQNIRAQXLHQLVLANLTSYSHXHVFLPFNQLAELNFCFYLQ

SEQ ID NO: 4441 - protein, 609 aa, Zea mays
  UNSURE (1)..(609): unsure at all Xaa locations
  Clone ID: PAT_MRT4577_12685C.1.pep
  unsure (1)..(609): unsure at all Xaa locations
MRLWEEEDDDEDEEGMEVDGEAEDEPGWPCGAPEAGPGETRPAAILVADAAEVDFPVIYVNAAFEAATGYRAHEVLGRNCRFLQFRDPHAQRRHPLVDPMVVSEIRRCLSEGIEFQGELLNFRKDGAPLHNRLRLVPMHGDDGYVTHVIGIQLFSEANIDLSSVSYPVYKQKXQQQAQHSRSELISPRARXKIQSADHCGMLQLSDEVLAHNILSRLSPRDVASIGSVCTRMHELTKNDHLRKMVCQNAWGRDVTVRLEMSTKMVGWGRLARELTTLEAASWRKFTVGGRVEPSRCNFSACAVGNRLVLFGGEGVNMQPMDDTFVLNLEAATPEWRRVKVSASPPGRWGHTLSWLNGSWLVVFGGCGQQGLLNDVFVLDLDAQQPTWREVASEGPPLPRSWHSSCTLDGSKLVVSGGCAESGVLLSDTFLLDLTKEKPAWREIPTSWSPPSRLGHTTSVYGATKLFMFGGLAKSGSLRLRSSDAYTVDVSEDSPQWRQLATTTGFPNVSPPPRLDHVAVSLPCGRIIIFGGSIAGLHSPAQLFLIDPAEEKPIWRILNVPGQPPKFAWGHSTCVVGGTRVLVLGGHTGEEWILNELHELCLASRPDEDG

SEQ ID NO: 4442 - protein, 117 aa, Zea mays
  UNSURE (1)..(117): unsure at all Xaa locations
  Clone ID: PAT_MRT4577_126890C.1.pep
  unsure (1)..(117): unsure at all Xaa locations
REIGREEVFGPVLWXKEXSPEEEAXXLANDTQYGLXGAVISGDRERCQRLSEEIDAGIIWVNCSQPCFCQAPWGGNKRSGFGRELGEGGIDNYLSVKQVTEYISDEPWGWYRSPSKL

SEQ ID NO: 4443 - protein, 143 aa, Zea mays
  UNSURE (1)..(143): unsure at all Xaa locations
  Clone ID: PAT_MRT4577_126925C.1.pep
  unsure (1)..(143): unsure at all Xaa locations
IHYSWGESKHHHHHLFHHKKDEEQLAPRRYXKSAEYTAATVTEGVPTADNXYNEYKKEEKEHKHKQHLGEAGAIAAGAFALYXEKHEANKDLEHAHRHKIHDEVSAAAARCSGGFAFHEHHXKKKDHKEAEEAXGEKKHHFFG

SEQ ID NO: 4444 - protein, 311 aa, Zea mays
  Clone ID: PAT_MRT4577_126939C.1.pep
MNHDSAPRPSKPRTRSAARAEAEAEAAMKRRKAGDAARWPMDTRQPDAEAAVAPYVGDIDRYLRSLEVEPLRRPSHSYFQDIQKNICPKMRAILVDWLVEVAEEFKLHAETLHLAVSYVDRFLTMNVVARNKLQLLGVTTLLVAAKYEEIESSKMKVVKMETDLLKSLSFQIGGPTVTTFLRQFIASCRGGNSASRGKLEFVCSYLAELSLLDYDCISYLPSVVAAACLFVARFIIHPKTRPWNLSLEQSTGYRVFDLQKSIYVIHELQLTIRCPNQVAIREKYKDPKFGCVSTMVSPREIPTSFLEGCHK

SEQ ID NO: 4445 - protein, 83 aa, Zea mays
  UNSURE (1)..(83): unsure at all Xaa locations
  Clone ID: PAT_MRT4577_126959C.1.pep
  unsure (1)..(83): unsure at all Xaa locations
MADVHXPLVRXTRKKDLEDYLVKFRWILTIFGVLTISTLIYFNIVLGDMWSVMNSEKKRSNQHDKNVHKVGNRLKQMNPKNDG

SEQ ID NO: 4446 - protein, 270 aa, Zea mays
  UNSURE (1)..(270): unsure at all Xaa locations
  Clone ID: PAT_MRT4577_127009C.1.pep
  unsure (1)..(270): unsure at all Xaa locations
SILGALVLILREKRFSSQKLGSFMELAFGGRYVILLMAIFXIYCGLIYNEFFSVPFHIFGKSAYECRDKSCSDAHTFGLIKVREPYPFGVDPSWRGSRSELPFLNSLKMKMSILMGVAQMNLGIVLSYFDARYHGNALDIRYQFIPQMIFLNSLFGYLALLILIKWCTGSQADLYHVMIYMFLDPAGDLGENQLFWGQKELQILLLLLAXIAVPMLFPKPFIXEKLHRRDSGHTYRSRTSEMDPDSDLIRRARMMISIQRVLCINDTSIE

SEQ ID NO: 4447 - protein, 61 aa, Zea mays
  UNSURE (1)..(61): unsure at all Xaa locations
  Clone ID: PAT_MRT4577_127074C.1.pep
  unsure (1)..(61): unsure at all Xaa locations
GSPGFGCVGERIEMTASRVEYRCFVGSLSCTTDDHSLHNAFSTYGEVXLESKNNTLSGDAY

SEQ ID NO: 4448 - protein, 103 aa, Zea mays
  UNSURE (1)..(103): unsure at all Xaa locations
  Clone ID: PAT_MRT4577_127114C.1.pep
  unsure (1)..(103): unsure at all Xaa locations
MGLSEEKTWSGREYKVKDLSKADLGRLEIELDEEEMPGLMVCRAEFGPYKPFDGTRISGALHMTIQTVDLIETLTALGHQVLWRSXCNMFFTQEHAGVAIARD

SEQ ID NO: 4449 - protein, 60 aa, Zea mays
  Clone ID: PAT_MRT4577_127137C.1.pep
GSAPLTTSPVCSSQLGRCLGRRRQQHQLRCQYLSGCDQLRLVGVGASGHSCSRERVASWC

SEQ ID NO: 4450 - protein, 89 aa, Zea mays
  UNSURE (1)..(89): unsure at all Xaa locations
  Clone ID: PAT_MRT4577_12720C.1.pep
  unsure (1)..(89): unsure at all Xaa locations
LPSRGRVHTNAVTGPPTATERKGAVYPPRPXPITDEGRVDKQTQRPQPPVHLIPFLALLLPCLDSLPYPQLQLLLSPIASNCTRAYYSQ

SEQ ID NO: 4451 - protein, 95 aa, Zea mays
  Clone ID: PAT_MRT4577_127230C.1.pep
MAAADVEYRCFVGGLASATNNKWLENAFTSYGEILDSKVITDRETGRSRGFGLDTFFYENSMLDAIENMNCKELHSRNITVKQAQSRGGGRCSRR

SEQ ID NO: 4452 - protein, 117 aa, Zea mays
  UNSURE (1)..(117): unsure at all Xaa locations
  Clone ID: PAT_MRT4577_127244C.1.pep
  unsure (1)..(117): unsure at all Xaa locations
GGFSFPSGSGSGSRGSAEWEFVGERIEMAAYDGEYRCFVSGLIWATDDHFLHNAFSTYGEVLESKIILDRETHRSRCFSSNNLYTDEAMQNAIEGMNGXELDSRNITVNEDQSRYGR

SEQ ID NO: 4453 - protein, 170 aa, Zea mays
  Clone ID: PAT_MRT4577_127500C.1.pep
GKISYIAPAGQYNLQDTVLELEFQGIKKKFTMLQTWPVRSPRPVASKLAADTPLLTGQRVLDALFPSVLGGTCAIPGAFGCGKTVISQALSKYSNSEAVVYVGCGERGNEMAEVLMDFPQLTMTLPDGREESVMKRTTLVANTSVLDGHPVYFDVPFIASIVISDGHACS

SEQ ID NO: 4454 - protein, 502 aa, Zea mays
  Clone ID: PAT_MRT4577_127502C.1.pep
HCVLKVVLTSWCNVTYFPPKKLGVGDVITGGDLYATVFENTLMQHHVALPPGSMGKISYIAPAGQYNLQDTVLELEFQGIKKNFTMLQTWPVRSPRPVASKLAADTPLLTGQRVLDALFPSVLGGTCAIPGAFGCGKTVISQALSKNSNSEAVVYVGCGERGNEMAEVLMDFPQLTMTLPDGREESVMKRTTLVANTSNMPVAAREASIYTGITIAEYFRDMGYNVSMMADSTSRWAEALREISGRLAEMPADSGYPAYLAARLASFYERAGKVKCLGSPDRTGSVTIVGAVSPPGGDFSDPVTSATLSIVQVFWGLDKKLAQRKHFPSVNWLISYSKYSKALESFYEKFDPDFIDIRTKAREVLQREDDLNEIVQLVGKDALAESDKITLETAKLLREDYLAQNAFTPYDKFCPFYKSVWMMRNIIHFNTLANQAVERAAGTDGQKITYGVIKHRLGDLFYRLVSQKFEDPAEGEEALVGKFKKLYDDLTTGFRNLEDEAR

SEQ ID NO: 4455 - protein, 659 aa, Zea mays
  UNSURE (1)..(659): unsure at all Xaa locations
  Clone ID: PAT_MRT4577_127503C.1.pep
  unsure (1)..(659): unsure at all Xaa locations
MALLPIASVRYPSPTRSLRDAARSDPGRRRRPLSPPAAMAYGDRXTTFEDSEKESEYGYVRKVSGPVVVADGMGGAAMYELVRVGHDNLIGEIIRLEGDSATIQVYEETAGLMVNDPVLRTRKPLSVELGPGILGNIFDGIQRPLKTIAIKSGDVYIPRGVSVPALDKDVLWEFQPTKLGVGDVITGGDLYATVFENTLMQHHVALPPGSMGKISYIAPAGQYNLQDTVLELEFQGIKKKFTMLQTWPVRSPRPVASKLAADTPLLTGQRVLDALFPSVLGGTCAIPGAFGCGKTVISQALSKYSNSEAVVYVGCGERGNEMAEVLMDFPQLTMTLPDGREESVMKRTTLVANTSNMPVAAREASIYTGITIAEYFRDMGYNVSMMADSTSRWAEALREISGRLAEMPADSGYPAYLAARLASFYERAGKVKCLGSPDRNGSVTIVGAVSPPGGDFSDPVTSATLSIVQVFWGLDKKLAQRKHFPSVNWLISYSKYSKALESFYEKFDPDFIDIRTKAREVLQREDDLNEIVQLVGKDALAESDKITLETAKLLREDYLAQNAFTPYDKFCPFYKSVWMMRNIIHFNTLANQAVERAAGTDGHKITYSVIKHRLGDLFYRLVSQKFEDPAEGEEALVGKFKKLYDDLTTGFRNLEDEAR

SEQ ID NO: 4456 - protein, 499 aa, Zea mays
  Clone ID: PAT_MRT4577_127724C.1.pep
MTATPAVIGLSARGNRLLATSFGSAELAPPDAYPSRQFAAAAPKLTVVAHRASASASSPADIGGAGHARAHAIRALRNHSAPALAPPPPADPAPELDSKFEFEFESSLEAIVLLQRSMLEKQWELPFEDDISSTEDEDEDERSTVVVARSGVSARQRRMSGRRRGAVVGRKSVTVSPELMQSRNRIYLRGTVSKDLLTHKQVVQLSRKIKDGIWLQHQRSKLKEKLGNEPSYKQLAQSLRIPAPELRARMRESFLAREMLAMSNTRLVISIAQKYDNLGVELPDLIQGGLIGLLRGIEKFDASRGFRISTYVYWWIRQGVSRALADNSRSFRLPTYLHERLVAIRGAKYALEDQGIAPTIENIAESLNISEKKVHNATEAVNKVLSLDQQAFPSLNGLPGDTLHSYIEDQNVANDPWHGFEEMYLKEEVNSLINSTLNERERDIIRLYHGIGKQCHTWEDISRQFGLSRERVRQVGLVAMEKLKHAARREHLDALLEEY

SEQ ID NO: 4457 - protein, 63 aa, Zea mays
  Clone ID: PAT_MRT4577_127949C.1.pep
YIASSSVRKKKKKKKKKKKKKKKKKKKKKKKKKKKKKKKKKKKKKKKKKKKKKKKGGFKGNKF

SEQ ID NO: 4458 - protein, 165 aa, Zea mays
  Clone ID: PAT_MRT4577_127956C.1.pep
AAARNSSDTQPPVPLSRHPAPRRRETVRRRSLVSIAALAGLVRAALVFLDLQAALPPGDDGGDRLAAPGLAERFLRAFRPALYEVLASTATTCEADGGADGDDCSVCLAGFRARAVVNRLPCGHLFHRACLETWLRYERATCPFCRAHVPLPADETPLLRYPEFE

SEQ ID NO: 4459 - protein, 157 aa, Zea mays
  UNSURE (1)..(157): unsure at all Xaa locations
  Clone ID: PAT_MRT4577_127957C.1.pep
  unsure (1)..(157): unsure at all Xaa locations
MGISSMPEPRDSLLGYLVYNTVISIAALAGLVRAALVFLDLQAALPPGDDGGDRLAASAPGTXERFLRAFRPALYEVLASTATTCEADGGGGGDDCSVCLAGFRARAVVNRLPCGHLFHRACLETWLRYERATCPLCRAHVPLPADETPLLRYPEFE

SEQ ID NO: 4460 - protein, 197 aa, Zea mays
  UNSURE (1)..(197): unsure at all Xaa locations
  Clone ID: PAT_MRT4577_128071C.1.pep
  unsure (1)..(197): unsure at all Xaa locations
MAAKIFCLLMLLGLSASAATATIFPQWLQASIGFLLSPYLLPAGVLGWENPIFXPFWIQQGIGGGILPLLPLVLQQLLTLLQELPLVHLLAQNIRAQQLPQLGLANLGGFFXQQQVLSFNQLAVLNSGSYLQQQQLPFKQVSGGYPQQFLSFNQLTGLNSSVFLHGQQLLPFSQVAGVSPASSLSQPQLLAFYQDAV

SEQ ID NO: 4461 - protein, 223 aa, Zea mays
  Clone ID: PAT_MRT4577_128099C.1.pep
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQQQQGELPRGAANAAGYAGYGAPGSGGMMMMMMGQPMYGGSQPQQQPPQPQPPQQQQQQHQQHHMAMGGRGGFGQQGGGGGSSSSSGLGRQDRA

SEQ ID NO: 4462 - protein, 561 aa, Zea mays
  Clone ID: PAT_MRT4577_12812C.1.pep
IMAVALANGGNKPPDWQDFVGIITLLIINSTISFIEENNAGNAAAALMARLAPKAKVLRNGRWTEEESAILVPGDIISVKLGDIIPADARLLEGDPLKIDQSALTGESLPVTKGPGDGVYSGSTCKQGEIEAVVIATGVHTFFGKAAHLVDSTNQVGHFQKVLTAIGNFCICSIAVGMLVELVVMYAIQHRAYRPGIDNLLVLLIGGIPIAMPTVLSVTMAIGAHRLAQQGAITKRMTAIEEMAGMDVLCSDKTGTLTLNKLTVDKSLVEVFQRGVDQDTVILMAARASRTENQDAIDATIVGMLADPKEARAGVQEIHFLPFNPTDKRTALTYLDGEGKMHRVSKGAPEQILHLAHNKSDIERRVRAVIDKFAERGLRALGVAYQEVPDGRKESPGGPWQFIGLLPLFDPPRHDSAETIRRALNLGVNVKMITGDQLAIGKETARRLGMGTNMYPSSALLGQNKDESIASLPIDDLIEKADGFAGVFPEHKYEIVKRLQARKHICGMTGDGVNDAPALKKADIGIAVADSTDAARSASDIVLTEPGLSVIISAGLTSRAI

SEQ ID NO: 4463 - protein, 53 aa, Zea mays
  Clone ID: PAT_MRT4577_128163C.1.pep
ARSIGTDHCYRPYHGAGCNIVQESPSPSQELLKNAWVIQKIQELVSAGIAHMR

SEQ ID NO: 4464 - protein, 166 aa, Zea mays
  Clone ID: PAT_MRT4577_128306C.1.pep
MASEHAAGGEAKHDQKQSLMDKAKGFVAEKIAHIPKPEATLDGVTFKGLSRECITLHSSVNVSNPYDHRLPICEVTYTLRCAGKEVASGTMPDPGWIAASGSTALEIPAKVPYDFLVSLVRDVGRDWDIDYELQVGLTVDLPIVGNFTIPLSTSGEFKLPTLKDLF

SEQ ID NO: 4465 - protein, 151 aa, Zea mays
  UNSURE (1)..(151): unsure at all Xaa locations
  Clone ID: PAT_MRT4577_128341C.1.pep
  unsure (1)..(151): unsure at all Xaa locations
DVEYRCFVGGLAWATADHXQHNAFSTYGEVLESKIILDRETQRARGLGYHTFSTAEAMXNAIQGMNRKELDRRNITVNXAQSRCGTXGGRSGYSGGRGGGGYCXGGRPDGGGRYWGGSGYRGNAXYRGGGXGYGGGNRGGGYRNSDXNWKN

SEQ ID NO: 4466 - protein, 261 aa, Zea mays; identical to SEQ ID NO: 4116
  Clone ID: PAT_MRT4577_128747C.1.pep

SEQ ID NO: 4467 - protein, 261 aa, Zea mays; identical to SEQ ID NO: 4116
  Clone ID: PAT_MRT4577_128748C.1.pep

SEQ ID NO: 4468 - protein, 261 aa, Zea mays; identical to SEQ ID NO: 4116
  Clone ID: PAT_MRT4577_128750C.1.pep

SEQ ID NO: 4469 - protein, 261 aa, Zea mays
  Clone ID: PAT_MRT4577_128751C.1.pep
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKHDSSEGQ

SEQ ID NO: 4470 - protein, 348 aa, Zea mays
  Clone ID: PAT_MRT4577_128794C.1.pep
MENGGGKGDVPNDANEHCPGTQSEEAGKADACAGCPNQQICATAPKGPDPDVVAIVERLATVKHKLLVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEINFCKKVGVPVLGVVENMSGLRQPLSDLSFVKPGEAGETDATEWALNYIKEKAPELLSVMACSEVFDSSKGGAEKMCREMGVPFLGKVPMDPQLCKAAEEGRSCFSDQKCGASAPALQSIVKKLIKTG

SEQ ID NO: 4471 - protein, 348 aa, Zea mays
  Clone ID: PAT_MRT4577_128796C.1.pep
MENGGAKGDVPDDANEHCPGTQSEEAGKADACAGCPNQQICATAPKGPDPDVVAIVERLATVKHKLLVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEINFCKKVGVPVLGVVENMSGLRQPLSDLRFIKSDEAGETDATEWALNYIKEKAPELLSVVACSEVFDSSKGGAEKMCHEMGVPFLGKVPMDPQLCKAAEEGRSCFADQKCSASAPALRNIVKKLIKAE

SEQ ID NO: 4472 - protein, 67 aa, Zea mays
  Clone ID: PAT_MRT4577_128800C.1.pep
VVLTGVTGHRLTSSGPRSLKEYVPRAHHSAPGEGSSRTAAFLQRTSIPCAWRRPAPTRLNGGRLAPI

SEQ ID NO: 4473 - protein, 480 aa, Zea mays
  Clone ID: PAT_MRT4577_128868C.1.pep
MSFRSIVRDVRDGFGSLSRRSFEVTLASIYGLTGHHKGKTQSSSHVLDDSPSIICESRWANLPPELIRDIIRRLEADESTWPARKHVVCFAAVCRTWREMCKEIVLSPEFCGKLTFPVSLKQPGPRDGNTMVQCFIKRNKSKSTYHLYLCLSNVVTSESGKFLLSAKRHRKTTCTEYTISMDSGNISRSKRTYIGKIRSNFLGTRFLIYDTQPPYNGAVVPPAGRTSRRFNSTKVSPKLPSVSYNIAQVSYELNVLGTRGPRRMRCIMHSIPASSVEPGGTVPGQPEQIVPRALEDSFRSTASFSQSFRSTASFSKSIMDSSMDFNSARFSDIAGSSARFTGVPGSSARFAGVPGSSARFSGIAGARLDNDEESETKERPLVLRNKPPRWHEQLQCWCLNFRGRVTIASVKNFQLIAAATPPPAGAPTPSQPAPSDPDKVILQFGKVARDMFTMDYRYPLSAFQAFAICLSSFDTKLACE

SEQ ID NO: 4474 - protein, 480 aa, Zea mays
  Clone ID: PAT_MRT4577_128869C.1.pep
MSFRSIVRDVRDGFGSLSRRSFEVTLASIYGLTGHHKGKTQSSSHVLDDSPSIIRESRWANLPPELIRDIIRRLEADESTWPARKHVVCFAAVCRTWREMCKEIVLSPEFCGKLTFPVSLKQPGPRDGNTMVQCFIKRNKSKSTYHLYLCPLACCTSESGEFLLSAKRHRKTTCTEYTISMDSGNISRSKRTYIGKIRSNFLGTRFLIYDTQAPYNGAVVPPAGRTSRRFNSTKVSPKLPSVSYNIAQVSYELNVLGTRGPRRMRCIMHSIPASSVEPGGTVPPRVRQIVPRALEDSFRSTASFSQSFRSTASFSKSIMDSSMDFNSARFSDIAGSSARFTGVPGSSSRFAGVPGSSARFSGIAGARLDNDEESETKERPLVLRNKPPRWHEQLQCWCLNFRGRVTIASVKNFQLIAAATPPPAGAPTPSQPAPSDPDKVILQFGKVARDMFTMDYRYPLSAFQAFAICLSSFDTKLACE

SEQ ID NO: 4475 - protein, 480 aa, Zea mays
  Clone ID: PAT_MRT4577_128873C.1.pep
MSFRSIVRDVRDGFGSLSRRSFEVTLASIYGLTGHHKGKTQSSSHVLDDSPSIIRESRWANLPPELIRDIIRRLEADESTWPARKHVVCFAAVCRTWREMCKEIVLSPEFCGKLTFPVSLKQPGPRDGNTMVQCFIKRNKSKSTYHLYLCLSNVVTSESGKFLLSAKRHRKTTCTEYTISMDSGNISRSKRTYIGKIRSNFLGTRFLIYDTQPPYNGAVVPPAGRTSRRFNSTKVSPKLPSVSYNIAQVSYELNVLGTRGPRRMRCIMHSIPASSVEPGGTVPGQPEQIVPRALEDSFRSTASFSQSFRSTASFSKSIMDSSMDFNSARFSDIAGSSARFTGVPGSSARFAGVPGSSARFSGIAGARLDNDEESETKERPLVLRNKPPRWHEQLQCWCLNFRGRVTIASVKNFQLIAAATPPPAGAPTPSQPAPSDPDKVILQFGKVARDMFTMDYRYPLSAFQAFAICLSSFDTKLACE

SEQ ID NO: 4476 - protein, 347 aa, Zea mays
  Clone ID: PAT_MRT4577_128883C.1.pep
MADNSIEQALIENPPNALKWKPSERAKRFRRCRSTPSDPTDQKPAENGSVLKAKELFKEKRPSFMLVGLLLFAYLLVGVIIFYLFMDQLSGKTTDRVLDALYFVIVTMTSVGYGDLFPNSDTTKLLACAFVFTGMAIIALFISKAADYLVEKQEVLFFKALHMNMKGSEAKMLGAMETNRIKYKFYTVALLLAMVIVAGTVFLWKVEKLSLVDSFYCVCATITTLGYGDKSFSSKLGRVFAVFWITTSTLIMAQFFMYLAELYTERRQKILTKWVINRRITTMDLEAADIDDDRQVGAAEFVLYKLKELGKISQEEISCFLEEFDKLDVDQSGTLSTYDLTLGQTSQ

SEQ ID NO: 4477 - protein, 348 aa, Zea mays
  UNSURE (1)..(348): unsure at all Xaa locations
  Clone ID: PAT_MRT4577_128885C.1.pep
  unsure (1)..(348): unsure at all Xaa locations
MADNSIEQALIENPPNVLKWKPSERAKRFRRCRSTPSDPTDQKPAENGSVLKAKELFKEKRPSFMLVGLLLFAYLLVGVIIFYLFMDQLSGKTTNRVLDALYFVIVTMTSVGYGDLFPNSDTTKLLACAFVFTGMAIIALFISKAADYLVEKQEVLFFKALHMNMKGSEAKMLGAMETNRIKYKFYTVALLLATVIVAGTVFLWKVEKLSLVDSFYCVCATITTLGYGDKSFSSQLGRTFAVFWIITSTIILALFFMYLAEIYTERRQKMLAKWVLTRRVTTMDLEAADLDSDRKVGAXAEFVVYKLKELGKISQEDISSFLEEFDKLDIDQSGTLSTYDLTQAQSGQ

SEQ ID NO: 4478 - protein, 134 aa, Zea mays
  Clone ID: PAT_MRT4577_128901C.1.pep
MAGRGKAIGSGAAKKAISRSSKAGLQFPVGRIARFLKAGKYAERVGAGAPVYLAAVLEYLAAEVLELAGNAARDNKKTRIVPRHIQLAVRNDEELSRLLGMVTIASGGVMPNIHNLLLPKKAGGSKAVAADDDS

SEQ ID NO: 4479 - protein, 409 aa, Zea mays
  UNSURE (1)..(409): unsure at all Xaa locations
  Clone ID: PAT_MRT4577_129094C.1.pep
  unsure (1)..(409): unsure at all Xaa locations
GRESPALPPGAYRGVSFLSSKPALGARLRRPPPAFLLYLRRGDPRQPSTPLTLPKPELSRSQDADPNQRPLPALYSPTTPQPTAMSATATDEAAVEARLQELRGRLGKKQHFEEAVNELAAAVRDRYAGASPALRKAMYSTVCRVATVLQTRYTAPGFWHVGLNLFVGIEKLVSNPAEKEHLKTCISRAREHLDEKENEDSVPSNREADTRFLFEGHLTVGQEPPPPAWLXVAQNLTRELSILTESSGDQDXPTTRTVPRAEEITPAIMNLLETISGDRDLETALEESLQGIIEYPQRAPPASKEVVANLPVIAVTEEVMSRLGSETECAVCRENLVVDDKMQELPCKHLFHPLCLKPWLDENNSCPICRHELRTDDHVYESRKEREREEEEDRRGAANAVRGGEFIYI

SEQ ID NO: 4480 - protein, 128 aa, Zea mays
  UNSURE (1)..(128): unsure at all Xaa locations
  Clone ID: PAT_MRT4577_12910C.1.pep
  unsure (1)..(128): unsure at all Xaa locations
MSDSDEHHFELDGRAGSSKTYPAHAGTVRMNCFIVIKNRPCTAVEVSTLKTDKHGHAKCYFVAIDISNGKKFEYIGPSXHTAXITAVNRTEYHMIDISDYGLASFLTSDGNTNDDLKLPTDYTLVAQI

SEQ ID NO: 4481 - protein, 383 aa, Zea mays
  Clone ID: PAT_MRT4577_129308C.1.pep
MIGFPPWNCLPTGIAKIAAAAAVVVAALASSGIALPRPRAAPPPSGFGLLMSKAKVYTDVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEFVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNSYLNKYHIELDPQLEALVGRHSRKPWLKFMNGDNQHLVSPEAIDFLDKLLRYDHQDRLTAREAMAHPYFLQVRAVENSRTRAQ

SEQ ID NO: 4482 - protein, 383 aa, Zea mays
  Clone ID: PAT_MRT4577_129310C.1.pep
MIGASPWNRLPSGIAKPAAAAAVVVAALASSFLALPRPRAAPPPAGSGPLMSKAKVYTDVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEFVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYHIELDPQLEALVGRHSRKPWSKFMNADNQHLVSPEAIDFLDKLLRYDHQDRLTAREAMAHPYFLQVRAVENSRTRPQ

SEQ ID NO: 4483 - protein, 381 aa, Zea mays
  Clone ID: PAT_MRT4577_12935C.1.pep
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECRDCKMCNSGKTNLCGKVRGATGVGVMMSDRKSRFSVNGKPIYHFMGTSTFSQYTVVHDVSVAKINPQAPLDKVCLLGCGVSTGLGAVWNTAKVEAGSIVAVFGLGTVGLAVAEGAKSAGASRIIGIDIDTKKFDVAKNFGVTEFVDPKEHDNPIQQVLVDLTDGGVDYSFECIGNVSVMRAALECCHKGWGTSVIVGVAASGQEIATRPFQLVTGRVWKGTAFGGFKSRTQVPWLVDKYMKKEIKVDEYITHNMNLADINDAFHLLHEGGCLRCVLAMQI

SEQ ID NO: 4484 - protein, 222 aa, Zea mays
  Clone ID: PAT_MRT4577_129407C.1.pep
GADGVMIDVWWGLVEGKGPKAYDWSAYKQVFGLVHEAGLKLQAIMSFHQCGGNVGDVVNIPIPQWVRDVGATDPDIFYTNRGGTRNIEYLTLGVDDQPLFHGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSCYS

SEQ ID NO: 4485 - protein, 95 aa, Zea mays
  Clone ID: PAT_MRT4577_129427C.1.pep
GPSRPAGRCLAGERGPALARRDTITATMEGVTSLLTTGWKTSQGAMEMPLMIQGYEKGLIEYPHHHLSQVLETRRRRPMYAPATSTSTGVPSAIT

SEQ ID NO: 4486 - protein, 73 aa, Zea mays
  UNSURE (1)..(73): unsure at all Xaa locations
  Clone ID: PAT_MRT4577_129440C.1.pep
  unsure (1)..(73): unsure at all Xaa locations
LNELDHLLVSLRMLCQLGHVHALLPGRLRRGHTCQXRVRCGGTGRVGGSGSPAARTVARLWVAHRLLWSASYE

SEQ ID NO: 4487 - protein, 175 aa, Zea mays
  UNSURE (1)..(175): unsure at all Xaa locations
  Clone ID: PAT_MRT4577_129576C.1.pep
  unsure (1)..(175): unsure at all Xaa locations
KDSIGPPVANARSRPPVACQAYYPLQAVTARXNGFIGIKNRPCKVVEGATXRTGHHGHAXCHFAAIDXFNGXKAPQILVLXHNCNILHGNRTEYXQLNDISEDGLASLLTSDGNTNDDLTLPTDETVAAQIKEGVESGKDLVVTVQTAMAEEQIXALKDVGPKQLACLEILYLRN

SEQ ID NO: 4488 - protein, 89 aa, Zea mays
  UNSURE (1)..(89): unsure at all Xaa locations
  Clone ID: PAT_MRT4577_129683C.1.pep
  unsure (1)..(89): unsure at all Xaa locations
MAGEIFCLLMLLALSASAATATIFPQCSQAPISFLLPPYLSPAVXSVCENPNLXPYMIHQAISSCIXPLSPIFLQQTSVLXQYFPLEHL

SEQ ID NO: 4489 - protein, 77 aa, Zea mays
  UNSURE (1)..(77): unsure at all Xaa locations
  Clone ID: PAT_MRT4577_129823C.1.pep
  unsure (1)..(77): unsure at all Xaa locations
MAANIFGFLMLLGLFVSAASSTIFPHCSQASIAFFLSPYLLPAVFSVCXNPILQPYRIQQVIAVCILPLSPLFPPTF

SEQ ID NO: 4490 - protein, 518 aa, Zea mays
  Clone ID: PAT_MRT4577_129850C.1.pep
MEYERIEKPFPVQGGGFSPKRLRAMLLGVDKRRKGQDGAAEEDEDGGGGGDYGALPKAHARSGAGDGGGATCEEYKDVDVVSTTSEFSSSLETAGGHRPRDAHPVATGSRTRVPPEEDSCDSESVASNFEFHKERRAAAAASVVPPFSKPAPSKWDDAQKWIASPTANCPGRGGAAPAPKKTEKPGSGIGRLPLPATKVVVEATEEIDTKRMDPSQEKREIGWQKAARWAPPDPCPEAEPCPTKTTLLAVETTVAAASAAAVNFNRHDASTTLQSAATCIPPPTTVRSVSMRDMGTEMTPIASQEPSRTGTPVRATSPNCSQPTTPRRTLGGPSAVGSFISHGGECSSSELSEQELQTKTRREIMLLGTQLGKTSIAAWASKKEEEKDASLSLKPVPMDQSTQNITAIRAAAWEEAEKAKYLARFKREEIKIQAWEDHQKAQIEAEMRKIEVEVERMRARAQDKLMTKLASARHSADEKRAAAELKRNRAAARTAEQAEHIRRTGRVPPSFGCWNWCS

SEQ ID NO: 4491 - protein, 251 aa, Zea mays
  Clone ID: PAT_MRT4577_129994C.1.pep
MGRGPVQLRRIENKINRQVTFSKRRNGLLKKAHEISVLCDAEVALIVFSTKGKLYEYSSHSSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQHRGAAESESEPSPAPAQANRGNLPPWMLRTVK

SEQ ID NO: 4492 - protein, 88 aa, Zea mays
  Clone ID: PAT_MRT4577_130243C.1.pep
WGWGSSCKCGKKSPSLEETSPPAQAPVVLGVAPEKKAAPEFFKPPGESGEAPPGCSLGGNCKCAPCNCCSHRSPPMDMIFFYLAWGGG

SEQ ID NO: 4493 - protein, 227 aa, Zea mays
  Clone ID: PAT_MRT4577_130373C.1.pep
MADSPVELPNRLAILPFRNKVLLPGAIVRIRCTNPSSVKLVEQELWQKEDKGLIGVLPVRDSEATAIGSLLSPGVGSDSGGGGSKAVGSAGESSKQHLKNGKEPIQWHTKGVAARALHLSRGVEKPSGRVTYIVVLEGLCRFSVQELNAGGPYHFARVSRLDMTKTELEHAEQDADLIALSRQFKATAMELISVLEQKQKTVGRTKVLLDTSLFSTRKVRADPAVSG

SEQ ID NO: 4494 - protein, 885 aa, Zea mays
  Clone ID: PAT_MRT4577_130377C.1.pep
MSDSPVELPSRLAVLPFRNKVLLPGAIVRIRCTNPSSVKLVEQELWQKEEKGLIGVLPVRDSEATAVGSLLSPGVGSDSGEGGSKVGGSAVESSKQDTKNGKEPIHWHSKGVAARALHLSRGVEKPSGRVTYIVVLEGLCRFSVQELSARGPYHVARVSRLDMTKTELEQAEQDPDLIALSRQFKATAMELISVLEQKQKTVGRTKVLLDTVPVYRLADIFVASFEISFEEQLSMLDSVHLKVRLSKATELVDRHLQSILVAEKITQKVEGQLSKSQKEFLLRQQMRAIKEELGDNDDDEDDVAALERKMQNAGMPANIWKHAQREMRRLRKMQPQQPGYSSSRAYLELLADLPWQKVSEERELDLRVAKESLDQDHYGLTKVKQRIIEYLAVRKLKPDARGPVLCFVGPPGVGKTSLASSIAKALNRKFIRISLGGVKDEADIRGHRRTYIGSMPGRLIDGLKRVSVSNPVMLLDEIDKTGSDVRGDPASALLEVLDPEQNKAFNDHYLNVPFDLSKVIFVATANRMQPIPPPLLDRMEIIELPGYTPEEKLKIAMKHLIPRVLEQHGLSTTNLQIPEAMVKLVIERYTREAGVRNLERNLAALARAAAVKVAEQVKTLRLGKEIQPITTTLLDSRLADGGEVEMEVIPMEHDISNTYENPSPMIVDEAMLEKVLGPPRFDDREAADRVASPGVSVGLVWTSVGGEVQFVEATAMVGKGDLHLTGQLGDVIKESAQLALTWVRARAADLNLSPTSDINLLESRDIHIHFPAGAVPKDGPSAGVTLVTALVSLFSNRKVRADTAMTGEMTLRGLVLPVGGVKDKVLAAHRYGIKRVILPERNLKDLSEVPLPILSDMEILLVKRIEEVLDHAFEGRCPLRSRSKL

SEQ ID NO: 4495 - protein, 47 aa, Zea mays
  Clone ID: PAT_MRT4577_130728C.1.pep
VDRGRDHRHLAVVAAHGAHEREVFLSAPHRCCEGLGLKGCVGGGAGK

SEQ ID NO: 4496 - protein, 208 aa, Zea mays
  Clone ID: PAT_MRT4577_130815C.1.pep
MSRRAAALLLACLVAVTAAALADGALLPWFGDGRRGLDEAAVTDVGLLAADPFRILEHVPFGFDRDDVAMVSMARVDWRETPDAHEIVVDVPGMRREDLRIEVEDNRVLRVSGERRRAEERKGDHWHREERSYGRFWRRFRLPENADLDSVAASLDSGVLTVRFRKLAPEQIKGPRVVGIAGGDGGAEAKESIGTGAGDGHQTKKVEL

SEQ ID NO: 4497 - protein, 208 aa, Zea mays
  Clone ID: PAT_MRT4577_130817C.1.pep
MSRRAAALLLACLVAVTAAALADGALLPWFGGGRRGLDEAAVSDVGLLAADPFRILEHVPFGFDRDDVAMVSMARVDWRETPDAHEIVVDVPGMRREDLRIEVEDNRVLRVSGERRRAEERKGDHWHREERSYGRFWRRFRLPENADLDSVAASLDSGVLTVRFRKLAPEQIKGPRVVGIAGGDGGAEAKESIGTGAGDGHQTKKVEL

SEQ ID NO: 4498 - protein, 106 aa, Zea mays
  Clone ID: PAT_MRT4577_130847C.1.pep
GGVRATPTGIGGIKRWGPPGQVILFATVMFTLVQRVYFRSGRVCFCPSVFFIPRSICVNCKDCVYPRFKRTHASNSMDWGSMDFVTPGRVFFKLILRKKWCFLVLP

SEQ ID NO: 4499 - protein, 57 aa, Zea mays
  UNSURE (1)..(57): unsure at all Xaa locations
  Clone ID: PAT_MRT4577_131110C.1.pep
  unsure (1)..(57): unsure at all Xaa locations
MASATALKSSFLPKKSEWGATRQAAAPRPSTVSMVXRAFGYADELVKTAKTIALPGR

SEQ ID NO: 4500 - protein, 243 aa, Zea mays
  Clone ID: PAT_MRT4577_13125C.1.pep
MASLFKDPSKLSAYRDRRFKGTQEEYEATLHASTTLYIGNMSFYTTEEQAYELFSRAGEIKKIIMGLDKNSKTPCGFCFVLYYSREDAEDAVKYISGTMLDDRPIRVDFDWGFEEGRQWGRGRSGGQVRDEYRTDYDPGRGGYGKMVQRELEAQRELVDYGGSFQPNAPPPYERGERKRGYGDSHRNARGDYQRKRYRSSDDRSAPEESKRAPDSDPADKNPRFREKGDSDEEDDDYDKRRRR

SEQ ID NO: 4501 - protein, 242 aa, Zea mays
  Clone ID: PAT_MRT4577_13127C.1.pep
MASLFKDPSKLSAYRDRRFKGTQEEYEAALLASTTLYIGNMSFYTTEEQAYELFSRAGEIKKIIMGLDKNSKTPCGFCFVLYYSREDAEDAVKYISGTMLDDRPIRVDFDWGFEEGRQWGRGRSGGQVRDEYRTDYDPGRGGYGKMVLRELEAQRELVDYGGSFQPNAPPPYERSERKRGHGDSHRNDRGDYQRKRYRNDDRSAPEESKRAPDSDPAEKNPRFREKGDSDEEEDDYDGKRRR

SEQ ID NO: 4502 - protein, 58 aa, Zea mays
  Clone ID: PAT_MRT4577_131301C.1.pep
AFLKLTLLLTKKKKKKKKKKKGKKKKKKKKKKKKKKKKKKKKKKKKKKKKKKKKGRPF

SEQ ID NO: 4503 - protein, 47 aa, Zea mays
  Clone ID: PAT_MRT4577_131328C.1.pep
NRVPVRICHRVSVRSTFGLGVGTPVVPIVCSRYKTRREKNEQGFCSQ

SEQ ID NO: 4504 - protein, 81 aa, Zea mays
  Clone ID: PAT_MRT4577_131498C.1.pep
AKMGARGMQAFGKHCKSLARLRRVMHPIALADRACQHDDAHTIAWSMSMLQHLEMGYMLVATEAVAEILRRCRELRFLGVR

SEQ ID NO: 4505 - protein, 313 aa, Zea mays
  UNSURE (1)..(313): unsure at all Xaa locations
  Clone ID: PAT_MRT4577_131516C.1.pep
  unsure (1)..(313): unsure at all Xaa locations
GRKPCNLKPLPGANRLIKHLKTNGVPTALASNSPRCNIEAKIFFQQGWKESFSAIVGGDEVEKGKPSPNIFLEAAKRMNCAPSNCLVIEDSLXCYRWKSCRNACXIAVPSIPKKTAEFSSADEVINSLLDVRPEKWGLPPFNDWIEGTLPIEPWFIGGPVIKGFGRGSKVLGIPTANLPAENFSDVVSEHTSGVYFGWAGLSTRGIYKMVMSIGWNPYFDNTEKTVEPWLLHDFGEDFYGEEVRLAIVGYIRPEANFPSLESLIERIHEDGRVAEKALDLPMYAKYKDSPYLRNPSKHGSSTTGGTQSEMDSK

SEQ ID NO: 4506 - protein, 767 aa, Zea mays
  Clone ID: PAT_MRT4577_131643C.1.pep
MKISALLTSAGINIGLCVLFLSLYSVLRKQPANVRVYFGRRIAEEHDRLRGAFILERFVPSTGWIVKALQCTEEEILAAAGLDAVVFNRILVFSIRIFSLAAVLCVFGILPLNYFGQDIHHVRIPSESLDIFTIGNVEVKSRWLWVHCVTLYIISAVACILLYIEYKHIARLKLLHLTSATPKPNHFTVLVRGIPKADKESCSDVVDNFFTKYHSSSYLFHQVVYKVGKVQKIMTGAKKAYKKFKHFTDETVDQGCRTVTYRCCLCGASSNSFKLLNTECEQNKGKADNKSILDLDDEECTTAFVFFKTRYAALIASEILQTSNPMNWVANLAPEPEDVYWSNLWLPYKQLWARRIATLLGSIFFMFIFLIPVTFIQGLSQLEQLQQRLPFLRGILKKKYYMTQLVTGYLPSVILQIFLYIVAPIMMLFSTLEGPTSHSERKRSACCKVLYFTVWNIFFANVLSGTVISQLNVLSSPKDIPVQLAKAVPGQATFFITYVLTSGWASLSSEVMQLFGLIWNFIIKYVLRMREDTEFVPSFPYHTEVPKVLLFGLLGFTFSVLAPLILPFLLVYFCLGYVVYRNQLLNVYRTRYDTGGLYWPIAYNTVIFSLVLTQIICLGVFGLKESPVAAGFTVPLIILTLLFNQYCRNRLLPLFKTFPAQDLIDMDREDERSGRMDEIHHGLHSAYCQFADTVDVPLDKIEIVGGDEEQGSSSGQSSVKETCEDPKKHLAHPTLKGLPVNRLRHAVRSVTFLIRLQKRGLSEQKIG

SEQ ID NO: 4507 - protein, 542 aa, Zea mays
  Clone ID: PAT_MRT4577_131768C.1.pep
MSARDSNHSYKCSDDSQMPYYNNSAPVGENGRIHMAENSLGHHYSSSDIGSQRINNSNPQVFEAQYCTLESSSANGVYPAQSSTSSHSISPLSGSPLSQHDSHSDHTYSSPPSASCLTEVADLLIQQKELENSIVGPGLDISSDCSRSLLQAHVPVRPDNWRQLLGINGGDLMQVVIACGKAVAENDVFATELLISELGHLVSVSGDPMQRLGAYMLEGIVARLSSSGSMLYKSLKCKEPTSSELMSYMHLLYEICPFYKFGYMSANGAIAEAIKGENFVHIIDFQIAQGSQWVTLLQALAARPGGPPYIRITGIDDSNSAYARGGGLDIVGRTLCDVANSCGLPFEFNAVPAASHEVELQHLAIRHGEIIAVNFAYQLHHVPDESVSTENHRDRIIRMIKSINPRVVTLVEQESNTNTAPFFPRYMETLNYYTAMFESIDVALPRDDRRRMSAEQHCVARDIVNLIACEGAERVERHELFGKWKSRFAMAGFRPYPLSSVVNNTINTLLHTYNSYYRLEERDGVLYLGWKNRVLVVSSAWC

SEQ ID NO: 4508 - protein, 493 aa, Zea mays
  Clone ID: PAT_MRT4577_132012C.1.pep
MVLSHGVGGSDESVHSTFASRYVRTSLPRYRMPEQSIPKEAAYQIINDELMLDGNPRLNLASFVTTWMEPECDKLIQASVNKNYVDMDEYPVTTELQNRCVNMIAHLFNAPLGDAETAVGVGTVGSSEAIMLAGLAFKRRWQNKMKAAGKPCDKPNIVTGANVQVCWEKFARYFEVELKEVKLSDGYYVMDPQKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRTKADLPEELIFHINYLGADQPTFTLNFSKGSSQVIAQYYQLIRLGFEGYKNIMENCQENATVLKQGLEKTGKFNIVSKDNGVPLVAFSLKDSSRHNEFEISDFLRRFGWIVPAYTMPPDAQHVTVLRVVIREDFSRTLAERLVLDIEKVLHELDALPARVPSGDLAALAAAESSEREMEKQRQVISLWKRAVLAKKKTNGVC

SEQ ID NO: 4509 - protein, 402 aa, Zea mays
  UNSURE (1)..(402): unsure at all Xaa locations
  Clone ID: PAT_MRT4577_132084C.1.pep
  unsure (1)..(402): unsure at all Xaa locations
MSFRSLIQDMKDEFGSISRHSLGXVRSHRSAGNAARAVAAGPSEAMDQSCWSQLPPELLREVLVRIEASESWWPARKDVVSGAGVCRTWRGIMKEAVRVPEVSGKLTFPISLKQPGPRDGTLKCFIRRNRTTQTYYLYIGLTEALADDGKFLLAARKCRKPTCTDYLISLDKVDMSKGSSTYIGKLRSNFLGTKFTVYDAHPPYDGAAVSKSRSARVVGLKQVSPRVPAGNYPVSHISYELNVLGSRGPRRMNCVMDSIPASAVKEGGKTPTQTEFPLSSLDSFPSFPFFRSKSARIDSSTSQSSSQREDRLVLKNKSPRWHEQLQCWCLNFRGRVTVASVKNFQLVASEDNGPESQESDKVILQFGKIGKDLFTMDYGYPISAFQAFAICLSSFDTKIACE

SEQ ID NO: 4510 - protein, 344 aa, Zea mays
  Clone ID: PAT_MRT4577_132172C.1.pep
MGILCLGASSTLLCGEDRNNVLGLGCGNELVEVGSGHDGLDSVVGAVFPVDTDEAVRALLEKETDHKPQDGYAERLERGGLEYSWRRDAMDWICKVHSYYRFGPLSLYLAVNYLDRFLSSYDLPHDKPWMRQLLSVACLALAVKMEETVLPLPVDLQVCDVKFEFEARTIGRMELLVLATLKWRMQAVTPFTFISYFLDKFNGGKPPSLALASRCTDIIIGTLKGSTFLSFRPSEIAAASALAAVSENQVVGSSSALSASEVPINKEMIARCYELLQEQALVRKTGHINGSPSVPQSPIGVLDATCFSFRSEDVRLGSSQSNNISSSSNDNQVSKRRRLSISPI

SEQ ID NO: 4511 - protein, 60 aa, Zea mays
  Clone ID: PAT_MRT4577_132351C.1.pep
EKHEAKKAPEHAHLHKIEEEVPAAPPLGSRGFAFHEHHEKKKARKHPEEAGGEKKHHFFG

SEQ ID NO: 4512 - protein, 114 aa, Zea mays
  UNSURE (1)..(114): unsure at all Xaa locations
  Clone ID: PAT_MRT4577_13259C.1.pep
  unsure (1)..(114): unsure at all Xaa locations
DPRVXGILPLSFLFFQQSSXLLHQXPLFHLLSQNIMSQQLQQLVLANLAAYSHXLLFFTFNQLTALNSTSYLLQQQLPFSQLPAAYLHLFLSFNHLPILNSPVYSQHQQLLPFI

SEQ ID NO: 4513 - protein, 206 aa, Zea mays
  Clone ID: PAT_MRT4577_132612C.1.pep
MRTICDVCESAPAVLFCAADEAALCRPCDEKVHMCNKLASRHVRVGLADPNKLVRCDICENSPAFFYCEIDGTSLCLSCDMTVHVGGKRTHGRYLLLRQRVEFPGDKPGHMDDVPMEIQDPENQRDQKKPPKEQTANHHNGDDPATDGNCDDQGNIDSKMIDLNMRPVRTHGQESNSQTQGVGLSVNNHDSPGVVPTSNSERDTSK

SEQ ID NO: 4514 - protein, 206 aa, Zea mays; identical to SEQ ID NO: 4513
  Clone ID: PAT_MRT4577_132613C.1.pep

SEQ ID NO: 4515 - protein, 205 aa, Zea mays
  Clone ID: PAT_MRT4577_132614C.1.pep
MRTICDVCESAPAVLFCAADEAALCRPCDEKVHMCNKLASRHVRVGLADPNKLARCDICENSPAFFYCEIDGTSLCLSCDMTVHVGGKRTHGRYLLLRQRVEFPGDKPGHMDDVPMEIKDPENQREQNTPKEQMANHHNVNDPVSDGNCDGQGNIDSKMIDLNMRPARTHGQGSNSQTQGVDLSVNNHDSPGVVPTSNSERDAIK

SEQ ID NO: 4516 - protein, 127 aa, Zea mays
  UNSURE (1)..(127): unsure at all Xaa locations
  Clone ID: PAT_MRT4577_132616C.1.pep
  unsure (1)..(127): unsure at all Xaa locations
RSCPSSHNYDSAVDKLDNTQWYVVWNKDMNTRILPEYVVSFKCSKLQLTQELSEATSKLKKPXEWLAXFPTLLAEIEKIVPDKCDLLQESYSRFKMGRIKKDQFIRFLRNYVGDKVLTTVAKKLRGC

SEQ ID NO: 4517 - protein, 103 aa, Zea mays
  Clone ID: PAT_MRT4577_13264C.1.pep
SDETTTGVKRLHQTQETGALLFPAINVNDSVTKSKFDNPHGCRHSLPDGPTRATDVTIAGQVAVVCGHGDVGKGRAAALKQAGARVTVTDTDPICGLQALTEG

SEQ ID NO: 4518 - protein, 51 aa, Zea mays
  UNSURE (1)..(51): unsure at all Xaa locations
  Clone ID: PAT_MRT4577_132703C.1.pep
  unsure (1)..(51): unsure at all Xaa locations
QQCHSNSFWHXGTNYPGNRLQLCPQNPVLFTRSKRALGPPQHPFLANPVNH

SEQ ID NO: 4519 - protein, 167 aa, Zea mays
  Clone ID: PAT_MRT4577_132831C.1.pep
TIIYNQESYLCSCFLHKVKLHFADNALRMIAKKALAKETGARGLRSIMEDILTEAMFEIPDGRHGKEKVIAVLVDEESVGPLHSRGCRAKIFRDDGALELYVYQNNIKLPGLDTEQPQTQTHFPALPSSRIIGNKALDLPDKFLVFHRCMNGLHGYYARSTILHNKI

SEQ ID NO: 4520 - protein, 727 aa, Zea mays
  Clone ID: PAT_MRT4577_132874C.1.pep
MKSAQATRKPSKASSTAGLKRGRRAVFESSESSISETDSDGEVEIPKHGPAENSAGPGQQTRRSSRQKQEVKYNEDSDDDNDDVEDDDNTVEDDFVDSPALKRLRKGGMFHGDHSTKTAKLNEDTAGHNSVNSWGNIKDKKNGGMPCEEKTSNGVEQMKRETMHVGENSDGKEELFHSVSNNGLGLNDDDASDDNKFTFPDPEFFDFDKLRDASQFRANQVWAVYDDQGCMPRFYARITRVKMVPKFMLQFVWLEFNPANKAEEAWSYRGLPVACGHFTHGLSETTSETGMFSRIISLERSKTKNFYEIYPRKGEVWALFKGWDIGWSSDAGIHKKMNHRYEVVQVLSDLTTSTSIIVMPLVKLKGYVSLFVQSGEAAPYVIPQVDTLRFSHCVPHYLTSGTEKEGIPEGSLELDPAALPSNLEEAFPSANPECSSARSQESDSKNAGLSSGNRKGSMNVGQGQHKIAANGRVCTKTTKVENIKHNIDLSEVGDVDDDSICQTEYVCAESEFYDFSRIRFLQKFSSGQIWALYSDIDKFPNYYAFIQKVDLKNDKVQVRWLDVCPQGEVEKRLSQDRTIGIGTFRVGYIHDMMTYTGTDAFSHLVEARPTGRKGEYEILPRLGEIWAVYKNWSAGWTAQDFEKCEYELVEIFGYTDSSIQVQLVRKVDGYKMVFMSYRAGGVKTIRRDEYPKFSHQIPCFHLTHEKGGKLRGYLELDPLSLPEEFLC

SEQ ID NO: 4521 - protein, 196 aa, Zea mays
  UNSURE (1)..(196): unsure at all Xaa locations
  Clone ID: PAT_MRT4577_132927C.1.pep
  unsure (1)..(196): unsure at all Xaa locations
MSKTALLTPYKMGRFDLSHRVVLAPLTRERSFGNVPQPHAILYYQQRTTKGGLLIAEATGVSDTAQGYKDTPGIWTKEQVEAWKPIVNGVHAKGGIFFCQIWHVGRVSNHTFQPNGQAPISSTDKPLKPVVRADGIDVPTISTPRRLQTNEIPLVINDFRAAARNAIEAGFDGVEIHGAHGYLIDQXLKDQVNDRT

SEQ ID NO: 4522 - protein, 98 aa, Zea mays
  Clone ID: PAT_MRT4577_132953C.1.pep
SSPNGAAKQGPVAFPKKNLISMYQNYSVSLPIVMFNFYFCGANTESAPRWRPCRVVPPLVWCVWVWSPLPASKGARLYLKPCFHCGHHRQTLSKCQFG

SEQ ID NO: 4523 - protein, 428 aa, Zea mays
  Clone ID: PAT_MRT4577_132954C.1.pep
MSSSAPAPAAMAVDDAEDDQLASMSTEEITRASRLLDNEIRVHKDELQRSNLELESIKEKTKENQEKIKLNKQLPYLVGNIVEILEMNPEDEAEEDGANIDLDSQRKGKCVVLKTSTRQTIFLPVIGLVDPDKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYA

SEQ ID NO: 4524 - protein, 428 aa, Zea mays
  Clone ID: PAT_MRT4577_132956C.1.pep
MSSSAPAPAAMAVDDAEDDQLASMSTEEIIRASRLLDNEIRVHKDELQRSNLELESIKEKTKENQEKIKLNKQLPYLVGNIVEILEMNPEDEAEEDGANIDLDSQRKGKCVVLKTSTRQTIFLPVIGLVDPDKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNAPFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYA

SEQ ID NO: 4525 - protein, 99 aa, Zea mays
  UNSURE (1)..(99): unsure at all Xaa locations
  Clone ID: PAT_MRT4577_133024C.1.pep
  unsure (1)..(99): unsure at all Xaa locations
MAAKIFSLLMLLGLSASAATVTICPQCSQAPIASXLLPPYLXIGVLRMXEIPIFQPYRIQQAFAAGILPLSPXLLLQHSLAPLQXVPLVDLLAQNIRAQ

SEQ ID NO: 4526 - protein, 264 aa, Zea mays
  Clone ID: PAT_MRT4577_133069C.1.pep
GLWRGRKDAKGGHCMVAWEKVCRPLHMGGLGISNLTKLCWALRMRWLWLQKTDSSRPWVDLPIQVPSIARSFFSAVLMSEVGNGANTLFWVDKWINGKKVADIAPRLFCTISKRIANKRTVQEAMDNRRWRGDIRGALSAGALIDFLHLWEALTDFQLHPDIEDRHIFTIAPDGNYSAKVAHEGLFQGSCSFLHHKRIWKSWMPPKCHFFLWLVAHDKCWTADRLQKRGMNHPARCPLCDQEPESINHLLGSCVFSRVFWYRLL

SEQ ID NO: 4527 - protein, 348 aa, Zea mays
  Clone ID: PAT_MRT4577_133091C.1.pep
MAPPAHDRLRRLVLLLVVATAAAALLLAPTTADAALPRVQHTPTKADGSLAILVVGDWGRRGQFNQTLVAQQMGVVGQKLDIDFVISTGDNIYDDGIANTSDPLFKESFSNIYTANSLQKPWYLVLGNHDYTGNALAQLDPAIRKVDSRYTAIAKSFIVNSGVADFFLVDTTPFIVHYWNNTKFDWRGVAPRDTYIANLLKDLKCALTASKAPWKIVVGHHPISSACGHGNNTELEELLLPVLRTHGVDMYLNGHDHCLQRVSSRDSRLQLLTSGGGSKAWAGKFKPTLDKVEFLYDGQGFMSMRLSRTEARLAFFDVAGSVLHCWTMHAQKLKTTTTTTAAAAAAGH

SEQ ID NO: 4528 - protein, 446 aa, Zea mays
  Clone ID: PAT_MRT4577_133158C.1.pep
MQEQDVDDGGGRTTQQQEKSIDDWLPINSSRKAKWWYSAFHNVTAMVGAGVLGLPYAMSELGWGPGIAVMILSWIITLYTLWQMVEMHEMVPGKRFDRYHELGQHVFGDRLGLWIVVPQQLAVEVSLNIIYMVTGGQSLKKFHDVICDGGRCGGDLKLSYFIMIFASVHLVLSQLPNFNSISAVSLAAAVMSLSYSTIAWGASLHRGRREDVDYHLRATTTPGKVFGFLGGLGDVAFAYSGHNVVLEIQATIPSTPDKPSKKAMWKGAFVAYVVVAICYFPVTFVGYWAFGSGVDENILITLSKPKWLIALANMMVVVHVIGSYQVYAMPVFDMIETVLVKKMRFAPSLTLRLIARSVYVAFTMFLGITFPFFGGLLSFFGGLAFAPTTYFLPCIMWLKVYKPKRFGLSWFINWICIVIGVLLLILGPIGGLRQIILSATTYKFYQ

SEQ ID NO: 4529 - protein, 159 aa, Zea mays
  Clone ID: PAT_MRT4577_133328C.1.pep
MDSTGTGAAGKGKKGAAGRKVGGPRKKSVSRSVKAGLQFPVGRIGRYLKKGRYAQRVGTGAPVYLAAVLEYLAAEVLELAGNAARDNKKTRIIPRHVLLAIRNDEELGKLLGGVTIAHGGVLPNINPVLLPKKTAEKASSGGSKEAKSPKKAAKSPKKA

SEQ ID NO: 4530 - protein, 159 aa, Zea mays
  Clone ID: PAT_MRT4577_133332C.1.pep
MDSTGTGAGGKGKKGAAGRKVGGPRKKSVSRSVKAGLQFPVGRIGRYLKKGRYAQRVGTGAPVYLAAVLEYLAAEVLELAGNAARDNKKTRIIPRHVLLAIRNDEELGKLLGGVTIAHGGVLPNINPVLLPKKTAEKASSVGSKEAKSPKKAAKSPKKA

SEQ ID NO: 4531 - protein, 159 aa, Zea mays; identical to SEQ ID NO: 4530
  Clone ID: PAT_MRT4577_133333C.1.pep

SEQ ID NO: 4532 - protein, 159 aa, Zea mays
  Clone ID: PAT_MRT4577_133334C.1.pep
MDSTGTGAGGKGKKGAAGRKVGGPRKKSVSRSVKAGLQFPVGRIGRYLKKGRYAQRVGTGAPVYLAAVLEYLAAEVLELAGNAARDNKKTRIIPRHVLLAIRNDEELGKLLGGVTIAHGGVLPNINPVLLPKKTAEKASSGGSKEAKSPKKAAKSPKKA

SEQ ID NO: 4533 - protein, 104 aa, Zea mays
  UNSURE (1)..(104): unsure at all Xaa locations
  Clone ID: PAT_MRT4577_133459C.1.pep
  unsure (1)..(104): unsure at all Xaa locations
GSTAFGFVGERIEMAGSDGEYRWFRGGLAWGTDDHSVHNALRNYREVLESKIILXRETHRSRGLGLGTLCTEEAMRNAIEGMNGKELDGRNITVNEGQSRGGRG

SEQ ID NO: 4534 - protein, 96 aa, Zea mays
  UNSURE (1)..(96): unsure at all Xaa locations
  Clone ID: PAT_MRT4577_133550C.1.pep
  unsure (1)..(96): unsure at all Xaa locations
GKXETELTKICDGIPKLLECEVVPSSTGPESKGLYFKKKGDYYRYLAEFKTGAERKDAAENTMVAYKAAQDIALAELAPTHPIRLGLALNFSGVYY

SEQ ID NO: 4535 - protein, 106 aa, Zea mays
  UNSURE (1)..(106): unsure at all Xaa locations
  Clone ID: PAT_MRT4577_133579C.1.pep
  unsure (1)..(106): unsure at all Xaa locations
NMVSPMILPSMMLSLMTPSIISPIMMPSMIPPMMMPSMVSSMIMPNMMTVPLCYSDSISLIILQQLXLFMFSPTIVVIAPMFLXRPPLGAAILDISICGELLVVFY

SEQ ID NO: 4536 - protein, 69 aa, Zea mays
  Clone ID: PAT_MRT4577_133649C.1.pep
HGEEPSFGAFFPKDGLDYVSCSPFRVPIGRQPQSQGLSQAASSLATGVPFDGGCGDPQYYSKAMIGEHS

SEQ ID NO: 4537 - protein, 391 aa, Zea mays
  Clone ID: PAT_MRT4577_133839C.1.pep
MLSSPLPPSFRLSLPTRPRAAPIFFPLDGAHKSAPNRQTKTRPRPPRQSSVLTFGPSSGYPAAAMAAEASAVQQLAGLLDQVDAPLKKTFENVHQGYPTETLLRFLKAREWHVNKAHRMLEDSLNWRMQNEIDSILEKPIIPVDLYRSIRDTQLIGLSGYSKEGIPVFAVGVGLSTYDKASVNYYVQSHIQINEYRDRFILPTVTKKYGRPITTCIKVLDMTGLKLSALHQMKIVTAISTVDDLNYPEKTETYYIVNAPYIFSACWKVVKPLLQERTRKKVHVLRGCGRDELLQIMDYSSLPHFCRQEGSGSSKHSSGDADNCFSLDHPFHQELYSFIQEQALNQELIKQGSLHVKIPEQDPEDAKIVEVIEAEFHKLGVQNGSANGIDQA

SEQ ID NO: 4538 - protein, 161 aa, Zea mays
  Clone ID: PAT_MRT4577_133893C.1.pep
MAAAATAIATPSVAPEAGDRKAVAPPVDAVDLELELELEEKHVLAVDDSSVDRAVIAKILRSSKYRVTTVDSATRALELLALGLVPDVNMIITDYWMPGMTGYELLKHVKESSALRAIPVVIMSSENVPTRISRCLEEGAEDFLLKPVRPADVSRLCSRIR

SEQ ID NO: 4539 - protein, 86 aa, Zea mays
  UNSURE (1)..(86): unsure at all Xaa locations
  Clone ID: PAT_MRT4577_133896C.1.pep
  unsure (1)..(86): unsure at all Xaa locations
CTERCLDWGEAGEPDLIVDDGSDXTLLIHDGVKAAVDYEQTGKIPDPASTDNAAFKIVLTIVRDGLNADPKKYRKLNERLVGVSEE

SEQ ID NO: 4540 - protein, 552 aa, Zea mays
  UNSURE (1)..(552): unsure at all Xaa locations
  Clone ID: PAT_MRT4577_133990C.1.pep
  unsure (1)..(552): unsure at all Xaa locations
MNSSRSLLSSPLFASSSPNFRSSASVSSSPSPSRTTAVPMIHDTSSSRASTACHYSPSLVAEEQLHGSKDTLTLKGEKALLELLLGMALDQHVDGRKLITQQEAEDSDFESYLREATSRVLYQPTFMYGASEFISSEEDDDDSVSESSSASLAKPAGTLDLGKLTEEPQLDVPQPHRRSVDPNHSYDQVFIRSTRLLERRSKKRNGGHRALDNGVACSGVNSKRKDKFGRVLXIQTSLFRLFLRDRETTEFLTAKEEKQMFSQIQNLMKLEGAQRNLQAQCGREPTVEEWAQAVGMSCRELQSCVRTGRRCREKMARSNFRLVIHVARKYEGCGLDIQDLVQDGCCGLMKTFEKFNPSKGCRFPTYAYWWIRQSIKKSIFKNSRLIRLPXESVYALLRKVGKARMECIMDGEQPTNEVVARRAGITIEKLAKLRAKTRKVRSMQDRVWSDDGVTYQEITEDPNIEGPEVSVDRLMMRQQVRSFLAGILSPREKEIIEHRFGIHDGQPKTLHVIGDMYGLSKERIRQVQNKALDKLRNSISAQGFHVYFDLLT

SEQ ID NO: 4541 - protein, 42 aa, Zea mays
  Clone ID: PAT_MRT4577_134019C.1.pep
TLRSVSPIECAMNGGKSKGAAKADAKLAGKSKGAENPTKGTK

SEQ ID NO: 4542 - protein, 88 aa, Zea mays
  UNSURE (1)..(88): unsure at all Xaa locations
  Clone ID: PAT_MRT4577_134122C.1.pep
  unsure (1)..(88): unsure at all Xaa locations
VTVLHMPSLRYIWVQGSRASWTGQNLMLMARPXWYILFAPPFPEGAYRVMADFXPCVDPHAQVLAYYPPAVCRPACPQWLVALPPVSM

SEQ ID NO: 4543 - protein, 51 aa, Zea mays
  Clone ID: PAT_MRT4577_134246C.1.pep
MTMEQTFIMIKPDGVQRGLIGDIISRFEKKGFYLKGMKFMNVQRSFSRRIR

SEQ ID NO: 4544 - protein, 578 aa, Zea mays
  Clone ID: PAT_MRT4577_134280C.1.pep
MWVENRLSTSWGFKCSKLSIVRNALPSKTPKASVSWKSKDDSNAIPRHLEQSHCKKTSRATRTHFKAMPNLIHKAKNVDTSNLNDGTSGSSWRGQADAYKGEDINIGKECTKTSELLKSREASRKSNILVVDRKDPNKDEPDKVKGIQDEVMTKEEGVKGHTCEGRATCWSCLKQANTTKTNDAPNLGSLLVGNEHMQGLMSNLRDNSSHLFEKNHSRHQRDDPCEYRETNLKFPNRIQSVGGNGKTNDVTSRRKRLLLEEKASAHVQNDLTYGPMKRRRYIEANEDEEEQNDLTYGPMKRRRYIEANEDEEDYVGDHHPVHIEDATTELTPQDSISKHCVERQCYCCSKPIDIPRWSGTFKIDGKEHISLAGHLSSKSCEKVWKLSSLPKVVQVTKVPRMAVWPKIFKASEPSGDNIGLYFFPPEMRHDEELDQLVNEVMDKDLILRAIIGEAEMLIFPSVLLPERYQTFQTKHYLWAAFKAKEDKGDAIVEEEVEKGNCVSNQPDKVQSDNASFPSNHGLDRPSMEAPPQSSSSVFGIVVRQAPNLEPEVKRFIQEMERKGALVTVMRGEAIGGGP

SEQ ID NO: 4545 - protein, 92 aa, Zea mays
  Clone ID: PAT_MRT4577_134332C.1.pep
MAGAACTEAVTVSIFYTVTARPTAAGLLGGAAADPRQPHVALGPGAGGGHDAPPPAGRRRRCRGRRRQAQADDIAPVRGQHERLLHVHLNHG

SEQ ID NO: 4546 - protein, 449 aa, Zea mays
  Clone ID: PAT_MRT4577_134409C.1.pep
MYRAKRAALSPKVKRRVGKYELGRTIGEGTFAKVRFAKNTENGEPVAIKILDKEKVKRHRLVEQIKREICIMKLVRHPNVVRLFEVMGSKARIFIVLEYVTGGELFEIIATNGRLKEDEARKYFQQLINAVDYCHSRGVYHRDLKLENLLLDAAGNLKVSDFGLSALTEQVKADGLLHTTCGTPNYVAPEVIEDGGYDGATADIWSCGVILFVLLAGYLPFEDDNIIALYKKISEAQFSCPSWFSAGAKNMITRILDPNPTTRITISQILEHPWFKKGYKPPVFDEKYQTSLDDVDAAFGDSEDRHVKEETEDQPTSMNAFELISLNQALNLENLFEAKEEYKRETRFTSQCPPKEIITKIEEAAKPLGFDVQKKKYKMRMENPKAGRKGNLNVATEVFQIAPSLHVVELKKAKGDTLEFQKFYRSLSTQLKDVVWKCDGEVDGNSAAA

SEQ ID NO: 4547 - protein, 449 aa, Zea mays; identical to SEQ ID NO: 4546
  Clone ID: PAT_MRT4577_134410C.1.pep

SEQ ID NO: 4548 - protein, 120 aa, Zea mays
  Clone ID: PAT_MRT4577_134413C.1.pep
MAGRGKAIGSGAAKKAMSRSSKAGLQFPVGRIARFLKAGKYAERVGAGAPVYLAAVLEYLAAEVLELAGNAARDNKKTRIVPRHIQLAVRNDEELSRLLGTVTIASGGVMPNIQCQGCGW

SEQ ID NO: 4549 - protein, 323 aa, Zea mays
  Clone ID: PAT_MRT4577_134423C.1.pep
MGVLEDLVARAGGCAVIDGGFATQLEALGADINDPLWSAACLITRPHLVKEVHMQYLEAGADVIISSSYQATIPGFIARGMSVAEAEDLLRTSVKLANEARDEFWKSTLRKSKPIYNRALVAASIGSYGAYLADGSEYSGSYGADITAEKLKDFHRRRLQVLASAGPDLIAFEAIPNQMEAQALVELLEEEKVQIPSWICFSSVDGKNLCSGESFADCLKILNASEKVAVVGVNCTPPQFIEGIICEFRKQTKKAIAVYPNSGEVWDGRAKRWLPVECLGHKSFDALAKRWQEAGASLIGGCCRTTPSTIRAVSKILKGRTGH

SEQ ID NO: 4550 - protein, 617 aa, Zea mays
  UNSURE (1)..(617): unsure at all Xaa locations
  Clone ID: PAT_MRT4577_13464C.1.pep
  unsure (1)..(617): unsure at all Xaa locations
MFDDAGAVAVKRMRLWEEDEVEVEEEGMEVDAEPGWPWGTPAAGLSRAAAIVVADAAEPDFPVIYVNAAFESATGYRAHEVLGRNCRFLQFRDPRAQRRHPLVDPMVVSEIRRCLNEGIEFQGELLNFRKDGAPLYNRLSLIPMHGDDGYVTHVIGIQLFSEANIDLSSVSYPVYKQQXQQAHHSRSELSFPXHAPKVQSADHCGMLQLSDEVLAHNILSRLSPRDVASIGSVCTRMHELTKNDHLRKMVCQNAWGRDATVKLEMSTKMVGWGRLARELTTLEAASWRKFTVGGRVEPSRCNFSACAVGNRLVLFGGEGVNMQPMDDTFVLNMEAARPEWRRVKVSASPPGRWGHTLSWLNGSWLVVFGGCGQQGLLNDVFVLDLDAQQPTWREVASEGPPLPRSWHSSCTLDGSKLVVSGGCTESGVLLSDTFLLDLTKEKPAWREIPTSWSPPSRLGHTMSVYGTTKLLMFGGLAKSGSLRLRSSDAYTMDVGEDSPQWRQLATTGFPNVGPPPRLDHVAVSLPCGRIIIFGGSIAGLHSPAQLFLVDPAEEKPTWRILNVPGKPPKFAWGHSTCVVGGTRVLVLGGHTGEEWILNELHELCLASRPDDDDDDRY

SEQ ID NO: 4551 - protein, 216 aa, Zea mays
  UNSURE (1)..(216): unsure at all Xaa locations
  Clone ID: PAT_MRT4577_134651C.1.pep
  unsure (1)..(216): unsure at all Xaa locations
LQMLLRLSASAATATIXPECSQAPIACLLPPYLAEPVASVCASGSLQPYRIQHASAAGILPLSPLVLQQSSALLQRLPXLVHLLXAQNIRAQQVQQLVLPNLAXAYSQEQQCLPFNRLGSLNSASYLQQQQLPFSQLPGAYPQQFLAFNQTSSIGTSPAYLQQXQLLPFSPLAGGSPATFLTHPRWWPVYQHVGXPNAGTLLQLQQLVAFNQLALT

SEQ ID NO: 4552 - protein, 144 aa, Zea mays
  UNSURE (1)..(144): unsure at all Xaa locations
  Clone ID: PAT_MRT4577_13487C.1.pep
  unsure (1)..(144): unsure at all Xaa locations
NIRAHQLRQLVLPNLADYSQQQQLLPFNQLARLXNSVSYSQHQQLPFRRLPVAYPQQCLPCNQLAGLNSPAYLQQQHLLPFSQIAGVSPATFLTQPQMMPFYQHAEPNAGTLLQLHPXLPFNQLASTNLAAFYQQPMIXGGALF

SEQ ID NO: 4553 - protein, 96 aa, Zea mays
  Clone ID: PAT_MRT4577_135032C.1.pep
MDTDIGSVDGAASNQTVGCPASAPGCPMASTPAQPAATLSAGEASLRRHSSRCLVQVGVNDVFAVSGDLNLTLVDHLIDEPGLLLDGCCNELNAGY

SEQ ID NO: 4554 - protein, 55 aa, Zea mays
  Clone ID: PAT_MRT4577_135057C.1.pep
NFPHSPVAAAPVAAIDASGAGSKVYKGAAVRKAVGPRNKSVTRSVKAGLQFPVGR

SEQ ID NO: 4555 - protein, 97 aa, Zea mays
  Clone ID: PAT_MRT4577_135079C.1.pep
RFQVAQSNYNAQLLIIQQTRDTTFRPPGTFDLEPKLTRSYHVLNKREHSVAGTRFTFKRTRTLTRRSTLKQTFGKSKTIPDPQANARYVLIAQGPAT

SEQ ID NO: 4556 - protein, 115 aa, Zea mays
  Clone ID: PAT_MRT4577_135081C.1.pep
LPPPKKRFFLMGGPFMAATFFPPVYKLPPPMDPFGGPSHRRAVGVYFSVAGQGHFFGIFVPDSPRVGRSMKGLSKACSSPGKLLLISPWRLVIKGDLWNFNPGCLIRQTAPCLYN

SEQ ID NO: 4557 - protein, 611 aa, Zea mays
  Clone ID: PAT_MRT4577_135170C.1.pep
MATMESLIGLVNRIQRACTVLGDHGGGGGEGSLWEALPSVAVVGGQSSGKSSVLESIVGRDFLPRGSGIVTRRPLVLQLHKTDGGHEYAEFLHAPRKRFTDFAAVRKEIADETDRITGKTKAISNVPIHLSIYSPHVVNLTLIDLPGLTKVAVEGQAESIVQDIENMVRAYVDKPNCIILAISPANQDIATSDAIKLARDVDPSGDRTFGVLTKLDLMDKGTNAVDVLEGRQYRLQHPWVGIVNRSQADINKNVDMLSARRKEKEYFESSPEYGHLAHKMGAEYLAKLLSQHLEAVIRAKIPSIIALINKTIDEIEAQLDRLGRPIGGDAGAQLYTILDMCRAFDRVFKEHLDGGRPGGDRIYGVFDNQLPAALKKLPFDRHLSMQNVRKVISEADGYQPHLIAPEQGYRRLIDSSLSYFKGPAEASVDAVHLVLKELVRRSIAATEELKRFPTLQSDIAAAANDSLERFREDGRKTVLRLVEMEASYLTVEFFRKLPTEPEKAADKNTPVSDRYQDNHLRRIGSNVSSYINMVCETLRNTVPKAIVHCQVKEAKRNLLNRFYAHVGSKEKKQLSAMLDEDPALMEKRDALVKRLELYKSARNEIDSVAWK

SEQ ID NO: 4558 - protein, 119 aa, Zea mays
  UNSURE (1)..(119): unsure at all Xaa locations
  Clone ID: PAT_MRT4577_135239C.1.pep
  unsure (1)..(119): unsure at all Xaa locations
LSPAVSPVCENPRLLSYRIQXAISAGILPXHPXFLQQSSALXQQLPLVHLLAQNIRAQQLQQLVLANLAVYSKQQQFLSFNQLAALNSAYYLTQQTPFSQLAAVFTQQFLPFNQLEVFN

SEQ ID NO: 4559 - protein, 52 aa, Zea mays
  UNSURE (1)..(52): unsure at all Xaa locations
  Clone ID: PAT_MRT4577_135272C.1.pep
  unsure (1)..(52): unsure at all Xaa locations
MAAADVEYRRLVXGLAWATSNESLENAFTSYGEILDCKVITDRETVRYRGFK

SEQ ID NO: 4560 - protein, 240 aa, Zea mays
  Clone ID: PAT_MRT4577_135567C.1.pep
MAAAPFAIAGRLSPVARLPVRAWRPAHGFASSGRARSLAVASAAQENRDNSVDVQVSQNGGNRQQGNAVQRRPRRATALDISPSPFGLVDPMSPMRTMRQMLDTMDRLFDDAVGFPMGTRRSPATTGDVRLPWDIVEDEKEVKMRIDMPGLARDEVKVMVEDDTLVIRGEHKKEEGAEGGSGGDGDGWWKQRSVSSYDMRLALPDECDKSKVRAELKNGVLLVTVPKTEVERKVIDVQVQ

SEQ ID NO: 4561 - protein, 123 aa, Zea mays
  Clone ID: PAT_MRT4577_135894C.1.pep
LPPVMPLGPMNPCMQFCMMHQGLASLMGGPSLMLQQLLAFPLQPMPVMMPPMMTPNPMSPLMMPGMMSPMVLPGMMSQMMMPQCPCDPVSQILLPQRFPFMFPPRALAIPPMFFQQPFVGGAF

SEQ ID NO: 4562 - protein, 609 aa, Zea mays
  Clone ID: PAT_MRT4577_1358C.1.pep
METLLAGNPANGVAKPTCNGVGALPVANSHAIIATPPAAATLAPAGATLGRHLARRLVQIGASDVFAVPGDFNLTLLDYLIAEPGLTLVGCCNELNAGYAADGYARSRGVGACAVTFTVGGLSVLNAIAGAYSENLPVVCIVGGPNSNDYGTNRILHHTIGLPDFSQELRCFQTITCYQAIINNLDDAHEQIDTAIATALRESKPVYISVSCNLAGLSHPTFSRDPVPMFISPRLSNKANLEYAVEAAADFLNKAVKPVMVGGPKIRVAKAREAFAAVADASGYPFAVMPAAKGLVPEHHPRFIGTYWGAVSTTFCAEIVESADAYLFAGPIFNDYSSVGYSLLLKREKAVIVQPDRMVVGDGPAFGCILMPEFLRALAKRLRRNTTAYDNYRRIFVPDREPPNGKPNEPLRVNVLFKHIKGMLSGDSAVVAETGDSWFNCQKLRLPEGCGYEFQMQYGSIGWSVGATLGYAQAAKDKRVIACIGDGSFQVTAQDVSTMLRCGQKSIIFLINNGGYTIEVEIHDGPYNVIKNWDYTGLVNAIHNSEGNCWTMKVRTEEQLKEAIAMATGDKKDCLCFIEVIVHKDDTSKELLEWGSRVSAANSRPPNPQ

SEQ ID NO: 4563 - protein, 592 aa, Zea mays
  UNSURE (1)..(592): unsure at all Xaa locations
  Clone ID: PAT_MRT4577_135914C.1.pep
  unsure (1)..(592): unsure at all Xaa locations
MGLCHGKPTQIPEAEAEEDPHVAXGAGDSGDGATSPSAAAPTAKPGTPKQPKFPFYLPSPLPPSSYKGSPANSSVSSTPARGGLKRPFPPPSPAKHIRALLARRHGSVKPNEVSIPEGGEPELGLDKSFGFSKHFFAKYDLGEEIGRGHFGYTCSAKAKKGEHKGQDVAVKVIPKAKMTTAIAIEDVRREVRILSSLTGHSNLVQFYDAFEDEDNVYIVMELCKGGELLDRILARGGKYSEEDAKVVMVQILSVVSFCHLQGVVHRDLKPENFLFSSKDENSPLKVIDFGLSDFVKPDERLNDIVGSAYYVAPEVLHRSYGTEADMWSIGVIAYILLCGSRPFWARTESGIFRAVLKAEPSFDEAPWPTLTAEAKDFVKRLLNKDYRKRMTAAQALSHPWIRNSQQVKVPLDMIIYKLMRAYISSSSLRKSALRALAKTLTTDQLFYVREQFELLGPNKNGYISLQNLKSALAKNSTDAMKDSRVVDFVNTVCALQYRKLDFEEFAASAISVYQMEALETWEQHARRAYELFDKEGNRPIVIEELASELGLGPSVPLHVVLQDWVRHADGKLSFLGFIKLLHGVSSRSIPKA

SEQ ID NO: 4564 - protein, 301 aa, Zea mays
  Clone ID: PAT_MRT4577_135917C.1.pep
ENSPLKVIDFGLSDFVKPDERLNDIVGSAYYVAPEVLHRSYAYILLCGSRPFWARTESGIFRAVLKAEPSFDEAPWPTLTAEAKDFVKRLLNKDYRKRMTAAQALSHPWIRNSQQVKVPLDMIIYKLMRAYISSSSLRKSALRALAKTLTTDQLFYVREQFELLGPNKNGYISLQNLKSALAKNSTDAMKDSRVVDFVNTVCALQYRKLDFEEFAASAISVYQMEALETWEQHARRAYELFDKEGNRPIVIEEVWSELGLGPSVPLHVVLQDWVRHADGKLSFLGFIKLLHGVSSRSIPKA

SEQ ID NO: 4565 - protein, 59 aa, Zea mays
  Clone ID: PAT_MRT4577_135919C.1.pep
MGLCHGKPTQIPEAEAEEDPHVASGAGDGGDGATSPSAAAPAAKPGTPKQPKFPFYLPS

SEQ ID NO: 4566 - protein, 51 aa, Zea mays
  Clone ID: PAT_MRT4577_135990C.1.pep
SSVLAPTCGSDSKVAMCQLLVMCSSPATADPCVKQHGLWIDVWCYSCQYLF

SEQ ID NO: 4567 - protein, 514 aa, Zea mays
  Clone ID: PAT_MRT4577_136067C.1.pep
MASPRGRMSFPLRSFLMICLMAQLGASNVVLMANNTTLSFDDVEAIFTPAVKGSGVNGVLYAVEPMDACSPLRTKAIGGSVSTFALVIRGGCHFDDKVRNAQNAGFKAAVVYDTEDNGILVSMAGSSSGVHIYAVFVSKASGEELKKYSGQTDAELWIIPTYANSAWSIMAISFISLLVMSAILAACFFARRHQIRRDRARLPQTREFHGMNSRLVKAMPSLIFTKVQEDDCTSATCAICLEDYSAGEKIRVLPCRHKFHAACVDLWLTSWRTFCPVCKRDANAGTPEPPVSESTPLLSSSAIRLPEPTASVSFWSTVAAAAAASPPRPISRHPSPSRSISRKHSVSGSSIPGTPIPRFHASSSSPTCTSGSSLDLANMPSSPWPRASHLASAHSSCGGRLSPPIHIRNTSAAHVSRSAYGSPSRYVGSSHMSRGSPSCYYLGSSSGQQHPYLRHCTLSGTSLFTMVPQSPQQNQLQHGGDSEKDLSAAAPFRQLYYLQHCPDSGTSSQSLPGC

SEQ ID NO: 4568 - protein, 514 aa, Zea mays
  Clone ID: PAT_MRT4577_136069C.1.pep
MASPRGRMSFPLRSFLMICLMAQLGASNVVLMANNTTLSFDDVEAIFTPAVKGSGVNGVLYAVEPMDACSPLKTKAIGGSVSPFALVIRGGCHFDDKVRNAQNAGFKAAVVYDTEDNGVLVSMAGSSSGVHIYAVFVSKASGEELKKYSGQTDAELWIIPTYENSAWSIMAISFVSLLVMSAILAACFFARRHQIRRDRARLPRARESHGMNSQLVKAIPSLIFTKVQEDDCTSATCAICLEDYSAGEKIRVLPCRHKFHAACVDLWLTSWRTFCPVCKRDANAGTPEPPVSESTPLLSSSAIRLPEPTASVSFRSTVAEAAAASPPRPISRHPSPSRSISRKHSVSGSSIPGTPIPRFHASSSSPTCTSGSSLDLANMSSSPWPRASHLASAHYSCSGRLSPPIHIRNTSAAHVSRSAYGSPSRYVGSSHMSRGSPSCYYLGSSSGQQHPYLRHCTLSGTSLFTMVPQSPQQNQLQHGGDSEKDLSAAAPFRQLYYLQHCPDSGTSSQSLPGC

SEQ ID NO: 4569 - protein, 42 aa, Zea mays
  Clone ID: PAT_MRT4577_136187C.1.pep
RVTVGFCPRVSVRSTFELGVGTPVVPFVCSRYETSPDNNAPN

SEQ ID NO: 4570 - protein, 160 aa, Zea mays
  Clone ID: PAT_MRT4577_136269C.1.pep
MASTNSWTVEIASPVAAPRLFRAAVMDWHTLAPKVASHVVASAHPVEGEGGVGSVRQFNFTSAMPFGFVKERLEFLDVDKCECKSTLVEGGGIGVAIETAASHVKVESAAGGGCVVKVDSTYKLLPGVEVQDEITKAKESVTNIFKAAEAYLVANPEAYN

SEQ ID NO: 4571 - protein, 134 aa, Zea mays
  UNSURE (1)..(134): unsure at all Xaa locations
  Clone ID: PAT_MRT4577_136321C.1.pep
  unsure (1)..(134): unsure at all Xaa locations
LANLTAYSKIHXFVPFTELVALSFVYYLQXQQLPLSQIVAANPQQFLPFHHLAALNSRAYSQQQQLIPFSQLAGVSPAAFLTQPQLLPFYQHAAPNAGTLLQLQQSPPLNQLALTNPAVLYQHPIIGGAHFSFL

SEQ ID NO: 4572 - protein, 83 aa, Zea mays
  UNSURE (1)..(83): unsure at all Xaa locations
  Clone ID: PAT_MRT4577_136356C.1.pep
  unsure (1)..(83): unsure at all Xaa locations
GSPGFRFVRERIEMAASDVDYRXFSDRLAWATDDHSLHNALSTYGEVLQSKIILDRXETQRLRCFSYVTFYTDDAMLNAHRRH

SEQ ID NO: 4573 - protein, 493 aa, Zea mays
  Clone ID: PAT_MRT4577_136542C.1.pep
IQSPHFHNSPRLPLRPSQISTTHRGHGRAMPPSADAMPAPGDAACAGDVRLISSKELREHASAADLWISISGDVYDVTPWLPHHPGGDLPLITLAGQDATDAFAAYHPPSARPLLRRFFVGRLSDYTVSPASADYRRLLAQLSSAGLFERVGPTPRVQLALMAVLFYAALYLVLACASASAHMLAGGLIGFVWIQSGWMGHDSGHHRITGHPLLDRVVQVLSGNCLTGLSIAWWKCNHNTHHIACNSLDHDPDLQHMPLFAVSPKLFGNIWSYFYQRTLAFDAASKFLISYQHWTFYPVMCIARINLLAQSAVFVLTEKRVPQRLLEIAGVAAFWAWYPLLVACLPNWWERVAFVLLSFTICGIQHVQFCLNHFSSDVYVGPPKGNDWFEKQTAGTLDILCPPWMDWFHGGLQFQIEHHLFPRLPRCHLRKVAPAVRDLCKKHGLTYSAASFWDANVLTWKTLRAAALQARSATGGGGGAPKNLVWEALNTHG

SEQ ID NO: 4574 - protein, 89 aa, Zea mays
  UNSURE (1)..(89): unsure at all Xaa locations
  Clone ID: PAT_MRT4577_136598C.1.pep
  unsure (1)..(89): unsure at all Xaa locations
LIYVYNPLQSRDVPSNSRVTFAEDHDYRSHMEYLWGGEGLTNYLVKWAPXVVERMRRTEKXVLFEDIVHSTTYXLACRVANANHMPPLK

SEQ ID NO: 4575 - protein, 374 aa, Zea mays
  UNSURE (1)..(374): unsure at all Xaa locations
  Clone ID: PAT_MRT4577_136624C.1.pep
  unsure (1)..(374): unsure at all Xaa locations
MASLPNGGGAAASGSCGARPVDKEVDFANYFCTYAYLYHQKEMLCDRVRMDAYHSAVFRNAPHFQGKVVLDVGTGSGILAIWSAQAGARKVYAVEATNMAEHARELARANGVTDIVEVIQGTVEDVDLPEKVDVIISEWMGYFLLRESMFDSVICARDRWLKPDGVMYPSHARMWLAPIRTGLGDKKREDFDIAMDDWSLFVQDTQTYYGVNMNALXRAEHEKYYLKSSIWNNLHPNQVIGQPAAIKEIDCLTATVDEIREVRAQVTLPIRMEARLSALAGWFDVHFRGSAQNPGVEEVELTTAPDEHGGTHWGQQVFLLTPPLSVTKGDNVNVSFSMVRSKENHRLMDMEFTYELHELSGRKHPAVKTKMYLE

SEQ ID NO: 4576 - protein, 486 aa, Zea mays
  Clone ID: PAT_MRT4577_136625C.1.pep
TNRSGMAGGDEGSLVPREVPGSYGMPFVSAIRDRLDFYYFQGQDKYFESRVDKYGSTVVRINVPPGPFMARDPRVVAVLDAKSFPVLFDVDKVEKKNLFTGTYMPSTSLTGGFRVCSYLDPSEPTHTKVKQLLFSLLASRKDAFIPAFRSHFSSLLATVESQPVLSKKSNFNTLNDATSFEFIGDAYFGVLPSASDLGTTGPTKAAKWLIFQLHPLVTLGLPMVLEEPLLHTVHLPPILVSGDYGTLYKYFSTVAKQALDTAEGLGLSREEACHNLLFATTFNSYGGLKVLFPGILANVASAGEKLHERLVAEIRGAVAEAGGKVTLAAVEKMELAKSVVWESLRLDPPVKFQYGHAKKDLQVQSHDAVFQVKKGEMLFGYQPCATKDPRVFGATAKEFVPGRFLGEEGSKLLQYVYWSNGRETENPTVDNKQCPGKNFVVLVGRLFLVELFLRYDTFTADIGKDLLGSSVVFTSVTKATSGPGSE

SEQ ID NO: 4577 - protein, 483 aa, Zea mays
  Clone ID: PAT_MRT4577_136626C.1.pep
MATSVRGFSSAPCRDVPGSYGLPLVGAVRDRLDFYYFQGQDKYFESRVERYGSTVVRMNVPPGPFMARDPRVVAVLDAKSFPVLFDMDKVEKKDLFTGTYMPSTSLTGGYRVCAYLDPSEPTHTKVKQLLFSLLLSRKDDVIPTFRSNFSSLLATVESELAKGGKAEFNKLNDVTSFDFIGEAYFGVRPSATELGKGGPSKAAKWLIWQLHPLVTLGLPMVLEEPLLHTFHLPPFLVKGDYRALYKYFSTVAKQALDTAEGLGLSREEACHNLLFATTFNSYGGLKVLFPGLLANVASGGEKLHERLVAEIRGAVADAGGKVTLAAVERMELAKSVVWESLRLDPPVKFQYGHAKKDLLVESHDAVFQVRKGEMLFGYQPCATKDPRVFGDTAGDFVPDRFLGEEGSKLLQYVYWSNGRETENPSVDNKQCPGKNFVVLVGRLLLVELFLRYDTFTAEVGKELLGTSVIFTGVTKATSGPGSE

SEQ ID NO: 4578 - protein, 439 aa, Zea mays
  UNSURE (1)..(439): unsure at all Xaa locations
  Clone ID: PAT_MRT4577_136628C.1.pep
  unsure (1)..(439): unsure at all Xaa locations
MAMANRLRLPLPQCLFLLHCYVVVAIVAHPSSPEQASPKANQHPLSYNNLRPEDFPNDRLYRAYHAIQSFKSTITSDPKNITGTWAGNDICGEKSYVGFYCATPTSRAKELTVTAVVLNGFGLRAPKLQGFVDQLPDVALFHAASNNFGNGGIPRLTGLEYSYDLSVDDNXLTSKFRTILKLLGELEPTFXVAGMIELRFRLGTGPDKGGGIIPGVADGKALLLNYNDLSGQLPADLGFSKLSFLALANNRLTGPIPPSVAQLKDSLLEVLLLNNQLSGCLAPELGMLAKAAVIDAGMNQLTGPIPSSFSCLISVEQLNLAGNRLYGHVPDALCRLAGPAGRLANLTLSGNYFTSVGPACAALIKDGVLNVKSNCIPGLANQRRPEECAAFIQSRPKTCPAAATTETTCPAPAANDAVAQGVRKVRDYFSYVTYATLHE

SEQ ID NO: 4579 - protein, 68 aa, Zea mays
  Clone ID: PAT_MRT4577_136636C.1.pep
MASSTMGLSSTDFSGKGVNVTSSSDFGEVRATMRKTSLKAKPAGASGSPRYGPDRALYLWPLSGEPTT

SEQ ID NO: 4580 - protein, 214 aa, Zea mays
  UNSURE (1)..(214): unsure at all Xaa locations
  Clone ID: PAT_MRT4577_136696C.1.pep
  unsure (1)..(214): unsure at all Xaa locations
RGWLQQVFVQTSGNVTFVADLCCSSNSYLELKRKTLKALCRAFPASIFSMRWQLYLDSWPMXVLTNTCCSHPLYRESELIEENCAGVRNAAQRKLFDELGIVADELPVDQFIPLGRMLYKAPSDGKWGEHELDYLLFMVRDVKLDPNPEEVADVKYMNRHQLKELLRKADAGEDGVKLSPWFRLVVDNFLMGWWDHVEQGTLQGAADMKTIHKL

SEQ ID NO: 4581 - protein, 131 aa, Zea mays
  UNSURE (1)..(131): unsure at all Xaa locations
  Clone ID: PAT_MRT4577_136782C.1.pep
  unsure (1)..(131): unsure at all Xaa locations
MAPIAVGDALPDGQLGWVDENDQLQQVSVHALAAGKKGMVXGVPGAFTPTWRNQHVPGFITQAEQLKAKGVDKIPLIRGNDPLVMKAGAKTYPENKHVKFLAGGSGGDTKAAXLKLDFTDKGLGVGSKKVG

SEQ ID NO: 4582 - protein, 905 aa, Zea mays
  Clone ID: PAT_MRT4577_136850C.1.pep
MRSWRARSAAPRRPTSSPCRSTTRRATPSSPSSRRSSSTCTPPPPLLLLPSPSTSSPLPRPPPPSPSPANSAPGSDEAKGTHQRARTRSVRRASPPPVLLPPAPIRPPRRSPHPMSAADPSAAPAAAADPDGPDSVRLTWNTWPRSKVEASRCVVPLAATISPTRVPDPSAASPPPLPYPPLRCKPPCSALLNPFARVDFAAKIWICPLCFSRNHFPPHYAAISESNVPAELFPQCSTVDYIVGGAGIPGVGGAPPPPPPVFLFVIDTCVIEEELEYVKMAMRKAVALLPEHALVGLVTFGTQVHLHELGFSDLSKIYVFRGTKEISKDQILDQLGLAGAGRPGFPKMPQQPGGPQVNGMHPPSTAGVNRFLLPVSDCEIALSTLLDELQPDQWPVEAGNRAIRCTGVALSVAAGLLGACMPGTGARIIALLGGPCTEGPGMIVSKDLSEPVRSHKDLDKDAAPHFQKAVKFYDGLAKQLVSQGHVLDVFASALDQVGLAEMKVAIERTGGLVVLSESFGHSVFKDSFKRIFEGGEQSLGLSFNGIIEINCSKDIKVQGIIGPCTSLEKKGAMCSDTVVGQGNTSAWKMCGLDRNTSLTVFFDVSPSERSSQPGNQNPHLYIQFVTSYQHPEGQMRIRVTTICRKWVDGSTNTEELVEGFDQETAAVVLARYISLKMEMEEEFDATRWLDRSLIRLCSRFGDYRKDDPSSFSLHSNFSLFPQFMFNLRRSQFVQVFNNSPDETAYFRMLLNRESITNSVAMIQPSLISFSFDSPPSPVFLDVASIAADRILLLDAYFSVVIFHGMTIAQWRNMGYQNQPEHEQFAQLLQAPHEEAQMIIKGRFPVPRLVVCDQHGSQARFLLAKLNPSATYNSAHDVAPGSDIIFTDDVSFQVFCEHLQRLAVQS

SEQ ID NO: 4583 - protein, 77 aa, Zea mays
  Clone ID: PAT_MRT4577_136888C.1.pep
ELFRVRRASSAITSCTHSLCRSEFDVLLEARGGKKAISLRSMMYEAPLGYSIEDVPPDVGVKKFQAAADSNCAKNLS

SEQ ID NO: 4584 - protein, 55 aa, Zea mays
  UNSURE (1)..(55): unsure at all Xaa locations
  Clone ID: PAT_MRT4577_137243C.1.pep
  unsure (1)..(55): unsure at all Xaa locations
AAIEKAGYTGQVVIGMDVAASEFCGEVDKTYDLNVXVANNDGSNKISGDSCIDLD

SEQ ID NO: 4585 - protein, 205 aa, Zea mays
  UNSURE (1)..(205): unsure at all Xaa locations
  Clone ID: PAT_MRT4577_137379C.1.pep
  unsure (1)..(205): unsure at all Xaa locations
MSPAEPTRDESVYMAKLAEQAERYEEMVEFMERVAKATGGAGPGEELSVEERNLLSVAYKNVIGARRASWRIISSIEQKEEGRGNDAHAATIRSYRSKIEAELAKICDGILALLDSHLVPSAGAAESKVFYLKMKGDYHRYLAEFKSGGXERKEAAESTMNAYKAAQDIALADLAPTHPIRLGLAFNFSVFYYEILNSPDRACNL

SEQ ID NO: 4586 - protein, 606 aa, Zea mays
  Clone ID: PAT_MRT4577_137423C.1.pep
MDTHIGSVNGAASNQTVGCPASAPGCPMASTPAQPAATLSAGEASLGRHLARRLVQVGVNDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVNNLDDAHEQIDTAIATALRESKPVYLSISCNLPGLPHPTFSRDPVPFFLTPRTSNKMGLEAAVEATVEFLNKAVKPVLVAGPKLRVAKAGKAFVDMVDASGYAYAVMPSAKGLVPETHPHFIGTYWGAVSTAFCAEIVESADAYLFAGPIFNDYSSVGYSFLLKKEKAIIVQPERVIVGNGPAFGCVMMKEFLSELAKRVNKNTTAYENYKRIFVPEGQPLESEPNEPLRVNVLFKHVQKMLTGDSAVIAETGDSWFNCQKLKLPEGCGYEFQMQYGSIGWSVGALLGYAQGANHKRVIAFIGDGSFQVTAQDVSTMLRCEQNSIIFLINNGGYTIEVEIHDGPYNVIKNWNYTGFVDAIHNGLGKCWTSKVKSEEELTAAIETALGEKKDCLCFIEVIAHKDDTSKELLEWGSRVSAANSRPPNPQ

SEQ ID NO: 4587 - protein, 168 aa, Zea mays
  UNSURE (1)..(168): unsure at all Xaa locations
  Clone ID: PAT_MRT4577_137441C.1.pep
  unsure (1)..(168): unsure at all Xaa locations
MDAIGAGSKGNKGXGGRKGGGPMKKWGTRAVKAGLQFPVGRXIGRYLKRGRDAHRVGTGAPVYLAAVLEYLAAEGLEVAGNAGKDNKKTRIIPRHGLLGIRNDEELGKRLGGVTIGHGGVLPNIHSVLLRKKAAGEAGSGGSEEPKAPKKXAKAPKKGKWGLHLRCVL

SEQ ID NO: 4588 - protein, 94 aa, Zea mays
  UNSURE (1)..(94): unsure at all Xaa locations
  Clone ID: PAT_MRT4577_137459C.1.pep
  unsure (1)..(94): unsure at all Xaa locations
YGLGQLPHAFARLSAVVRGTYMLSQAXCKVEFGGIGKSYGVTSERETARCMKIICDPSYLPCKVKKVGRVAHAICITKHPIPDTIDSHSVQIIL

SEQ ID NO: 4589 - protein, 47 aa, Zea mays
  Clone ID: PAT_MRT4577_137464C.1.pep
MAANKGMVAGSHNRNEFVMIRHDGDAPVPAKPTKSANGQVCQICGDT

SEQ ID NO: 4590 - protein, 1074 aa, Zea mays
  Clone ID: PAT_MRT4577_137469C.1.pep
MAANKGMVAGSHNRNEFVMIRHDGDAPVPAKPTKSANGQVCQICGDTVGVSATGDVFVACNECAFPVCRPCYEYERKEGNQCCPQCKTRYKRQKGSPRVHGDDEEEDVDDLDNEFNYKQGNGKGPEWQLQGDDADLSSSARHDPHHRIPRLTSGQQISGEIPDASPDRHSIRSPTSSYVDPSVPVPVRIVDPSKDLNSYGLNSVDWKERVESWRVKQDKNMLQVTNKYPEARGDMEGTGSNGEDMQMVDDARLPLSRIVPISSNQLNLYRIVIILRLIILCFFFQYRISHPVRNAYGLWLVSVICEVWFALSWLLDQFPKWYPINRETYLDRLALRYDREGEPSQLAPIDVFVSTVDPLKEPPLITANTVLSILAVDYPVDKVSCYVSDDGSAMLTFESLSETAEFARKWVPFCKKHNIEPRAPEFYFAQKIDYLKDKIQPSFVKERRAMKREYEEFKIRINALVAKAQKVPEEGWTMADGTAWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDLHDRYANRNIVFFDINMKGLDGIQGPVYVGTGCCFNRQALYGYDPVLTEADLEPNIVVKSCCGRRKRKNKSYMDSQSRIMKRTESSAPIFNMEDIEEGIEGYEDERSVLMSQRKLEKRFGQSPIFIASTFMTQGGIPPSTNPASLLKEAIHVISCGYEDKTEWGKEIGWIYGSVTEDILTGFKMHARGWQSIYCMPPRPCFKGSAPINLSDRLNQVLRWALGSVEILLSRHCPIWYGYNGRLKLLERLAYINTIVYPITSVPLIAYCVLPAICLLTNKFIIPEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQKAAALGQCGVNC

SEQ ID NO: 4591 - protein, 1075 aa, Zea mays
  Clone ID: PAT_MRT4577_137470C.1.pep
MAANKGMVAGSHNRNEFVMIRHDGDAPGSAKPTKSANGQVCQICGDSVGVSATGDVFVACNECAFPVCRPCYEYERKEGNQCCPQCKTRYKRQKGSPRVHGDEDEEDVDDLDNEFNYKQGNGKGPEWQLQGDDADLSSSARHEPHHRIPRLTSGQQISGEIPDASPDRHSIRSPTSSYVDPSVPVPVRIVDPSKDLNSYGLNSVDWKERVESWRVKQDKNMMQVTNKYPEARGGDMEGTGSNGEDMQMVDDARLPLSRIVPISSNQLNLYRVVIILRLIILCFFFQYRVSHPVRNAYGLWLVSVICEVWFALSWLLDQFPKWYPINRETYLDRLALRYDREGEPSQLAPIDVFVSTVDPLKEPPLITANTVLSILSVDYPVDKVSCYVSDDGSAMLTFESLSETAEFARKWVPFCKKHNIEPRAPEFYFAQKIDYLKDKIQPSFVKERRAMKREYEEFKVRINALVAKAQKVPEEGWTMADGTAWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDLHDRYANRNIVFFDINMKGLDGIQGPVYVGTGCCFNRQALYGYDPVLTEADLEPNIVIKSCCGRRKKKNKSYMDSQSRIMKRTESSAPIFNMEDIEEGIEGYEDERSVLMSQRKLEKRFGQSPIFIASTFMTQGGIPPSTNPASLLKEAIHVISCGYEDKTEWGKEIGWIYGSVTEDILTGFKMHARGWQSIYCMPPRPCFKGSAPINLSDRLNQVLRWALGSVEILLSRHCPIWYGYNGRLKLLERLAYINTIVYPITSIPLIAYCVLPAICLLTNKFIIPEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQKAAALGQCGVNC

SEQ ID NO: 4592 - protein, 240 aa, Zea mays
  UNSURE (1)..(240): unsure at all Xaa locations
  Clone ID: PAT_MRT4577_137504C.1.pep
  unsure (1)..(240): unsure at all Xaa locations
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYXDSTLIMQLLRDNLTLWTLI

SEQ ID NO: 4593 - protein, 377 aa, Zea mays
  UNSURE (1)..(377): unsure at all Xaa locations
  Clone ID: PAT_MRT4577_137832C.1.pep
  unsure (1)..(377): unsure at all Xaa locations
MDVDRTGGLELPPGFRFHPSDFEIVNDYLTKKVHDRDYSCIAIADADLNKTEPWDLPKVAKMGEKEWYFFYQKDRKYPTGLRANRATEAGYWKATGKDKEVYDPLAAEGLLLVGMKKTLVFYKGRAPRGDKTNWVMHEYRLEGSGRLPASPXPHPAQPPTXAAMMKASASACKDEWVVCRVFNKTTGIKKTAAPAYQVAMAGAEMDQNQNNIPAIPIPMPLQLPLPVPMQMQFPILPDFAMDPVAPYYPNPNAGAGMMPPMALAGMGGAGGLQINGALFGNPVPAPLPMNFYHHQMGMGAAAGQVDMGAAAGQMDMGAAGAGAGGFDVAAPESRPSSMVSQKDEQANAAEISSMMSVTGPGSATTTIEMDGIWKYKY

SEQ ID NO: 4594 - protein, 530 aa, Zea mays
  Clone ID: PAT_MRT4577_137888C.1.pep
MAAAPPPKADELQPFPPKEQLPGVAFCITSPPPWPEAILLGFQHFVVMLGTTVIIPSALVPQMGGGNEEKARVVQTILFVAGINTLFQTLFGTRLPVVMGGSYVFVGPTISIVLAGRYSNEADPHEKFLRTMRGTQGALLVASTIQIILGFSGLWRNVVKLLSPLAAVPLVSLVGFGLYELGFPGVAKCVEVGLPELLLLVVFSQYLPQVLDFGKSVFSRFSVLFTVAIVWLYAYILTIGGAYKNSPPKTQVHCRVDRSGLISGAPWISVPYPFQWGAPTFDAGEAFAMMMTSFIALVESTGAFIGASRYASATMIPPSIISRGVGWQGIGLLLDSFFGTANGTSVSVENIGLLALTRIGSRRVVQISAGFMIFFSVLGKFGALFASIPLPVFAGMYCLFFGYVGGVGLSLLQFCNLNSFRTKFIMGFAFFMGLSVPQYFNEYTAVASYGPVHTGARWFNDMINVPFTSKPFVAGLVAYILDNTLQVKESAVRKDRGNHWWEKFRSFKKDARSQEFYSLPFNLNKFFPSV

SEQ ID NO: 4595 - protein, 447 aa, Zea mays
  UNSURE (1)..(447): unsure at all Xaa locations
  Clone ID: PAT_MRT4577_138175C.1.pep
  unsure (1)..(447): unsure at all Xaa locations
EQTRRNKPSWAASPFRSPWRRTTSRSPPPPDPPPPPPRRLASTPPRPSLPPDPXQHHGNNAHRRGPHHHHQPHHHPHYHPHQHYQPRHQHHQAQAEDEGSAAATAEDREGPAGAVQAQHRLPEPEARKLVKQVEFYFSDINLATTEHLMKFIAKDPDGFVPISVVASFRKIREIVYDRSLLVAALRTSSELVVSEDGKHVKRLQPFNAEEVQSRIVVAENLPEDQKHQTLMKIFSAVGNVKSIRTCYPQDISPAAANRTSRIEMIFANKLHSFVEYSAVEDAEKAVAEFGGGGNWREGIRVRSLLGCLKHGLGQGRKGGDEEYAADEDGPDTTDHPRDFGTDVTAQISEAHFDHQAEDGTHDKGGMRQQGRGRGRGGRGRGRGQHYGHNSRDGHHPIGTPPSEHPAVPKPPPGPRMPDGTKGFTMGRGKPLSITIDAAANPTTTDAA

SEQ ID NO: 4596 - protein, 103 aa, Zea mays; identical to SEQ ID NO: 3555
  Clone ID: PAT_MRT4577_138176C.1.pep

SEQ ID NO: 4597 - protein, 103 aa, Zea mays; identical to SEQ ID NO: 3555
  Clone ID: PAT_MRT4577_138178C.1.pep

SEQ ID NO: 4598 - protein, 81 aa, Zea mays
  UNSURE (1)..(81): unsure at all Xaa locations
  Clone ID: PAT_MRT4577_138415C.1.pep
  unsure (1)..(81): unsure at all Xaa locations
MASIAVCDXLSDGXLGWFDENDQLQQVSVHALVCGKKVILFCVLGAFXPTCSNQHVPGFITQAEQLIAKGVDEILLISVND

SEQ ID NO: 4599 - protein, 83 aa, Zea mays
  Clone ID: PAT_MRT4577_138453C.1.pep
GTGGIHRWGPPGQVILFAPVMFTLVQRVYFRSFRLLLPICVFNSKVALCQLLGLCLSWGPANPCFNQHGFWINGCCYPCRDLF

SEQ ID NO: 4600 - protein, 104 aa, Zea mays
  Clone ID: PAT_MRT4577_13848C.1.pep
RWKLGARKGLQPTAAAETRSASPAAWKKSRVEETRSGPNPGPFIGCCPGCPRARGTRNGGQPKGGEQSQAGVKDVMSKITSGSSRKVLKETRHQAGGPRNTSQS

SEQ ID NO: 4601 - protein, 155 aa, Zea mays
  UNSURE (1)..(155): unsure at all Xaa locations
  Clone ID: PAT_MRT4577_138492C.1.pep
  unsure (1)..(155): unsure at all Xaa locations
EHHFESKADAGACKTYPQQAGTVRNNGFIDIKNRPCKAVEVSTSNTDTNGHIKCHFVAIHIFNVKKLEDIVPSSHNCDIPHVNRTEYQLIDISEDAFASLLTSNGNTRDDLRLPTDETLVDHIKEGFESGKDLVXTVQTAMSDEXICALDDDGPK

SEQ ID NO: 4602 - protein, 75 aa, Zea mays
  UNSURE (1)..(75): unsure at all Xaa locations
  Clone ID: PAT_MRT4577_13850C.1.pep
  unsure (1)..(75): unsure at all Xaa locations
AIHYDPLPRIEQLSXENPMLRLRRCTLGISHPESTDMQARTIFEPAITMTNQGVQVYPXIMATLVGTPQELGHQV

SEQ ID NO: 4603 - protein, 36 aa, Zea mays
  Clone ID: PAT_MRT4577_138513C.1.pep
GKKVKGRGVRALTSEAVTLGVTTPPAALNAPIQGGS

SEQ ID NO: 4604 - protein, 104 aa, Zea mays
  UNSURE (1)..(104): unsure at all Xaa locations
  Clone ID: PAT_MRT4577_138599C.1.pep
  unsure (1)..(104): unsure at all Xaa locations
PSLCSLHSSLHLQHCRLIHLLEWLALSAADASFFSAGGLEGYEKRLEITFSEAPRSGDPHGRGERALYRAQIDSDLDLARCTIASELSHKDFDXMVLSESSYVY

SEQ ID NO: 4605 - protein, 39 aa, Zea mays
  Clone ID: PAT_MRT4577_138634C.1.pep
GTGGLVLVDWRLVDPSYAAATLLQHLDEFRGQHCLQPTE

SEQ ID NO: 4606 - protein, 441 aa, Zea mays
  Clone ID: PAT_MRT4577_138695C.1.pep
APGSNRGGQSRVSTRGGVAGPGSPRASPAATAFAALRRRWRWAPPGSPTLERAARAFLLASAALVLACALYLYVLRYVGRGGRAFAAAGFVGGSVLGLGGEPCDVFDGAWVPDDTGRHPLYNSSECPFAERGFDCLANGRNDTGYLKWRWKPRRCGVPRFAARTALERLRGKRVVFVGDSMSRSQWESFICMLMAGVDDPRTVFEVNGNEITKTIRHLAVRFASHGLTVEFFRSVFLVQEHPAPRHAPKRVKSTLRLDRMDNFSRKWVNSDVLIFNTGHWWTPTKLFDTGCYFQAGRSLKLGTSIDAGFRMALETWASWVQKRVDLNRTHVFFRTYEPSHWGDTSQKVCEVTEQPSSEAKGNDKSEFGAILSDVVTNMKVPITVLNVTLMGAFRSDAHVGTWSYPPTILDCSHWCLPGVPDAWNELVFSYLLTNGWRNMPG

SEQ ID NO: 4607 - protein, 93 aa, Zea mays
  Clone ID: PAT_MRT4577_138729C.1.pep
QNYAHAQSHLPHSSHPNGHLTVQSSTYLVRRPCPAPEAKLYFGSEPTDAPAIPTNTRALELLRRHLPETYGEDAAAKDSGNRVPHESAHAFPH

SEQ ID NO: 4608 - protein, 654 aa, Zea mays
  UNSURE (1)..(654): unsure at all Xaa locations
  Clone ID: PAT_MRT4577_138761C.1.pep
  unsure (1)..(654): unsure at all Xaa locations
QRPADNCYGCSIYHASVIETDPAEYCIVAPDTEIFCDXEEEEEEDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKSRSHVIVMGATNRPNSIDPALRRFGRFDREIDIGVPDEVGRLEVLRIHTKNMKLAEDVNLELISKDTHGYVGADLAALCTEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRMKDNPEAMEEDEVDEIAEIKAAHFEESMKYARRSVSDADIRKYQAFAQTLQQSRGFGSEFRFSEQSATAGAAAADPFASAGAAADDDDLYS

SEQ ID NO: 4609 - protein, 182 aa, Zea mays
  Clone ID: PAT_MRT4577_138762C.1.pep
EVIAVNSVFEMHRLLAQPGALEKVLGTVRAVRPRIVTVVEQEANHNSGTFLDRFTESLHYYSTMFDSLEGGSSGGPSEVSSGAAAAPAAAGTDQVMSEVYLGRQICNVVACEGAERTERHETLGQWRNRLGNAGFETVHLGSNAYKQASTLLALFAGGDGYKVEEKEGCLTLGWHTRPLIAT

SEQ ID NO: 4610 - protein, 402 aa, Zea mays
  UNSURE (1)..(402): unsure at all Xaa locations
  Clone ID: PAT_MRT4577_138763C.1.pep
  unsure (1)..(402): unsure at all Xaa locations
GRVGVGADLAALCXEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRRKDNPEAMEEDEVDEIAEIRAPHFEESMKYARRSVSDADIRKYQAFAQTLQQSRGFGSEFRFSDQPATAGAAAAADPFASAGAAADDDDLYS

SEQ ID NO: 4611 - protein, 474 aa, Zea mays
  Clone ID: PAT_MRT4577_138802C.1.pep
MNLAVAAALPSVTPRTGVVLPRSSRRHCPRGVVPLAASSSVSSFTSPSAAAAPIYAPTPQDRSLRTPHSGYHFDGTARPFFEGWYFKVSIPECRQSFCFMYSVENPLFRDGMSDLDKLLYGPRFTGVGAQILGADDKYICQFSEKSNNFWGSRHELMLGNTFISNKESTPPQGEVPPQDFSRRILEGFQVTPIWHQGFIRDDGRSNYVPNVQTARWEYSTRPVYGWGDVKSKQLSTAGWLAAFPFFEPHWQICMASGLSTGWIEWDGERFEFENAPSYSEKNWGGGFPRKWYWIQCNVFPGASGEVSLTAAGGLRKIGLGDTYESPSLIGIHYEGQFFEFVPWTGTVSWDIGLWGLWKMSGENKTHLVEIEATTAESGTALRAPTIEAGLVPACKDTCYGDLRLQLWEKKYDGSKGEMILDATSNMAALEVGGGPWFNGWKGTTVVNEVVNNIVGTPVDVESLLPIPFLKPPGL

SEQ ID NO: 4612 - protein, 347 aa, Zea mays
  Clone ID: PAT_MRT4577_138883C.1.pep
VGTGGSLSLSAVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATVTDLQLNVMGSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEASPQAVQAKEGESNPLISDSLSAAENGGSATDDEPLKVPMWSSKYSKA

SEQ ID NO: 4613 - protein, 356 aa, Zea mays
  Clone ID: PAT_MRT4577_138888C.1.pep
MGVAGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATVTDLQLNVMGSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLAFGYVLLHDPFSWRNILGILIAVIGMVLYSYFCTRETQQKPAEASPQAIQAKEGESSPLILDSLSAAENGGSATDDEPLKVPMWSSKYSKA

SEQ ID NO: 4614 - protein, 175 aa, Zea mays
  Clone ID: PAT_MRT4577_13898C.1.pep
APSVRRSQQSSTTVTALRDHGSARSAVQGGKILFGGSAIESEGNFVQPTIVEITRSAPVVKEELFGPVLYVMKFQTLKEAIEINNSVPQGLSSFIFTKWPDIIFKWLGPHGSDCGIVNVNIPTNGAEIGGAFGGEKAAGGGREAGSDSWKQYMRRATCTINYGSELPLAQGINFG

SEQ ID NO: 4615 - protein, 189 aa, Zea mays
  UNSURE (1)..(189): unsure at all Xaa locations
  Clone ID: PAT_MRT4577_13900C.1.pep
  unsure (1)..(189): unsure at all Xaa locations
LVEVYKQVQIGDPLEKGTLLGPLHTPASKENFLKGIQTIKSQGGKILFGGSAIESEGNFVQPTIVEITRSAPVVKEEHFGPLLWPGRVQTLKEXIEINNSVPQGLSSSIFTKRPDIIFKWLGPHGSDCGIVNVNIPTNGAEIGGAFGGEKATGGGREAGSDSWKQYMRRATCTINYGSELPLAQGINFG

SEQ ID NO: 4616 - protein, 74 aa, Zea mays
  UNSURE (1)..(74): unsure at all Xaa locations
  Clone ID: PAT_MRT4577_13901C.1.pep
  unsure (1)..(74): unsure at all Xaa locations
PGVGRAVGGPLAGLAALPGPRGVAERVLPVRPPPRPAHHTSLGCRCSVGGPAERGGAAGVSVGGGALGVRXGPA

SEQ ID NO: 4617 - protein, 263 aa, Zea mays
  UNSURE (1)..(263): unsure at all Xaa locations
  Clone ID: PAT_MRT4577_139031C.1.pep
  unsure (1)..(263): unsure at all Xaa locations
MAPPSMCLAAKGVLPFSALISSGVTQRPVSVTASLEHKTSDARRKFLKLALGNIGVGLPTLLGVKKALADEQGISSSRMSYSRFLEYLDKGRVKKVDLFENGTIAIVEAISPELGNRVQRVRVQLPGLSQELLQKLREKNIDFAAHSNQEDSGSLLFNLIGNLAFPLILIGGLFLLSRRAQGGLGGPNGPGFPLGFGQSRAKFQMEPNTGVTFDDVAGVDEAKQDFMEVVEFLKKPEXFTAVGARIPXSVLLCRPPGTXKLCL

SEQ ID NO: 4618 - protein, 252 aa, Zea mays
  UNSURE (1)..(252): unsure at all Xaa locations
  Clone ID: PAT_MRT4577_139032C.1.pep
  unsure (1)..(252): unsure at all Xaa locations
MAPPSMCLAAKGVLPFSALISSGVTQRPVSVTASLEHKTSDARRKFLKLALGNIGVGLPTLLGVKKALADEQGISSSRMSYSRFLEYLDKGRVKKVDLFENGTIAIVEAISPELGNRVQRVRVQLPGLSQELLQKLREKNIDFAAHSNQEDSGSLLFNLIGNLAFPLILIGGLFLLSRRAQGGLGGPNGPGFPLGFGQSRAKFQMEPNTGVTFDDVAGVDEAKQDFMGVVEFLKKPERXTAXGARFPKGFLL

SEQ ID NO: 4619 - protein, 678 aa, Zea mays
  UNSURE (1)..(678): unsure at all Xaa locations
  Clone ID: PAT_MRT4577_139033C.1.pep
  unsure (1)..(678): unsure at all Xaa locations
MALPSMCLAAKGVLPFSARISSGVTQRPVSVTASLEHKTSDARRKFLKLALGNLGVGLPTLLGAKKALADEQGVSSSRMSYSRFLEYLDKGRVKKVDLFENGTIAIVEAISPELGNRVQRVRVQLPGLSQELLQKLREKNIDFAAHSNQEDSGSLLFNLIGNLAFPLILIGGLFLLSRRAQGGLGGPNGPGFPLGFGQSRAKFQMEPNTGVTFDDVAGVDEAKQXDFMEVVEFLKKPERFTAVGARIPKGVLLVGPPGTGKTLLAKAIAGEAGVPFFSISGSEFVEMFVGVGASRVRDLFKKAKENAPCIVFVDEIDAVGRQRGTGIGGGNDEREQTLNQLLTEMDGFEGNTGIIVIAATNRADILDSALLRPGRFDRQVSVDVPDVRGRTEILKVHGSNKKFDSDVSLDVIAMRTPGFSGADLANLLNEAAILAGRRGRTAISSKEIDDSIDRIVAGMEGTVMTDGKSKSLVAYHEVGHAICGTLTPGHDPVQKVTLVPRGQARGLTWFIPMDDPTLISRQQLFARIVGGLGGRAAEEVIFGEPEVTTGAAGDLQQITGLAKQMVVTFGMSEIGPWSLMEGGAQSGDVIMRMMARNSMSEKLAEDIDSAVKQLSDEAYEIALRHIRNNREAIDKIVEVLIEKETVTGDEFRAILSEFAEIPVENRVPPATPAAALPA

SEQ ID NO: 4620 - protein, 71 aa, Zea mays
  Clone ID: PAT_MRT4577_139155C.1.pep
GVFFWLFFFFFPTPKKQILFINKMGSQIFFHTFMLIGGDPTDPLKLVTYLFKLIPLVAPLEVHILTNHKFL

SEQ ID NO: 4621 - protein, 206 aa, Zea mays
  UNSURE (1)..(206): unsure at all Xaa locations
  Clone ID: PAT_MRT4577_139235C.1.pep
  unsure (1)..(206): unsure at all Xaa locations
PPPAAYCIFALTHYSRCYCTGVMLDSRVLXTRGLNKEHEGPAEATGEDCSDDPPDERRPFRALWDDGLIRTTTGNRAFGALTGAMDGGLDIAHSEKRIAGLNKDDKQLDADIHRKYIYGGHVADYMTNLADHEPDKNQSHFSEYINKGIEADDMEAMNKKVHAGIRADPSVVKATKHPPKEHKRYHPKKLSYQQRKAXLIERLKPT

SEQ ID NO: 4622 - protein, 247 aa, Zea mays
  Clone ID: PAT_MRT4577_139270C.1.pep
QLWSRCRENGLKNIHQFSWPEHCKNHLSRILTLGMRSPAVGSEEERSKAPISGRKHIIVISVDSVNKENLVRIIRNAIEAAHTENTPASTGFVLSTSLTISEICSLLVSVGMHPAGFDAFICNSGSSIYYPSYSGNTPSNSRVTHVIDRNHQSHIEYRWGGEGLRKYLVKWATSVVERKGRIERQMIFEDSEHSSTYCLAFKVVNPNHLPPLKELRKLMRIQSLRCNALYNHSATRLSVTPIHASRS

SEQ ID NO: 4623 - protein, 104 aa, Zea mays
  Clone ID: PAT_MRT4577_139347C.1.pep
MDASGAGSMGKKGAAGRMAGIPRKMSVTLSVKAELMFHVGRIERYLKKVRFAQRVITVTRVYLDRVLEYLAVEVIELACIAANDFKMTRIILSDVLLAIRNDEE

SEQ ID NO: 4624 - protein, 99 aa, Zea mays
  Clone ID: PAT_MRT4577_139459C.1.pep
FQLLLSDSDEFLLLLRSPADVLLLIDSDEFRLLLPSPADVLLSQVNLTMFPSSEEQSLSDPAFWKSAEENTDNGGNPRLLSDSSFHSCNPGSAREPTRP

SEQ ID NO: 4625 - protein, 99 aa, Zea mays
  UNSURE (1)..(99): unsure at all Xaa locations
  Clone ID: PAT_MRT4577_139545C.1.pep
  unsure (1)..(99): unsure at all Xaa locations
VQRSSSQSARRAPGSRNKMSNRXTQSCYACPQAIRLRXQDIVSHNCNDGSIQEISEMSRILNTYELLELDYDGRRATMIXMMDAMSSLMRQRMEDMXRD

SEQ ID NO: 4626 - protein, 438 aa, Zea mays
  UNSURE (1)..(438): unsure at all Xaa locations
  Clone ID: PAT_MRT4577_139718C.1.pep
  unsure (1)..(438): unsure at all Xaa locations
RVYYGHPDVFDRXFHVTRGGVSKASKIINLSEDIFAGFNSTLREGNVTHHEYMQVGKGRDVGLNQISLFEAKIANGNGEQTLSRDIYRLGHRFDFFRMLSCYYTTIGFYFSTMITVWTVYVFLYGRLYLVLSGLDEALATGRRFVHNAPLQVALASESFVQLGFLMALPMMMEIGLERGFRTALSDFILMQLQLASVFFTFSLGTKTHYYGRTLLHGGAEYRATGRGFVVFHAKFADNYRLYSRSHFVKGIELMILLVVYEIFSQPYRGAVTYIFITVSMWFMVGTWLFAPFLFNPSGFEWQKIVDDWTDWHKWISNRGGIGVAPEKSWESWWEKEQEPLRYSGKRGTVVEILLALRFFIYQYGLVYHLNITKKITKDNQSVLVYCFSWVVIFVILLLMKTVSVGRRRFSAEFQLVFRLITALIFITFTAILVILIAI

SEQ ID NO: 4627 - protein, 330 aa, Zea mays
  Clone ID: PAT_MRT4577_139769C.1.pep
MPLPIDGRRERAVCVRGAGAGAMEINIVDKYEKLEKVGEGTYGKVYKAQDKATGQLVALKKTRLEMDEEGIPPTALREISLLNLLSHSIYIVRLLAVEQAAKNGKPVLYLVFEFLDTDLKKYLDVYRRGPSARPLPATLIKNFLYQLCKGVAHCHSHGVLHRDLKPQNLLVDKEKGILKIADLGLGRAFTVPMKSYTHEIVTLWYRAPEVLLGATHYSTGVDMWSVGCIFAEMARRQALFPGDSELQQLLHIFRLLGTPTEEQWPGVSDLRDWHEFPQWKPQGLARVVPTLEPEGVDLLSKMLQLDPSNRISALAAMEHPYFNSLDKSQF

SEQ ID NO: 4628 - protein, 46 aa, Zea mays
  UNSURE (1)..(46): unsure at all Xaa locations
  Clone ID: PAT_MRT4577_139867C.1.pep
  unsure (1)..(46): unsure at all Xaa locations
MAGAFRVLHLVRAFLRFLPXAPNANRNILFQKTAIYTVISLIIYLP

SEQ ID NO: 4629 - protein, 90 aa, Zea mays
  Clone ID: PAT_MRT4577_140013C.1.pep
CNCQQGGCASGGAKRHRKVLRDNIQGITKPAIRRLARMGGVKRISGLIYEETRGVLKIFLQNVIRDAVTYTQHARPKNRTRMDVVYPLKP

SEQ ID NO: 4630 - protein, 91 aa, Zea mays
  Clone ID: PAT_MRT4577_140093C.1.pep
RGIRQLRRETGRTYWWGPRAQDILFPPVMFPPVQRVYPRSSRLLWPICVFDSKAALCQLLDLCSPSARAAPCFNQHGMWIDGCCSPCQDLF

SEQ ID NO: 4631 - protein, 569 aa, Zea mays
  Clone ID: PAT_MRT4577_1400C.1.pep
MGPAVRSSVVIRATVVGLVLVGIALALPLAAALRPLREHVASIGAAASAGSWGDEHAFYKRDENDIGPYSWNITGTYKGSWTFAGATNGSSRFLEFVESKGDSVLELLSTPTKISGVHYVQGSVTFHDVIDNAHNGGVAQIRLEGVYIWPFRQLRMVANSGADGEPLQEEDYFLSNPYHLLRIFSSQVFQESSEEKNRRKNSLTYDMEKHCNTEIAAKVVRVSSNPNDGEHEKYRLEGLMESPAVDDDGECFSPILLNATSLNVEVYYNKAVNYTLMVTFISFLQVLLLIRQMEHSNTQSGAAKVSILMIGQQAIMDAYLCLLHLTAGILVESLFNAFATAAFFKFVVFSIFEMRYLLAIWKASRPLNSGEGWEIMRRELSVLYSRFYGILLGGILLMYELHNFLRPLLLLMYSFWVPQIVTNVIRDTRKPLHPQYILGMTVTRLAIPLYIFGCPSNFMRIEPDKKWSIAVTVFMGIQAAVLLLQHYLGSRCFIPRQILPEKYCYHRKVEDSTNQPIDCVICMTTIDLTQRTSEYMVAPCEHIFHSGCLQRWMDIKMECPTCRRSLPPA

SEQ ID NO: 4632 - protein, 54 aa, Zea mays
  UNSURE (1)..(54): unsure at all Xaa locations
  Clone ID: PAT_MRT4577_140129C.1.pep
  unsure (1)..(54): unsure at all Xaa locations
VPRHIQLGVRNDXELTKLTGGATIESXATMPNIHQHVLANKAAFSKASADDDNY

SEQ ID NO: 4633 - protein, 478 aa, Zea mays
  Clone ID: PAT_MRT4577_140198C.1.pep
MDAGDASTALALTAAEPSPPSPNRRGKRPTNPPKRFVHTPIPPSILSDPTLAAAATSLLPANYNFELHKTAHRIRSAAARRVALQLPEGLLLFALPLSHLLAPYLEPGADNDVLVLADATYGACCLADRPARALAADLLVHYGHSCLVPVTASLLPVLYVFVEIRVDAARLAAAVRAAFPDPAAAPRLAIAGTVQFIAAVHAAREMLTVEGYHDIVVPQAKPLSAGEILGCTAPTLKKSEEVGAVVFVADGRFHLEAFMIANPGVKAYRFDPFLGVLVLEEYDHVGMKQARKAAVLAARKAKSWGVVLGTLGRQGSTKVLDRVVEHLEEKELEHTVVLMSELSPARMELFGDSIDAWVQIACPRLSIDWGEGFKKPVLTTFEFDVALGYVPGWWEKGSRGCGSECGVGCCSGSGTRGNCNCSDGDYGGDYPMDYYSQDGGDWNSCYMKKKPSTGERKLRVRIGQRNSSRGEAWESGFS

SEQ ID NO: 4634 - protein, 324 aa, Zea mays
  Clone ID: PAT_MRT4577_140212C.1.pep
MPGDAYDLLCAEDDAAGSALLCTTDDDDGCCSAVEEDSAAAAASIAELIGGEAQYSPRPDYPDRLRSRSIDPAARAESVAWILKVQEYYGFLPLTAYLAVNYMDRFLSLHRLPQEDGWAMQLLAVTCLSLAAKMDRLVVVDCTALQVEGTSRYDCFEPGTVGRMELLVLMALNWRLRSVTPFTFVDFFACKVDPGGRHTRCLIARATQVILAAMHDVEFLDHCPSSMAAAAVLCAIGETPSLESVSPGAAVSWCIGLAEEGISSCYRLMQRLVIGNVRTRVASTTTITMAAVNLCCSDEALSSHSSATSSPPPAKRRKRSPTAT

SEQ ID NO: 4635 - protein, 72 aa, Zea mays
  UNSURE (1)..(72): unsure at all Xaa locations
  Clone ID: PAT_MRT4577_14036C.1.pep
  unsure (1)..(72): unsure at all Xaa locations
EALHLRGGMSGLGREHVKVCSYHNILVIKGEGXKDDSEDXAVLSPRYSVLIXLAPEVYRMDKIKAYIKNGVL

SEQ ID NO: 4636 - protein, 95 aa, Zea mays
  Clone ID: PAT_MRT4577_140424C.1.pep
AFLISSSPRSGKWRDAQANVPSARRLRAQPAFKNLMVRGILQFTPGIAFCYVLHRCENPNIRCPKSSRLLYLIDEIPGLLSFFLFFSDGLFIISF

SEQ ID NO: 4637 - protein, 208 aa, Zea mays
  UNSURE (1)..(208): unsure at all Xaa locations
  Clone ID: PAT_MRT4577_140503C.1.pep
  unsure (1)..(208): unsure at all Xaa locations
MVAAMESMVMDLSSXCFAGKAVNVPSSSAFGEARVTMRNTWACAKPAVASWSPWYGPDRVLYLGPLSGEPPSYLTCDFPGYYGWDAAGLSADPETFANKRELEVIHSRWAMLVALGCVFPXLLARNGVKFCDAVWLTAGSHIFSEGGLDYLVNSRLMHAXSILAIWVCQVVLRGAVEGYRISVGPVGEVLDPLYPGASFDPLXLSDYP

SEQ ID NO: 4638 - protein, 76 aa, Zea mays
  UNSURE (1)..(76): unsure at all Xaa locations
  Clone ID: PAT_MRT4577_140557C.1.pep
  unsure (1)..(76): unsure at all Xaa locations
NEWSAXVALWAWDIVVGGCAVCRSHIVDLCVXCHASRASATSDECTVAWGVCNHALHFRCIGMWLETRRVCPLDSS

SEQ ID NO: 4639 - protein, 505 aa, Zea mays
  UNSURE (1)..(505): unsure at all Xaa locations
  Clone ID: PAT_MRT4577_140694C.1.pep
  unsure (1)..(505): unsure at all Xaa locations
MASPAMVPLRQLFVDGEWRPPAQGRRLPVVNPTTEAHIGEIPAGTAEDVDAAVAAARAALKRNRGRDWARAPGAVRAKYLRAIAAKVIERKPELAKLEALDCGKPYDEAAWDMDDVAGCFEYFADQAEAXDCDKISPFSLPMETFKCHLXKRPIGVVGLITPWNYPLLMATWKVAPALAAGCTAVLKPSELASVTCLELADICKEVGLPSGVLNIVTGLGPDAGAPLSAHPDVDKVAFTGSFETGKKIMAAAAPMVKPVTLELGGKSPIVVFDDVDIDKAVEWTLFGCFWTNGQICSATSRLLIHTKIAKKFNERMVAWAKNIKVSDPLEEGCRLGPVVSEGQYEKIKKFISNAKSQGATILTGGVRPAHLEKGFFIEPTIITDITTSMEIWREEVFGPVLCVKEFSTEDEAIELANDTQYGLAGAVISGDRERCQRLSEEIDAGCIWVNCSQPCFCQAPWGGNKRSGFGRELGEGGIDNYLSVKQVTEYISDEPWGWYQSPSKL

SEQ ID NO: 4640 - protein, 477 aa, Zea mays
  UNSURE (1)..(477): unsure at all Xaa locations
  Clone ID: PAT_MRT4577_140696C.1.pep
  unsure (1)..(477): unsure at all Xaa locations
GRDWARAPGAVRAKYLRAIAAKVIERKQELAKLEALDCGKPYDEAAWDMDDVAGCFEYFADQAEALDKRQNSPVSLPMETFKCHLRREPIGVVGLITPWNYPLLMATWKVAPALAAGCAAVLKPSELASVTCLELADICKEVGLPPGVLNIVTGLGPDAGAPLSAHPDVDKVAFTGSFETGKKIMAAAAPMVKPVTLELGGKSPIVVFDDVDIDKAVEWTLFGCFWTNGQICSATSRLLVHTKIAKEFNERMVAWAKNIKVSDPLEEGCRLGPVVSEGQYEKIKKFISNAKSQGATILTGGVRPAHLEKGFFIEPTIITDITTSMEIWREEVFGPVLCVKEFSTEDEAIELANDTXELILFSAVSMSFLQASQVMCXHXMNLCQYPSFEFLXYGLAGAVISGDRERCQRLSEEIDAGCIWVNCSQPCFCQAPWGGNKRSGFGRELGEGGIDNYLSVKQVTEYISDEPWGWYQSPSKL

SEQ ID NO: 4641 - protein, 119 aa, Zea mays
  Clone ID: PAT_MRT4577_140714C.1.pep
PNLKNGTDPLLMPFNSYMADWSSDKITYTTLNTPKISTELPVKLHHDKSSSFEAPNLKEHESVFATHEMTVEATRKEDEHTSKSSFTFYNGVPDTAAQASKPKKTRTTTAKNTEKFDWE

SEQ ID NO: 4642 - protein, 85 aa, Zea mays
  Clone ID: PAT_MRT4577_140869C.1.pep
SDPPHQTPAAAASSLAHLLLCGSVKRRNRIANAAGGKRAKKGNWFKVSKLRPLMEALDPTAKEVNNLKLRRFLRTRDHDVVKASA

SEQ ID NO: 4643 - protein, 198 aa, Zea mays
  Clone ID: PAT_MRT4577_140882C.1.pep
MATPNPPPPQQDEPSSSADPKAKKDYSTAILERKKSPNRLVVDEATNDDNSVVALHPDTMERLQLFRGDTVLLKGKKRKDTICIVLADDTCEEPKVRMNKTVRKNLRVRLGDVVSVHQCPDVKYGKRVHILPIDDTVEGITGNLFDAFLKPYFLEAYRPLRKGDLFLVRGGMRSVELKVIETDPAEYCIVAPDTEIFC

SEQ ID NO: 4644 - protein, 32 aa, Zea mays
  UNSURE (1)..(32): unsure at all Xaa locations
  Clone ID: PAT_MRT4577_140895C.1.pep
  unsure (1)..(32): unsure at all Xaa locations
AXXSVGDHLKYQAXRCNFTLKKNYVSAIAIVF

SEQ ID NO: 4645 - protein, 554 aa, Zea mays
  UNSURE (1)..(554): unsure at all Xaa locations
  Clone ID: PAT_MRT4577_141052C.1.pep
  unsure (1)..(554): unsure at all Xaa locations
MGNACGGALRSKHQHSFKHAASSQRHHASSEYSASAAADDSPRKPPPPPATTDAHAPPPPPATAMRRGGAGAPPDLGSVLGHPTPNLRDLYALGRKLGQGQFGTTFLCTELATGIDYACKSISKRKLITREDVDDVRREIQIMHHLSGHTNVVAIKGAYEDQLYVHIXXXXXXXXXXXXXXXQRGHYSERKAAALTRIIVGVVEACHSLGVMHRDLKPENFLLANRDDDLSLKAIDFGLSVFFKPGQVFTDVVGSPYYVAPEVLLKSYGPAADVWTAGVILYILLSGVPPFWAETQQGIFDAVLKGAIDFDSDPWPVISDSAKDLIRRMLNPRSAERLTAHEVLCHPWIRDHGVAPDRPLDPAVLSRIKQFSAMNKLKKMALRVIAESLSEEEIAGLKEMFQTMDTDNSGAITYDEXXXXXXXXGSTLKDTEIRDLMDAADIDNSGTIDYIEFIAATLHLNKLEREEHLVAAFSYFDKDGSGYITVDELQQACKEHNMPXXXXXXXXXXXDQDNDGRIDYGEFVAMMTKGNMGVGRRTMRNSLNISMRDXPGAF

SEQ ID NO: 4646 - protein, 556 aa, Zea mays
  Clone ID: PAT_MRT4577_141053C.1.pep
MGNACGGALRSKYQHSFKHAASSQRRASSEYSASAVADDSPRKPTQPPATTDAHAPPPPPATAAAAMRRGGAGAPPDLGSVLGHPTPNLRDLYALGRKLGQGQFGTTFLCTELATGVDYACKSISKRKLITREDVDDVRREIQIMHHLSGHTNVVAIKGAYEDQLYVHIVMELCAGGELFDRIIQRGHYSERKAAELTRIIVGVVEACHSLGVMHRDLKPENFLLVNKDDDLSLKAIDFGLSVFFKPGQVFTDVVGSPYYVAPEVLLKNYGPAADVWTAGVILYILLSGVPPFWAETQQGIFDAVLKGVIDFDSDPWPVISDSAKDLIRRMLNPRSAKRLTAHEVLCHPWIRDHGVAPDRPLDPAVLSRIKQFSAMNKLKKMALRVIAESLSEEEIAGLKEMFQTMDTDNSGAITYDELKEGLRKYGSTLKDTEIRDLMDAADIDNNGTIDYIEFIAATLHLNKLEREEHLVAAFSYFDKDGSGYITVDELQQACKEHNMPDAFLDDVINEADQDNDGRIDYGEFVAMMTKGNMGVGRRTMRNSLNISMRDAPGAF

SEQ ID NO: 4647 - protein, 553 aa, Zea mays
  Clone ID: PAT_MRT4577_141054C.1.pep
MGNACGGALRSKYQHSFKHAASSQRHASSEYSASAVADDSPRKPPPPPATTDAHAPPPPPATAMRRGGAGAPPDLGSVLGHPTPNLRDLYALGRKLGQGQFGTTFLCTELATGVDYACKSISKRKLITREDVDDVRREIQIMHHLSGHTNVVAIKGAYEDQLYVHIVMELCAGGELFDRIIQRGHYSERKAAELTRIIVGVVEACHSLGVMHRDLKPENFLLVNKDDDLSLKAIDFGLSVFFKPGQVFTDVVGSPYYVAPEVLLKNYGPAADVWTAGVILYILLSGVPPFWAETQQGIFDAVLKGVIDFDSDPWPVISDSAKDLIRRMLNPRSAERLTAHEVLCHPWIRDHGVASDRPLDPAVLSRIKQFSAMNKLKKMALRVIAESLSEEEIAGLKEMFQTMDTDNSGAITYDELKEGLRKYGSTLKDTEIRDLMDAADIDNNGTIDYIEFIAATLHLNKLEREEHLVAAFSYFDKDGSGYITVDELQQACKEHNMPDAFLDDVINEADQDNDGRIDYGEFVAMMTKGNMGVGRRTMRNSLNISMRDAPGAF

SEQ ID NO: 4648 - protein, 549 aa, Zea mays
  Clone ID: PAT_MRT4577_141056C.1.pep
MGNACSGALRSKYLHSFKHAASQRHDSEYSASASADDSPRKPTPPATTDAHAPAPPAAAMRRGAAGATPDLGSVLGHPTPNLRDLYALGRKLGQGQFGTTYLCTELATGIDYACKSISKRKLITKEDVDDVRREIQIMHHLSGHKNVVAIKGAYEDQVYVHIVMELCAGGELFDRIIQRGHYSERKAAALTRIIVGVVEACHSLGVMHRDLKPENFLLANRDDDLSLKAIDFGLSVFFKPGQVFTDVVGSPYYVAPEVLLKSYGPAADVWTAGVILYILLSGVPPFWAETQQGIFDAVLKGAIDFDSDPWPVISDSAKDLIRRMLNPRPAERLTAHEVLCHPWIRDHGVAPDRPLDPAVLSRIKQFSAMNKLKKMALRVIAESLSEEEIAGLKEMFQTMDTDNSGAITYDELKEGLRKYGSTLKDTEIRDLMDAADIDNSGTIDYIEFIAATLHLNKLEREEHLVAAFSYFDKDGSGYITVDELQLACKEHNMPDAFLDDVINEADQDNDGRIDYGEFVAMMTKGNMGVGRRTMRNSLNISMRDAPGVF

SEQ ID NO: 4649 - protein, 347 aa, Zea mays
  UNSURE (1)..(347): unsure at all Xaa locations
  Clone ID: PAT_MRT4577_141133C.1.pep
  unsure (1)..(347): unsure at all Xaa locations
MAEQAGAGRYWCHMCAAAVSPAEGEVEMKCPFCHSGFLEEMETARGAATDDGDGDGDGAVAQVHPGADRPSSIWAHAILSTVDSSARRRRNRRQQEAASDVYDWNDPEFSLRRRRVTAFLRLLHELRDRQLQRLESAAGVALEGDQXPRSAGAXIGAAGGEHGVALGDYFLGPSLDALPRLRAENDAARHGTPPAKKEAVEAMPTVEIAGGNDGDDAASCPVCLEDYAAGERAREMPCRHRFHGNCIVPWLEMHSSCPVCRFQLPATDDKSSCSGGDGGFVSVDADREGSDNGGGDGRASSPGNAELAEAEESGRRLPPSLQWLNSLFSPSAQSSGSGGSSSHHWEN

SEQ ID NO: 4650 - protein, 175 aa, Zea mays
  UNSURE (1)..(175): unsure at all Xaa locations
  Clone ID: PAT_MRT4577_141167C.1.pep
  unsure (1)..(175): unsure at all Xaa locations
MVGTGKRERIAIRRIDNLAARQVTFSKRRRGLFKKAEELSILCDAEVGLVVFSATGKLFHFASSSMKQVIDRYDSHSKTLQRSEPQSSQLQSHMDDGTCARLKEELAETSLKLRQMRGEELQRLSVEQLQELEKTLESGLGSVLKTKSXKKILDEISGLERXRTQLIEENSRLKE

SEQ ID NO: 4651 - protein, 232 aa, Zea mays
  UNSURE (1)..(232): unsure at all Xaa locations
  Clone ID: PAT_MRT4577_141169C.1.pep
  unsure (1)..(232): unsure at all Xaa locations
MVGTGKRERIAIRRIDNLAARQVTFSKRRRGLFKKAEELSILCDAEVGLVVFSATGKLFHFASSSMKQVIDRYDSHSKTLQKSEPQSSQLQSHMDDGTCARLKEELAETSLKLRQMRGEELQRLSVQQLQELEKTLESGLGSVLKTKSQKILDEISGLERKRTQLIEENSRLKEQVTRMSRMETQLGADPEFVYEEGQSSESVTNTSYPRPSPXTDDCSDTSLRLGLPFFSS

SEQ ID NO: 4652 - protein, 233 aa, Zea mays
  Clone ID: PAT_MRT4577_141171C.1.pep
MVGTGKRERIAIRRIDNLAARQVTFSKRRRGLFKKAEELSILCDAEVGLVVFSATGKLFHFASSSMKQVIDRYDSHSKTLQRSEPQSSQLQSHMDDGTCARLKEELAETSLKLRQMRGEELQRLSVEQLQELEKTLESGLGSVLKTKSQKILDEISGLERKRTQLIEENSRLKEQVTRMSRMETQLGADPEFVYEEGQSSESVTNTSYPRPSTDTDDCSDTSLRLGLPLFSSK

SEQ ID NO: 4653 - protein, 70 aa, Zea mays
  UNSURE (1)..(70): unsure at all Xaa locations
  Clone ID: PAT_MRT4577_141465C.1.pep
  unsure (1)..(70): unsure at all Xaa locations
GARAXALRVPALFXWRPVRPPGPCGPALPXRVXXSFLGPPALRPAAPSSPAXGSAGVXWLPGAAAPGXWG

SEQ ID NO: 4654 - protein, 248 aa, Zea mays
  Clone ID: PAT_MRT4577_141627C.1.pep
MVKLAFGSFRDSLSAASLKAYVAEFIATLLFVFAGVGSAIAYSQLTKGGALDPAGLVAIAIAHAFALFVGVSMAANISGGHLNPAVTFGLAVGGHITILTGILYWVAQLLGASVACFLLQYVTHGQAIPTHGVSGISEIEGVVMEIVITFALVYTVYATAADPKKGSLGTIAPMAIGFIVGANILAAGPFSGGSMNPARSFGPAVAAGNFAGNWVYWVGPLVGGGLAGLVYGDVFIASYQPVGQQEYP

SEQ ID NO: 4655 - protein, 123 aa, Zea mays
  Clone ID: PAT_MRT4577_141669C.1.pep
GKELPPRNIPVTQAQSRGGAGAAGGYGGGRGGDGGYGAGRRDGGYGGGAPHAGRREGAGAAYGAGGGYGGRREGAGAGYGGGGGPRWRDCVAPSLAWPELSPSTPLVSPFALCPRVSARSPLD

SEQ ID NO: 4656 - protein, 341 aa, Zea mays
  Clone ID: PAT_MRT4577_141711C.1.pep
MLRRQGRGGKFLEEVLIVGGLLLVQCVLSGYVVFTDHLLALGADPLAVVVVAGAAYAAFCFPFAVALERKRWPSTVSGTLVAQYLLIALGGTTAFQALMLLGIKKTTPAIASAMPNLSPGLIFIVAACFRLERFDRACKYTQAKMAGTVVCLAGALAMGFLHSPTSTSSSLQAAVAAEAAAGGGDYYYDWILGCCCLVAAVTVFALVTVLQAATLAAFPAPLTMCCATSATGAALTAVLRLVLEGRFLGMGSPRIDATLVAGDRRPRRGRGGRVHGVPGVVPGQEGPAFRLRLRARPDRLHRHPLRGSPPPSPQPGKPRRDRAHVHWALHCPMGQEQRDLG

SEQ ID NO: 4657 - protein, 250 aa, Zea mays
  Clone ID: PAT_MRT4577_141718C.1.pep
MVKLAFGSVGDSFSVTSIKAYVAEFIATLLFVFAGVGSAIAFGQLTNGGALDPAGLVAIAVAHALALFVGVSVAANTSGGHLNPAVTFGLAVGGHITVLTGLFYWVAQLLGASVACLLLRFVTHGKAIPTHGVSGGTTELEGVVFEIVITFALVYTVYATAADPKKGSLGTIAPIAIGFIVGANILAAGPFSGGSMNPARSFGPAVAAADFAGNWVYWVGPLIGGGLAGLVYGDVFIGGSYQQVADQDYA

SEQ ID NO: 4658 - protein, 69 aa, Zea mays
  Clone ID: PAT_MRT4577_141731C.1.pep
FAGYDELMIQLIIWVCRLFGREREPIIINCCRFCCWGPTHVRVSSMFTPLQNKISRLLWNKLGKKVFFL

SEQ ID NO: 4659 - protein, 297 aa, Zea mays
  Clone ID: PAT_MRT4577_141787C.1.pep
MVLLLLYHSIWLRVAGAGDSSSTDSPGGSLRRAHRDRGSTMAANFWTSSHCKQLLDPEDVDLVPAADRERGITPEEFRLIKIHMSFHIWRLAQQVKVRQRVVATAIAYFRRVYTRKSMSDYDPRLVAPTCLYLASKVEESTVQARLLVFYIKKMCGSDDKYRFEIKDILEMEMKLLEALDYYLVVFHPYRPLLQLLQDAGITDLTQFAWGLVNDTYKMDLILIYPPYMIALACIYIASVLKDKDTTAWFEELRVDMNIVKNISMEILDFYDTYKIDPQRGIPEDKISPVMNKLPAKA

SEQ ID NO: 4660 - protein, 491 aa, Zea mays
  Clone ID: PAT_MRT4577_141944C.1.pep
MAFFLALVCILVFLAIASYVQYTRWQKGKGRFGGHGRSAPLKLPPGSMGWPYLGETLQLYSQDPSVFFASKQKRYGEIFKTHLLGCPCVMLASPEAARFVLVTQAHLFKPTYPRSKERMIGPSALFFHQGDYHLRLRKLVQGALGPDALRALVPEVEAAVRSTLASWDAGHVRSTFHAMKTLSFDVGIVTIFGGRLDERRKAELRKNYSVVEKGYNSFPNSLPGTLHYKAMQARRRLHGVLCDIMRERRGQAQAGTTGLLGCLMRSRGDDGAPLLSDEQIADNVIGVLFAAQDTTASALTWIVKYLHDHPKLLEAVRAEQAAVREATGGGRQPLAWAHTKSMALTHRVILESLRMASIISFTFREAVADVEYKGFLIPKGWKVMPLFRNIHHSPDYFQDPHKFDPSRFQVAPRPSTFLPFGHGVHACPGNELAKLEMLVLIHHLVTGYRCVHLLSDPLHIFPACCIASGPRMTHGWLVFTSPAVLSLLYKL

SEQ ID NO: 4661 - protein, 500 aa, Zea mays
  UNSURE (1)..(500): unsure at all Xaa locations
  Clone ID: PAT_MRT4577_141949C.1.pep
  unsure (1)..(500): unsure at all Xaa locations
MAFFLALVCILILLAIASYVQYTRWQKGKGRFGGHGRSAPLKLPPGSMGWPYLGETLQLYSQDPSFFFASKQKRYGEIFKTHLLGCPCVMLASPEAARFVLVTQAHLFKPTYPRSKERMIGPSALFFHQGDYHLRLRKLVQGALGPDALRALVPEVEAAVRSTLASWDAGHVRSTFHAMKTLSFDVGIVTIFGGRLDERRKAELRKNYSVVEKGYNSFPNSLPGTLHYKAMQARRRLHGVLCDIMRERRGQAQAAGTGLLGCLMRSRGDDGAPLLSDEQIADNVIGVLFAAQDTTASALTWIVKYLHDHPKLLEAVRAEQAAVREATGGGRQPLAWAHTKSMALTHRVILESLRMASIISFTFREAVADVEYKGFLIPXGWKVMPLFRNIHHSPDYFQDPHKFDPSRFQVAPRPSTFLPFGHGVHACPGNELAKLEMLVLIHHLVTGYRWQIVGSSDEVEYSPFPVPKHGLPVRLWRQNNPVDRKGRETDDDHVERIFLV

SEQ ID NO: 4662 - protein, 249 aa, Zea mays
  Clone ID: PAT_MRT4577_142197C.1.pep
MAAAGRLSLPLVLLVVLAVAGRAAAQDYDFFYLVLQWPGAYCDTKQSCCYPKSGKPAADFGIHGLWPNRDDGTYPQNCSPDNAFNPSKVSDLMSSLRAKWPTLACPSNDGLRFWGHEWEKHGTCAADVFDEHGYFQAALRLRDQLGVLGALTSAGVKPDGGYYTLSQIKGAIRQGTGFEPYVECNRDEAGNSQLYQLYFCVDAAGDSFVDCPVLPSGRPLHSMQEDNGMFIPHSSFFFANKRRAIGVPY

SEQ ID NO: 4663 - protein, 229 aa, Zea mays
  Clone ID: PAT_MRT4577_142201C.1.pep
MAAAGRLSLPLVLLVVLAVAGRAAAQDYDFFYLVLQWPGAYCDTKQSCCYPKSGKPAADFGIHGLWPNRDDGTYPQNCSPDNAFNPSKVSDLLSSLRAKWPTLACPSNDGLRFWGHEWEKHGTCAADVFDEHGYFQAALRLRDQLGVLGALTSAGVKPDGGYYTLSQIKGAIRQGTGFEPYVECNRDEAGNSQLYQLYFCVDAAGDSFVDCPVLPSGRPCGNRIEFPAF

SEQ ID NO: 4664 - protein, 71 aa, Zea mays
  UNSURE (1)..(71): unsure at all Xaa locations
  Clone ID: PAT_MRT4577_142367C.1.pep
  unsure (1)..(71): unsure at all Xaa locations
PTRPTPRIHVNAHAPTRHIQERLXVSPCPAATVPTQLSGAPATPAPVDRVAAPCGVDSPSAGAVCRAAGKG

SEQ ID NO: 4665 - protein, 138 aa, Zea mays
  UNSURE (1)..(138): unsure at all Xaa locations
  Clone ID: PAT_MRT4577_142410C.1.pep
  unsure (1)..(138): unsure at all Xaa locations
MAEEKHHXHHLFHHKKDEEQAAAGGYGESAEYTEATVTEVVSTGENEFDEYKKEEKEHKHKQHLGEAGAIAAGAFALYEKHEAKKDPEHAHRHKIEEEVAAAAAVGSGGFAFHEHHEKKKDHKEAEEAGGEKKHHFFG

SEQ ID NO: 4666 - protein, 141 aa, Zea mays
  Clone ID: PAT_MRT4577_142413C.1.pep
MAEEKHHHHHLFHHKKDEEQEEQLAGGGYGESAEYTEATVTEVVSTGENEYDEYKKEEKQHKHKQHLGEAGAIAAGAFALYEKHEAKKDPEHAHRHKIEEEVAAAAAVGSGGFAFHEHHEKKKDHKDAEEAGGEKKHHFFG

SEQ ID NO: 4667 - protein, 161 aa, Zea mays
  Clone ID: PAT_MRT4577_142415C.1.pep
MGSEGSSGPVVVPRNFRLLEELERGEKGIGDGTVSYGMDDADDIYMRSWTGTIIGPPNTVHEGRIYQLKLFCDTDYPDKPPTVRFQTRINMTCVNQETGLVEPSLFPMLGKWEREHTMEDILASLKREMSTPQNRRLYQPHEGNEDQRVEQKGLSLRCVVM

SEQ ID NO: 4668 - protein, 138 aa, Zea mays
  Clone ID: PAT_MRT4577_142418C.1.pep
MAEEKHHHHHLFHHKKDEEQLAAGGYGESAEYTEATVTEVVSTGENEYDEYKKEEKEHKHKQHLGEAGAIAAGAFALYEKHEAKKDPEHAHRHKIEEEVAAAAAVGSGGFAFHEHHEKKKDHKEAEEAGGEKKHHFFG

SEQ ID NO: 4669 - protein, 545 aa, Zea mays
  Clone ID: PAT_MRT4577_142494C.1.pep
MSSEPPPAPSAAAAEGLAADLSAATLSKKQQKKDARKAEKAEKAAQRQQQQQPADAEDPFAANYGDVPVEEIQSKAISGRLWSQIGDLDDSSAGRSVLIRGSLQAIRPVSKKMAFVVLRQSMSTVQCVLVASADAGVSTQMVRFATALSKESIVDVEGVVSLPKEPLKATTQQVEIQVRKIYCINRAIPTLPINLEDAARSEADFEKAELAGEKLVRVGQDTRLNYRAIDLRTPSNQAIFRIQCQVENKFRDFLLSKDFVGIHTPKLISGSSEGGAAVFKLLYNGQPACLAQSPQLYKQMAISGGFERVFEVGPVFRAENSNTHRHLCEFVGLDAEMEIKEHYFEVCDIIDGLFVSIFKHLSENCKKELESINRQYPFEPLKYLDKTLKLTYEEGIQMLKEAGTEIEPMGDLNTEAEKKLGRLVREKYDTDFFILYRYPLAVRPFYTMPCYDNPAYTNSFDVFIRGEEIISGAQRIHTPELLAKRATECGIDVSTISAYIEVFSYGAPPHGGFGVGLERVVMLFCALNNIRKTSMFPRDPQRLVP

SEQ ID NO: 4670 - protein, 457 aa, Zea mays
  UNSURE (1)..(457): unsure at all Xaa locations
  Clone ID: PAT_MRT4577_142527C.1.pep
  unsure (1)..(457): unsure at all Xaa locations
MSFRSIVRDVRESFGSLSRRSLEVRISGLPGLSGGHHRGKSVGSVSDLRDRPVVVDQSRWXGLPPELLRDVMRRLEEGESNXWPSRKNGVACAAVCGTWREICKDIVLSPEFCGKLTFPVSLKQPGPRNGIIQCFIKRDKSTSTYYLYLCLSPVVLSEDGKFLLAAKRNRRTTYTEYIISVDPKSISRSSDGCVGKMRSNFLGTKFIVHDTRAPHNAGSLVSCERGSRRISSRRVSPKVPTASYPIARVNYELNLLGTRGPRRMNCTMHSIPASTLDPQGMVPEPGQPKQIFVPGSSSFEDSFRSANNTPSSSRFSVADRSLDWSSSRFSETSGLAQQDDDDSDQAKERPLVLCNKEPRWHEQLQCWCLNFHGRVTVASVKNFQLIAAPQLDSEPSQQAQQQTQPSNSSSASDHDKVILQFGKVANDMFTMDYRYPLSAFQAFAICLTSFDSKLACE

SEQ ID NO: 4671 - protein, 223 aa, Zea mays
  UNSURE (1)..(223): unsure at all Xaa locations
  Clone ID: PAT_MRT4577_142569C.1.pep
  unsure (1)..(223): unsure at all Xaa locations
MDSNRSMATSGVAPFVAKTYRMVDDPATDGVVAWGRDNNSFVVADPFAFSQTLLPAHFKHSNFSSFVRQLNTYGFRKVDPDRWEFAHVSFLRGQTHLLGQIVRRSSGGKRKDDGNGAGAGSADDEDAVAMEVVRLRREQRAIEEQVAAMWRRVQETERRPKQMLAFLVKVAGDPXAAPPRLRRRGRRRVRRRGAGGRREHQEGAAASRCRKRRRRRRRLQRAL

SEQ ID NO: 4672 - protein, 105 aa, Zea mays
  Clone ID: PAT_MRT4577_142585C.1.pep
SRLFFFFFFFFFFFFFFFFFFFFFFWAAQTIFGWFSPFSIRFSIINMFGCAGLTSKFWDFTNKGGGVFYSTRIGAHRARGHTHEHNRFSLQCKIGIPIEHGNGRT

SEQ ID NO: 4673 - protein, 47 aa, Zea mays
  Clone ID: PAT_MRT4577_142684C.1.pep
MSEEKHHHFFNLHKIVVEQPADEYGYFETDVVTVTDYGECERHMKEV

SEQ ID NO: 4674 - protein, 267 aa, Zea mays
  Clone ID: PAT_MRT4577_142686C.1.pep
MAAGGGGGSAAPFVWKTYTMVEDPGTAGVIGWGSGNNSFVVADPFVFSQTLLPAHFKHNNFSSFVRQLNTYGFRKVDPDRWEFAHASFLRGQTHLLRNIVRRGSSAAGAGGGKRKDASPTELASGDDMTMVATEVVRLKQEQRAIDDRVASMWRRVQETERRPKQMLAFLLKVVGDRDRLHRLVGDAPVPDNGFASGGAAEPPAAEVGEKRARLLLDGDSMVALGPEAVDFAGFYSGGGAFGDVAVDAAAGSRGGGFSFAFGVDAGY

SEQ ID NO: 4675 - protein, 163 aa, Zea mays
  UNSURE (1)..(163): unsure at all Xaa locations
  Clone ID: PAT_MRT4577_142744C.1.pep
  unsure (1)..(163): unsure at all Xaa locations
MAVTIAWVXARQTFDSRGNPTAEGDVGLRDSGYARGAGPRGASTAIYEALKLRNAGSDYLAKGALKGASMGNNIMGPIFVANPPTEQVEIDDFMGHQVDGTSNEXGWWEQNFGPNDILAVSLAGWRAXGAMVKKIPLDQNIEGLGGXNETLGVPVPAFKVIKE

SEQ ID NO: 4676 - protein, 163 aa, Zea mays
  Clone ID: PAT_MRT4577_143055C.1.pep
GTLEAGRVWNDPAKYKISDNRRHVAIVTTASLPWMTGTAINPLFRAAYLARSAKQKVTLVVPWLSKSDQELVYPNNITFSSPEEQETYIRNWLQERIGFEANFKISFYPGKFSKERRSIIPAGDTSQFISSKEADIAILEEPEHLNWYHHGKRWTDKFNHVIG

SEQ ID NO: 4677 - protein, 260 aa, Zea mays
  UNSURE (1)..(260): unsure at all Xaa locations
  Clone ID: PAT_MRT4577_143184C.1.pep
  unsure (1)..(260): unsure at all Xaa locations
MWSFASNAIAGSLKKKAQPSKCSISNADYSDDEVSSCTSREEGLDCPICWESFNLVENVPYVLWCGHTMCKNCILGLHWAVVKFPSLPIQLPLFISCPWCNLLSFRLVYKGNLRFPRKNYFLLWMVESMNGGRAKFHSTNHDEHHSTWHSSAGTSSSHQQRRNAAVGSESSSXRDRRRPQXFHTDNISASLQKLMVCFMQLTAKFPLVIIFLLIVLYAVPASAAVLVLYALVTFLFALPSFLILYFAYPSLDWLVREIFA

SEQ ID NO: 4678 - protein, 193 aa, Zea mays
  UNSURE (1)..(193): unsure at all Xaa locations
  Clone ID: PAT_MRT4577_143214C.1.pep
  unsure (1)..(193): unsure at all Xaa locations
MLLSVDNTSAGRQHEVKDLSQEHFGRLEIEMREVEMAVLMACRAECGPYKPFADARISGSLHMTIHXTATSSRPSPRLGVEVXWCSCCIXSTRGTSAXAAIXRDSAAXSAEKDXTLEEYWWCTERCLDXVRAVPPDLIEDDGQXATLLIHDRVQGEEDYNKIGKIPDPESTDDAEIKIEITIIRDCVKVDPKN

SEQ ID NO: 4679 - protein, 828 aa, Zea mays
  UNSURE (1)..(828): unsure at all Xaa locations
  Clone ID: PAT_MRT4577_143224C.1.pep
  unsure (1)..(828): unsure at all Xaa locations
MESSWLLLLSCLPAVWVLAAAAGRSPGCATRCGEIDVPYPFGLDPQCAIHAGFWLNCTTVDGATKLLDKNSEVTKISVEDGKAWFKNFISRQCYNQSSGDMFENNAWVDYTGEPYVLSAEDNKIIVLGCNSMAYMQSDSYIIGCMSTCDDPLKNGSCSGTAGCCQAELPPGVQFYQGFFNSLHNTTKIWKQTPCNYITVMESAAFSFSSTYLNSTVLYDSDDGRTPVVMEWGITRQTCEEAKANKTAYACVSNHSDCVYSDAAGYRCRCSGGFKGNPYVVDGCAGSFLLRAQTSKSMHAQVTNRCDFFVRFSDIDECLDSATYPCAGICKNTLGNFTCSCPRGRSMINGVCVKSQRSTWMVPVVGRSLHKLRTCVRKIPCREHLFFFPTLFQCFPGVYRRSNKXFVRKIXCIAGASVGLVTLVIGVTCAYLVRERRKLHRVKQSYFRRHGGLLLFEELKSQHHQQGAAAFTIFSEEELQQATDRFDAQRVLGHGGHGTVYKGVLKSGTATEIAVKRCMTIDEQQKKEFGKEMLILSQVNHRNIVKLLGCCLEVEVPILVYEFVPNGTLFDLIHGDHGQRVSLDTRLRIAYESAEALAYLHSCASPPILHGDVKSTNILLDGDYAAKVSDFGASILAPNDKSQFVTVVQGTCGYLDPEYMQTYELTDKSDVYSFGVVLLELLTGKKAFDLQGSEQDRSLSMRFLYAMKENRLEDILDDQIKNSESIEYLEEIAELARQCLEMSGVNRPTMKEVADKLGRLRKIMKHPWAHEDPEELDRLLGEPSTTTNSTATTGNFIIAIGEPSTANSTANTGNFSITKRAAMGLESGR

SEQ ID NO: 4680 - protein, 89 aa, Zea mays
  Clone ID: PAT_MRT4577_143334C.1.pep
ATRQVTRMVRGAESLQCHGFRRLESFLHEEHLLIFLPHHKPVKVYVLRWSWGGQGHMHFPPMLEQNVLTIFWYSDYLASLYQVPKNQAS

SEQ ID NO: 4681 - protein, 568 aa, Zea mays
  Clone ID: PAT_MRT4577_143406C.1.pep
MEHSSSLEIRIEALRPHPPFSLALQVATHSVRRDRRSETTSPPTIRNARAMCPVRGGGCSWPASVVGSVTAALLLAAVIVRLFVPSACSSGIIKGRRQVGAGAAGGARLPAGSLGWPLLGETLAFIRAAYSPRPESFVEKRRVLYGKVFKSHLWGSPAVVSSDPEVSRAVLQADASAFVPWYPRSLMELMGQSSILVLGGGLQRRVHGLAGAFFKSPQLKAQVTLDMQRRVGRAMDMWGRRRHRSMGDDDSGGMPVRVQNEAKSIVFEILVRALIGLEEGDKMQYLRQQFQEFIAGLISLPVKLPGTQLYRSLKAKKRMTKLIKTIIQEERKKMMSEGDDLRGGTHPRDMIDVLLGNGNDELTDELISDNMIDFMIPAEDSVPVLITLAVKYLSECPQALQQLEEENMELKRQKSGAGETLEWTDYMSLAFTQHVITETLRMGNIINGIMRKAVRDVEVRGHLVPKGWRVLVYFRAVHLDAAVHDDPHAFNPWRWKERPDVVAMSGFTPFGGGQRLCPGLDLARLEASIFLHHLVTNFRWVAEEDTVVNFPTVRLKRGMPIAVTPRTC

SEQ ID NO: 4682 - protein, 161 aa, Zea mays
  Clone ID: PAT_MRT4577_14340C.1.pep
MTSSSTPSRKALSKIACNRLQKELAEWQVGPPAGFKYKVSDNLQRWVIEVGGAEGTLYAGETYQLQVDFPEHYPMEAPQVIFLNPAPMHPHIYSNGHICLDILYDSWSPAMTVSSVCISILSMLSSSPAKQRPADNDRYVRNCRNGRSPKETRWWFHDDKV

SEQ ID NO: 4683 - protein, 115 aa, Zea mays
  UNSURE (1)..(115): unsure at all Xaa locations
  Clone ID: PAT_MRT4577_143488C.1.pep
  unsure (1)..(115): unsure at all Xaa locations
NQLEAQIHRKDIYGGQVGEYMRNLDEXEPEKGQFRFSECIKXGIEAFGMGALYKKVQSAIRADPSVVKWTKQPPKEHXRCYPKKVTFEQRKASFIERLNRLNSSGGTEAADEDDE

SEQ ID NO: 4684 - protein, 176 aa, Zea mays
  UNSURE (1)..(176): unsure at all Xaa locations
  Clone ID: PAT_MRT4577_143683C.1.pep
  unsure (1)..(176): unsure at all Xaa locations
MGNQLATMRRHIRVPTRAAKIFGLLMLLGLSAGAVTATIFPQGSQAPIASFFPPYLXPAGSSVCENPIFQPYRIQQAIEVGILPXIXPLFLQQXXALLQQLPLGHXMXQNIRAQQLQQLVLANLVAYFKKQQFFPFNQLGSLNFVFNLKQQQLQFSQLPVAYPKHFLPFNQLAALN

SEQ ID NO: 4685 - protein, 471 aa, Zea mays
  Clone ID: PAT_MRT4577_143832C.1.pep
MVGAMRGGAMELEDRLATLPRFRGDHDDDGKERRTGTVWTATAHIITAVIGSGVLSLAWAMAQLGWVAGPVILVLFAAITFYTCGLLADCYRVGDPVTGKRNYTYTEAVKSYLGGRYVWFCGFCQYVNMFGTGIGYTITASISAAAINKSNCFHWHGHDADCSQNTSAYIIGFGVVQVIFSQLHNFHKLWWLSIIAAIMSFSYSAIAVGLSLAQIVMGPTGKTTMTGTLVGVDVDAAQKVWMTFQALGNVAFAYSYAIILIEIQDTLRSPPAENKTMRRATMMGISTTTGFYMLCGCLGYAAFGNAASGNILTGFGFYEPFWLVDFANACIVVHLVGGFQVFCQPLFAAVEGAVAARYPGSTREYGAAGLNVFRLVWRTAFVAVITLLAILMPFFNSILGILGSIAFWPLTVFFPVEMYIRQRQVRRFSTKWIALQSLSFVCFLVTAASCAASVQGVVDSLKTYVPFKTRS

SEQ ID NO: 4686 - protein, 172 aa, Zea mays
  Clone ID: PAT_MRT4577_143833C.1.pep
MVGAMRGGAMELEDRLATLPRFRGDHDDDGKERRTGTVWTATAHIITAVIGSGVLSLAWAMAQLGWVAGPLTLVLFAAITFYTCGLLADCYRVGDPVTGKRNYTYTEAVKSNLGGWYVWFCGFCQYVNMFRTSIGYTITAFISAAGINKSNCFHWHGHDADCSQNTSAYIIG

SEQ ID NO: 4687 - protein, 99 aa, Zea mays
  Clone ID: PAT_MRT4577_143840C.1.pep
ASEQLCFSISPIASLPIPPARRFVREGDTAALASSPEQQAAARDLRAQQRRTGSWWRPAEKMAGASSVDTEAAAGTANVKAGLHTPQGARVPHDAGGHG

SEQ ID NO: 4688 - protein, 61 aa, Zea mays
  Clone ID: PAT_MRT4577_143884C.1.pep
VNAIFTIPPELAYGASGSTTNNPTQCKPAIDVEMLSWTSVHSHLLRWRLIHAATLKRESPG

SEQ ID NO: 4689 - protein, 78 aa, Zea mays
  Clone ID: PAT_MRT4577_144014C.1.pep
MAAADVEYRCFLGRLAWATSNESLENAYDFYGEILDSKVITDRETERSRGFGYVTFSFENFMLYAIENMNCKELDGRN

SEQ ID NO: 4690 - protein, 165 aa, Zea mays
  Clone ID: PAT_MRT4577_14402C.1.pep
MSSHRVKWNEDNLYEIESNKPVRQKITEPKTPYHPMIDDDGSLSPTRPFDKCLDETVQAEAILTALNGVASSSISISKDDGWGSSDDDTDAIDQDADPEADTTRLSFKEHRRAHYDEYRKVKELMRTGSLTAEEADEDNRAATSSEDKGVGKGGPNDNMKPSPQT

SEQ ID NO: 4691 - protein, 52 aa, Zea mays
  Clone ID: PAT_MRT4577_144152C.1.pep
ARPQPPPERRLKLRALRPRGARCGGARFSTDSKQEFDHKRCHALIRLTVGSC

SEQ ID NO: 4692 - protein, 448 aa, Zea mays
  Clone ID: PAT_MRT4577_144161C.1.pep
MALLVRRARRAATKAAVSLAGRTGSVELAIPAHFRCPISLDLMRDPVTAPAGITYDRESIEAWLDTGRATCPVTHAPLRHEDLVPNHAIRRVIQDWCVANRSRGVERIPTPKIPVTPVQASELLFDLAGSARRRDAAARCAEVVTKIKVLARDSERNRRCFASIGTGRVLAAAFESLAAAAAADAAAPAGRVLEDILAALVCMMPLDEEAARTLALPTSLGSLVAIAENGSLAGRLNAVLAIKEVVSCDGAVTDLSGKADEIVDALAKIIKSPICPQATKAGMVATYHLALYDERVAARLAAAGLVPVLVEVLVDADKSMSEKALAVLDAVLASEEGRASARAHALAVPMLIKKMFRVSDLATQLAVSAMWRLGKAHSDGEDDGAVTRCLVEALGVGAFQKLLLLLQVGCRDATKEKATELLKLLNKYKSVGECVDAVDFRGLNKLSS

SEQ ID NO: 4693 - protein, 510 aa, Zea mays
  Clone ID: PAT_MRT4577_144241C.1.pep
MAAEQGRSLAETPTWSVATVTTLMVAACFLVERSLSRFAKWLRKTKRKAMLAALEKIREELMLLGVISLLLSQTARFISEICVPSSLFTSRFYICSESDYQDLLRNTDANQTALDKNMFGGQRLHVCGEGHEPFVSYEGLEQLHRFLFILGITHVLYSFVTVVLSMIKIYSWRKWETLAGPIAAEELKARRTKVMRRQSTFVFNNASHPWSKNKILIWMLCFLRQFKGSIIRSDYLALRLGFVTYHKLPHSYDFHKYMVRSMEDDYNGTIGISWPLWAYAIVCILINVHGINIYFWLSFVPVIKLVLLVGTELQHVIAQLALEVAEATAPYVGSQLKLRDDLFWFGKPRVLWWLIQFISFQNAFELATFLWSLWELSAHTCFMKHYYMVAIRLISGLLVQFWCSYSTLPLNVIISQMGSKFKKSLVSENVRESLHSWCKRVKDRSRHNPLFSRNGTLTTRSVCSLDTTYETDHETNTVCTLSRTASATSLDDQLTVVTVDDEPSCIEKDV

SEQ ID NO: 4694 - protein, 118 aa, Zea mays
  UNSURE (1)..(118): unsure at all Xaa locations
  Clone ID: PAT_MRT4577_144375C.1.pep
  unsure (1)..(118): unsure at all Xaa locations
DRSARLDPPHTYFVHPWRNILEGRFSPQVAVAALIPXFQQLTGINVNMFYAPVLSLTICFSDDTSIMAAVITGLVNMFATREYIASVDXRLGLSALLLQGGTQIFDSQIVEGTLIALQ

SEQ ID NO: 4695 - protein, 108 aa, Zea mays
  UNSURE (1)..(108): unsure at all Xaa locations
  Clone ID: PAT_MRT4577_144426C.1.pep
  unsure (1)..(108): unsure at all Xaa locations
FPAGPTRARFSSPSGSGSGPRGSPEGGGVRERIEMAASDVEXYRLIVRRLTCATDDHSLHNAFSTYSEVLDSKIILDRETQMYRGFRFVTFFTGDAMRNAIXEGMNGK

SEQ ID NO: 4696 - protein, 358 aa, Zea mays
  UNSURE (1)..(358): unsure at all Xaa locations
  Clone ID: PAT_MRT4577_14449C.1.pep
  unsure (1)..(358): unsure at all Xaa locations
MATTATNRRVILKEYVEGYPREEHMELLQGAEVPLRLTGAEPAGSVLVRNLYLSCDPYMRPKMSRPLRESYTAAFVPGDTITGYXAARVVDSSDPRLAPGDLVWGITGWEDYSVVTPPATRLLSKISHHGAGEGAGVPLSYYTGILGMPGLTAYVGFHEICAPKKGETVFVSAASGAVGQLVGQFARLAGCHVVGSAGSREKVELLKTRFGFHDAFNYKEEPDLGAALKRCFPDGIDIYFENVGGAMLDAVLLNMRVHGRIAVCGLISQYNLADGEKDAVRNLAAVISKRLRLQGFIEPDHKHLYPQYEAWVLPYIRDGTLAYVEDVAEGLESAPKALIGLFHGRNVGKQLVRVADDE

SEQ ID NO: 4697 - protein, 59 aa, Zea mays
  Clone ID: PAT_MRT4577_144533C.1.pep
TPKNQILFITKRGSQIFFHTYMLIGVNPVDHLKLHTYLFKLIQLVATSEVHMLTDDKFS

SEQ ID NO: 4698 - protein, 71 aa, Zea mays
  Clone ID: PAT_MRT4577_144569C.1.pep
MGFRGAQEGGGLLSWKGMNSDSEATGLKFFLRIFGIGPGAKQMFSFLGDTCDAPVDKHSKLKGHAVTGFRM

SEQ ID NO: 4699 - protein, 66 aa, Zea mays
  UNSURE (1)..(66): unsure at all Xaa locations
  Clone ID: PAT_MRT4577_144800C.1.pep
  unsure (1)..(66): unsure at all Xaa locations
TNXTHIPEHLSPLLMPFPTMNPXMQYFMKQQVVANLIAIPTLILHQLLTSPLHQCQIPMITPGMMP

SEQ ID NO: 4700 - protein, 303 aa, Zea mays
  Clone ID: PAT_MRT4577_14481C.1.pep
MRTNPTTSRPGISTIEEKSVGRIDQIIGPVLDITFPPGKLPYIYNALIVKSRDTADKQINVPGQVQQLLGNNRVRAVAMSATEGLMRGMEVIDTGTPLSVPVGGATLGRIFNVLGEPIDNLGPVDTSATFPIHRSAPAFIELDTKLSIFETGIKVVDLLAPYRRGGKIGLFGGAGVGKTVLMPRPINNITKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLS

SEQ ID NO: 4701 - protein, 74 aa, Zea mays
  UNSURE (1)..(74): unsure at all Xaa locations
  Clone ID: PAT_MRT4577_14490C.1.pep
  unsure (1)..(74): unsure at all Xaa locations
DKEYEGNVEATGEDFSVEPADETMPFRALLDVSLXRTTTGTRVVGAIKXSLDGGLYMQHTDKRYAAFNNDDKQL

SEQ ID NO: 4702 - protein, 119 aa, Zea mays
  UNSURE (1)..(119): unsure at all Xaa locations
  Clone ID: PAT_MRT4577_145492C.1.pep
  unsure (1)..(119): unsure at all Xaa locations
KPEAKKDPGARPPPQDRGGGCGGAARRFRRLPLPRAPQKEKGPQGPRGGRRRKKAPLFRLIDPPXVSSSXPCATXVCESDIERPPFCARVRLYALVLCPNKRGYVIYRMYTCGYACAWV

SEQ ID NO: 4703 - protein, 74 aa, Zea mays
  UNSURE (1)..(74): unsure at all Xaa locations
  Clone ID: PAT_MRT4577_145816C.1.pep
  unsure (1)..(74): unsure at all Xaa locations
IVSGSGSGNDMYQNRFLQREAAFNKFRLKRKDWNFGKKVCYQNRKRLFXQRPRVRGQFVRQFEQKDQTAQGLKK

SEQ ID NO: 4704 - protein, 332 aa, Zea mays
  Clone ID: PAT_MRT4577_145875C.1.pep
MSTANRYQHIKSTKPVVGKARKLKDLMIKSDNRICADCGAPDPKWASANIGVFLCLKCGDVHRALGPDISKVLSVTLDDWSDSDIDSMVEVGGNSYANSIYEAFLPKDHPKPKPDSTMEYRTKFIRAKYETQDFLKPSLRISSRSSFKSTTSVKSVDSNFSSTSRKDVFEDTREFVGELNITLVKGTNLAVRDMLTSDPYVVLTLGGQKVQSTVKKSDLNPVWNEVLKISVPRNYGPLKLEVYDHDMFSADDIMGEAEIDLQPMITAAMAFGDTSRLGDMQIGRWFMTKDNALMKDSTVNVVAGKVKQEVHLKLQNVESGELELELEWVPIL

SEQ ID NO: 4705 - protein, 189 aa, Zea mays
  Clone ID: PAT_MRT4577_145926C.1.pep
LPRYIQISRHLKKKKKRGRSRSSWLLLPHRFVFRFWFVGEREEMAASDVEYRCFVGGLAWATDDHSLNNAFSTYGEVLESKIILDRETQRSRGFGFVTFSTEDAMRSAIEGMNGKELDGRNITVNEAQSRGGRGGGGGGYGGGRRDGGGYGGGGGGYGGGRGGYGGGGGGYGGANRGGGYGNNDGNWRN

SEQ ID NO: 4706 - protein, 112 aa, Zea mays
  Clone ID: PAT_MRT4577_146023C.1.pep
AQGYTNQQQGKFSHSTLFYAGNIWLPATGGKGLCKDGSNRHRKVLRDNIQGITKPAIRRLARRGGVKRISGLIYEETRGVLKIFLENVIRDAFTYTEHARRKTVTAMDVFYA

SEQ ID NO: 4707 - protein, 113 aa, Zea mays
  Clone ID: PAT_MRT4577_146083C.1.pep
SASYLQQHQLPFSQLLPTSPQHFLPFNQLAAFYSAAYLQQQQLLPFKQLAGMSPATFSIHPQLFPFSQLCAPSSGPLLHVPQFLPFSHRALTNPGAFSDQPIIGGALFWISYE

SEQ ID NO: 4708 - protein, 223 aa, Zea mays
  Clone ID: PAT_MRT4577_146094C.1.pep
MSNAASTTPLLAHYKMGKFDLSHRVVLAPLTRERSFGNVPQPHAILYYQQRATKGGLLIAEATGVSDTAQGYKDTPGIWTKKQVEAWKPIVDGVHAKGGIFFCQVWHVGRVSNHTFQPNGQAPISSTDKPIKPATRADGIGLAKVSTPRRLTTDEIPLVIDDFRVAARNAIEAGFDGVEIHGAHGYLIDQFLKDQVNDRTDKYGGSLENRCRFALEVVQAVAD

SEQ ID NO: 4709 - protein, 289 aa, Zea mays
  Clone ID: PAT_MRT4577_146234C.1.pep
MAAPMVDAEYLRQVDRARRHLRALISNKGCAPIMLRLAWHDAGTYDLKTKTGGANGSIRYEEEYTHGSNAGLKIAIDLLEPIKAKNPKITYADLYQLAGVVAVEVTGGPTVEFIPGRRDSSVCPREGRLPDAKKGAPHLRDIFYRMGLSDKDIVALSGGHTLGRAHPERSGFDGAWTKEPLKFDNSYFLELLNEESEGLLKLPTDKALLSDPEFRRYVELYAKDEDAFFKDYAESHKKLSELGFTPRSTAPSKSDLPTAAVLAQSAFGVAVAAAVVIAGYLYEASKKAK

SEQ ID NO: 4710 - protein, 301 aa, Zea mays
  UNSURE (1)..(301): unsure at all Xaa locations
  Clone ID: PAT_MRT4577_146362C.1.pep
  unsure (1)..(301): unsure at all Xaa locations
MEQYEKVEKIGEGTYGVVYKALDKATNETIALKKIRLEQEDEGVPSTAIREISLLKEMNHGNIVRLHDVVHSEKRIYLVFEYLDLDLKKFMDSCPEFAKNPTLIKSYLYQILHGVAYCHSHRVLHRDLKPQNLLIDRRTNALKLADFGLARAFGIPVRTFTHEVVTLWYRAPEILLGARQYSTPVDVWSVGCIFAEMVNQKPLFPGDSEIDELFKIFRILGTPNEQSWPGVSCLPDFKTAFPRWQAQDLATVVPNLDPAGLDLLSKMLRYEPSKRITARQALEHEXYFKALEVVQCPAKCA

SEQ ID NO: 4711 - protein, 699 aa, Zea mays
  Clone ID: PAT_MRT4577_146436C.1.pep
MATETETFAFQAEINQLLSLIINTFYSNKEIFLRELISNSSDALDKIRFESLTDKSKLDAQPELFIHIVPDKASNTLSIIDSGIGMTKSDLVNNLGTIARSGTKEFMEALAAGADVSMIGQFGVGFYSAYLVAERVVVTTKHNDDEQYVWESQAGGSFTVTRDTSGEQLGRGTKITLFLKEDQLEYLEERRLKDLVKKHSEFISYPISLWTEKTTEKEISDDEDEEEKKDAEEGKVEDVDEEKEEKEKKKKKIKEVSHEWSLINKQKPIWMRKPEEITKEEYAAFYKSLTNDWEEHLAVKHFSVEGQLEFKAVLFVPKRAPFDLFDTRKKQNNIKLYVRRVFIMDNCEELIPEWLSFVKGIVDSEDLPLNISRETLQQNKILKVIRKNLVKKCVELFFEIAENKEDYNKFYEAFSKNLKLGIHEDSQNRTKIAELLRYHSTKSGDELTSLKDYVTRMKEGQNDIYYITGESKKAVENSPFLEKLKKRGYEVLYMVDAIDEYAVGQLKEFEGKKLVSATKEGLKLDETEDEKKRKEELKEKFEGLCKIIKEVLGDKVEKVVVSDRVVDSPCCLVTGEYGWTANMERIMKAQALRDSSMSGYMSSKKTMEINPENPIMDELRKRAEADKNDKSVKDLVMLLFETALLTSGFSLDDPNTFGTRIHRMLKLGLSIDEDESAEAEAEMPPLEDDAGESKMEEVD

SEQ ID NO: 4712 - protein, 698 aa, Zea mays
  Clone ID: PAT_MRT4577_146438C.1.pep
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGADVSMIGQFGVGFYSAYLVADRVVVTTKHNDDEQYVWESQAGGSFTVTRDTSGEQLGRGTKITLFLKDDQLEYLEERRLKDLVKKHSEFISYPISLWTEKTTEKEISDDEDEEEKKDAEEGKVEDVDEKEEKEKKKKKIKEVSHEWSLVNKQKPIWMRKPEEITKEEYAAFYKSLTNDWEEHLAVKHFSVEGQLEFKAVLFVPKRAPFDLFDTKKKQNNIKLYVHRVFIMDNCEELIPEWLSFVKGIVDSEDLPLNISRETLQQNKILKVIRKNLVKKCVELFFEIAENKEDYNKFYEAFSKNLKLGIHEDSQNRTKIAELLRYHSTKSGDELTSLKDYVTRMKEGQNDIYYITGESKKAVENSPFLEKLKKRGYEVLYMVDAIDEYAVGQLKEFEGKKLVSATKEGLKLDETEDEKKRKEELKEKFEGLCKVIKEVLGDKVEKVVVSDRVVDSPCCLVTGEYGWTANMERIMKAQALRDSSMAGYMSSKKTMEINPENPIMDELRKRAEADKNDKSVKDLVMLLFETALLTSGFSLDDPNTFGNRIHRMLKLGLSIDEDEPVEAEAEMPQLEDDAGESKMEEVD

SEQ ID NO: 4713 - protein, 698 aa, Zea mays
  Clone ID: PAT_MRT4577_146439C.1.pep
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGADVSMIGQFGVGFYSAYLVADRVVVTTKHNDDEQYVWESQAGGSFTVTRDTSGEQLGRGTKITLFLKDDQLEYLEERRLKDLVKKHSEFISYPISLWTEKTTEKEISDDEDEEEKKDAEEGKVEDVDEKEEKEKKKKKIKEVSHEWSLVNKQKPIWMRKPEEITKEEYAAFYKSLTNDWEEHLAVKHFSVEGQLEFKAVLFVPKRAPFDLFDTKKKQNNIKLYVRRVFIMDNCEELIPEWLSFVKGIVDSEDLPLNISRETLQQNKILKVIRKNLVKKCVELFFEIAENKEDYNKFYEAFSKNLKLGIHEDSQNRTKIAELLRYHSTKSGDELTSLKDYVTRMKEGQNDIYYITGESKKAVENSPFLEKLKKRGYEVLYMVDAIDEYAVGQLKEFEGKKLVSATKEGLKLDETEDEKKRKEELKEKFEGLCKVIKEVLGDKVEKVVVSDRVVDSPCCLVTGEYGWTANMERIMKAQALRDSSMAGYMSSKKTMEINPENPIMDELRKRAEADKNDKSVKDLVMLLFETALLTSGFSLDDPNTFGNRIHRMLKLGLSIDEDEPVEAEAEMPQLEDDAGESKMEEVD

SEQ ID NO: 4714 - protein, 259 aa, Zea mays
  Clone ID: PAT_MRT4577_146470C.1.pep
MAAAAAAAGTREEMVYMAKLAEQAERYEEMVEFMEKVAAAAELTVEERNLLSVAYKNVIGARRASWRIVSSIEHKEETRGAAGHAAAARGYRARVEAELSGICAGILRLLDERLVPAAAAVDARVFYLKMKGDYHRYLAEFKTGAERKDAADSTLAAYQAAQDIAVKELPPTHPIRLGLALNFSVFYYEILSSPDRACSLAKQAFDEAISELDSLGEESYKDSTLIMQLLRDNLTLWTSDMQEDGGDEMRDANKPDEEQ

SEQ ID NO: 4715 - protein, 590 aa, Zea mays
  Clone ID: PAT_MRT4577_146477C.1.pep
MGRGGARAAPAAAVPPWHALPDEVWEHAFSFLPADSDRGAAACACHAWLRFERRSRRRLAVANCYAASPRDAVERFPAVRAVEVKGKPHFADFGLVPPAWGADAAPWVAAAAAGWPLLEEISFKRMVVTDDCLEMIAASFRNFQVLRLVSCEGFSTAGLAAIAAACRNLRELDLQENEIEDCSIHWLSLFPVSFTSLVTLNFSCLEGDVNITVLEQLVTRCSNLKTLKLNNAIPLDKLANLLRKAPQIVELGTGRFSADYHPDLFSKLEAAFAGCKSLRRLSGAWDAVPEYLPAFYCVCEGLTSLNLSYATVRGPELIKFISRCKNLQLLWVMDLIEDHGLAVVASSCNKLQELRVFPSAPFEAAEQVSLTERGLVDVSASCPMLESVLYFCRRMTNEALITIAKNRPNFTCFRLCIIEPHTPDYITHQPLDAGFSAIVESCKGLRRLSVSGLLTDSVFKSIGAHADRLEMLSIAFAGNSDLGLHYILSGCKSLKKLEIRDCPFGDKPLLANAAKLETMRSLWMSTCSMTLGACRQLARKMPRLSVEVMNDPRRGFPLDSLTDESPVETLYVYRTISGPRSDTPACVQIL

SEQ ID NO: 4716 - protein, 499 aa, Zea mays
  Clone ID: PAT_MRT4577_146531C.1.pep
MVVSVAATGPGTDAEPVSSTFFASRYVRDPLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSCQIIAQYYQLIRLGFEGYRNIMENCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVATATAEQSGDGVVAKKSVLEIEREVAARWMNAVNKKKTGVC

SEQ ID NO: 4717 - protein, 220 aa, Zea mays
  Clone ID: PAT_MRT4577_146534C.1.pep
LTGQIPASLGALSALQVLRLGDNPGLSGAIPDALGKLGNLTALGLASCNLTCPIPASLVRLDALTALNLQQNALSGPIPRGLAGLASLQALSLAGNQLTGAIPPELGTLARLQKLNLGNNSLVGAIPPELGALGELQYLNLMNNRLTGRVPRTLAALSRVHTIDLSGNMLSGALPAELGRLPQLIFLVLSDNQLTGSVPGDLCGGDEAESSSIEHLMLSM

SEQ ID NO: 4718 - protein, 110 aa, Zea mays
  UNSURE (1)..(110): unsure at all Xaa locations
  Clone ID: PAT_MRT4577_146736C.1.pep
  unsure (1)..(110): unsure at all Xaa locations
PRVRKLRFICNMYRTGCWVREYHRTPSGVCNGTSGCQAMLIRCYIDRXHVQHDAVGXCAALGAMTYRCIKAVECEPHAVTYGRLLTSMKSIMTNASGCYQHLKGACATAR

SEQ ID NO: 4719 - protein, 234 aa, Zea mays
  Clone ID: PAT_MRT4577_146756C.1.pep
MSRLAAAALRCVVTASRDTSSSRFAVSAPVSARLFSADASGEAAATAAESQDDSFFKASREGLAYGRFYSVIGGGSRLEKNILKTDIIHHLDRCGLSLDDVKIEYNKGYAPLAALLRFSSKAMFTTAIRQANQNRLHRIDEISRETWDLKKSFDGKAVLLQGVPRNALADDIERFLCGTNFEPPPFETFLRAGVPEPIRMMLVKFHTKTDAMNAFITKNRSFCLNSQVSMRVLQ

SEQ ID NO: 4720 - protein, 140 aa, Zea mays
  Clone ID: PAT_MRT4577_147020C.1.pep
GGSGGAREGGGFGGGGPRYGGGGSGGGGGSGGGGGSGGGGGGFGGGPRGGGFGNSPGNWRNLPVGPARPSFPFRSRDVSPSPKGLSSFVSCLLFPPCVFYCKVPLCQLLVLCSPPVSADPCLQQHGLRVDGCFSPPPAFF

SEQ ID NO: 4721 - protein, 445 aa, Zea mays
  Clone ID: PAT_MRT4577_147063C.1.pep
MDEEYDVIVLGTGLKECILSGLLSVDGLKVLHMDRNDYYGGDSTSLNLNQLWKRFRGEDKPPAHLGASRDYNVDMVPKFMMANGTLVRTLIHTDVTKYLSFKAVDGSYVFSKGKIYKVPATDMEALKSPLMGLFEKRRARNFFIYVQDYNEADPRTHQGLDLTRVTTRELIAKYGLSDDTVDFIGHALALHRDDRYLDEPALDTVKRMKLYADSLARFQGGSPYIYPLYGLGELPQGFARLSAVYGGTYMLNKPECKVEFDMEGKVCGVTSEGETAKCKKVVCDPSYLPNKVRKIGRVVRAIAIMSHPIPNTNESHSVQIILPQKQLGRRSDMYVFCCSYTHNVAPRGKFIAFVSAEAETDNPQSELKPGIDLLGSVDEIFYDIYDRYEPVNEPSLDNCFVSTSYDATTHFETTVTDVLNMYTMITGKTVDLSVDLSAASAAEEY

SEQ ID NO: 4722 - protein, 52 aa, Zea mays
  Clone ID: PAT_MRT4577_147104C.1.pep
LLLPLLPSPPRIRVPYGFVGGLWQRVVWNTVSYTAGFPWPPTTNPWIKPFSS

SEQ ID NO: 4723 - protein, 394 aa, Zea mays
  Clone ID: PAT_MRT4577_147208C.1.pep
MADSGEGRRVCGMPEKAQLHVAMLLLQFGYAGFHVVSRLALNMGISKLVFPVYRNIIALCLLVPFAYFLEKKDRPQLTLNFVVQFFLLALCGITANQGFYLLGLDNTSPTFASAIQNSVPAITFAMAAALRIEKVRLDRRDGVAKVAGTLACVAGASVITLYKGPTIFGPSGSGGGGGGLELAAVGGDKNWTLGCVYLIGHCLSWSGWLVLQAPVLKKYPARLSVTSYTCFFGVIQFLVIAAFMERDAEAWKFHSGSELFTILYAGFIASGVAFAVQIWCIDRGGPVFVAVYQPVQTLVVAIMASLTLGEKFYLGGIIGAVLIVAGLYLVLWGKSEERARVARDAVSGGDREGLLVAAAAGGGGGGIVRSAGNKAASAATQPLLLPSSTPTDNV

SEQ ID NO: 4724 - protein, 400 aa, Zea mays
  UNSURE (1)..(400): unsure at all Xaa locations
  Clone ID: PAT_MRT4577_147210C.1.pep
  unsure (1)..(400): unsure at all Xaa locations
MADAGEGRRVCGMPEKAQLHVAMLALQFGYAGFHVVSRLALNMGISKLVFPVYRNIIALCLLVPFAYFLEKKDRPQLTLNFVIQFFLLALCGITANQGFYLLGLDNTSPTFASAIQNSVPAITFAMAAALRIEKVRLDRRDGVAKVAGTLACVAGASVITLYKGPTIFXPAAAAAAATSSSCXVAVAVAAGEKNWTLGCVYLIGHCLSWSGWLVLQAPVLKKYPARLSVTSYTCFFGVIQFLVIAAFMERDADAWKFHSGSELFTILYAGFIASGVAFAVQIWCIDRGGPVFVAVYQPVQTLVVAIMASLTLGEKFYLGGIIGAVLIIAGLYLVLWGKSEERARIARDAAAALVVSGAGDREGLLAAGGGGGGGIRSKAAASAAVTQPLLLPSSTSTDNV

SEQ ID NO: 4725 - protein, 67 aa, Zea mays
  UNSURE (1)..(67): unsure at all Xaa locations
  Clone ID: PAT_MRT4577_147268C.1.pep
  unsure (1)..(67): unsure at all Xaa locations
AVVLRYLAGEVLELAGNAARDNKXTRIVPRHIQLAVRHDEELNKLLGGATIASGGVMPNMGGXLLPK

SEQ ID NO: 4726 - protein, 54 aa, Zea mays
  Clone ID: PAT_MRT4577_147335C.1.pep
FDLDARATHAVRVSAATAEQSGDGVVAKKSVLEIEREVAARWRNAVNKKKTGVC

SEQ ID NO: 4727 - protein, 193 aa, Zea mays
  UNSURE (1)..(193): unsure at all Xaa locations
  Clone ID: PAT_MRT4577_147337C.1.pep
  unsure (1)..(193): unsure at all Xaa locations
WVPGPPRVDPRVRLNFSXGSCQIIAQYYQLIRLGFEGYRNXMENCQENAAILREGIAATGRFDVLSKDAGVPLVAFSLRDSSRFSVFDVSENLRRFGWIVPAYTTPADAEHVAVLRVVVREDFSRSLAERLVSDVRKILRELDARATHAVRVSTATAEQSGDGVVAKKSVLEIEREVAARWMNAVNKKKTGVC

SEQ ID NO: 4728 - protein, 159 aa, Zea mays
  Clone ID: PAT_MRT4577_147424C.1.pep
MDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLAGVTIAHGGVLPNINPVLLPKKTAEKASSGGSKEAKSPRKVAKSPKKA

SEQ ID NO: 4729 - protein, 159 aa, Zea mays
  Clone ID: PAT_MRT4577_147426C.1.pep
MDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLAGVTIAHGGVLPNINPVLLPKKTAEKASSGGSKEAKSPRKAAKSPKKA

SEQ ID NO: 4730 - protein, 313 aa, Zea mays
  UNSURE (1)..(313): unsure at all Xaa locations
  Clone ID: PAT_MRT4577_147427C.1.pep
  unsure (1)..(313): unsure at all Xaa locations
MGGMPDAWADAWADAWADAWADAWEILVCTHIIESGIDIAHANTMIIQFAELYGLAQLYQLRGRVGRSGTEGFAYLFYTDKSLLSXELQRLGAIEEHSELGQGFHVAEKDMGIRGFGSLFGEQQSGDVANVGIDLFFDMLFDSLSKVDQFCLVPVPYKDVQLDINISPRLSSEYISYLENPVELLNEAAKAAEKDLWTLIQFTEDLRRRYGKEPRDMELLLKKLYVRRMAADLGISRIYPSGKMIFMKTNMNKKVFRLMTEAMTSETHRNSLSFAEKEIKAELLVNLPDTLLLNWLFHCLSDCYTVIPALVKY

SEQ ID NO: 4731 - protein, 417 aa, Zea mays
  UNSURE (1)..(417): unsure at all Xaa locations
  Clone ID: PAT_MRT4577_147438C.1.pep
  unsure (1)..(417): unsure at all Xaa locations
GPSSFLSLARSPPFPRSLSSSSLHSYLRSRHSPPTEGQGTVPTRPPVRPPWSPGGAARPGCRRRRAPRSAPPXGGEAKVTPEADPAAQHDEADEERWSRLLPELLTEIMRRVDAGAERWPPRRDVVVCACVCRRWRDAAVSVVRPPLECGRITFPSSLKQPGPRDAPMHCFIRRDKKNSTFSLYLSLTQALTDKGKFLLAARRFRQGAHTEYIISYDYDDLHPRSSSYVGKLRSDFLGTKFIIYDSQAPYDGAKPSRTRSTRRFASKQISPQVSGGNFEVGQVTYRFNFMKSRGPRRMQCNIQCPVGQGSASDPSKEKTPSPSSLDLKNKAPRWHDHLQCWCLNFHGRVTVASVKNFQLVATAGSGGPWGVGDEETVILQFGKIEDDAFTMDYRQPLSAFQAFAICLTSFGTKLACE

SEQ ID NO: 4732 - protein, 302 aa, Zea mays
  Clone ID: PAT_MRT4577_147484C.1.pep
MGSEADCDRIRGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRKLAAASAPAGSSDVDARPTKRVSLSPDSPSGSGSGSGSGSGSDRSDLSHGAGQVYRPVARSGGFEPADCAMSRPLEEEEEEKEDPLTSLSLSLPGTDQRFHHDRAHSQFQELPASPPSPSPPPPPAGPTSAYPFSPVFMEAMQELIRTEVQRYMASVGVRAGCGAAGGADLCMPQLVDGVMRAAAERVGRMQ

SEQ ID NO: 4733 - protein, 110 aa, Zea mays
  Clone ID: PAT_MRT4577_147564C.1.pep
SESYYLRRRGLAPSPIGGSRFPLRAARARRLTAVLAVAPVRGMSHRHLDLVGVSCAPRAGMVMISHRVHSVLRLGHPGTNDVTGWQEVRSAADRVDRLDDIRSHNGAPGL

SEQ ID NO: 4734 - protein, 92 aa, Zea mays
  UNSURE (1)..(92): unsure at all Xaa locations
  Clone ID: PAT_MRT4577_147568C.1.pep
  unsure (1)..(92): unsure at all Xaa locations
EHDLESKADAGASKTYAHHAGTVRKNGFIGIKNRPXKVVVVPTSETVHHGHAKCHFAAIDIFNGKKLEDIAHXSHNCDITYVNRTEYQLIDL

SEQ ID NO: 4735 - protein, 87 aa, Zea mays
  Clone ID: PAT_MRT4577_147672C.1.pep
PGWPKGGAGGYGAGGGYAGRPQGGGGGYGGGGGGWRDLCVGPPWLGPSYLTHLKDRGPVRFGPRVRARSPLGLGVGTPAPPPVCPRY

SEQ ID NO: 4736 - protein, 501 aa, Zea mays
  Clone ID: PAT_MRT4577_147684C.1.pep
MDTVGVPVVAVANGIGEVERKVQKSYWEEHSKCLTVESMMLDSRAADLDKEERPEILSLLPSYKGKSVLELGAGIGRFTGDLAKEAGHVLALDFIESVIKKNQSINGHHKNITFRCADVTSNDLKIEDNSVDLIFSNWLLMYLSDEEVQKLVGKMVKWLKVGGHIFFRESCFHQSGDSKRKVNPTHYREPRFYTKVFKEGHSFDQDGGSFELSLVTCKCIGAYVKNKKNQNQICWLWEKVKSTEDRDFQRFLDNVQYKTSGILRYERVFGEGFVSTGGIETTKEFVGMLDLKPGQKVLDVGCGIGGGDFYMAANYDVHVLGIDLSVNMVSFAIERAIGRKCSVEFEVADCTTKDYPENSFDVIYSRDTILHIQDKPALFRSFFKWLKPGGKVLISDYCKNPGKPSEEFAAYIKQRGYDLHDVKAYGQMLKDAGFHNVIAEDRTEQFLNVLQREIGEVEKNKDAFLADFTQEDYDDIVNGWNAKLKRSSAGEQRWGLFIATK

SEQ ID NO: 4737 - protein, 151 aa, Zea mays
  UNSURE (1)..(151): unsure at all Xaa locations
  Clone ID: PAT_MRT4577_147695C.1.pep
  unsure (1)..(151): unsure at all Xaa locations
MAMTRPFLAPLMIVAAVLLSRMAAAAADDGDVLLQVKSAFVDDPXGVLAGWNDSAGSGAGSSGFCSWSGVACDASGLRVVGLNLSGAGLAGTVSRALARLDALEAIDLSSNALTGPVPAALGGLPNLQLLLLYSNQLTGQIPASLGALSAL

SEQ ID NO: 4738 - protein, 221 aa, Zea mays
  UNSURE (1)..(221): unsure at all Xaa locations
  Clone ID: PAT_MRT4577_148063C.1.pep
  unsure (1)..(221): unsure at all Xaa locations
YARSIGPESRVDHASGGIGMTQSXLVNNLGTIARSGTKEFMEALAAGADVSMIGQFGVGFYSAYLVAERXVVVTTKHNDDEQYVWESQAGGSFTVTRDTSGEQLGRGTKITLYLKDDQLEYLEERRLKDLIKKHSEFISYPISLWTEKTTEKEISDDEDEEEKKDAEEGKVXDVDEEKEEKEKKKKKIREVSHEXWSLVNKQKPIWMRKPEEITKXEEYAA

SEQ ID NO: 4739 - protein, 499 aa, Zea mays
  Clone ID: PAT_MRT4577_148084C.1.pep
TCIVKLAWVSMDYLAAAVPVTLALGVGAILLVLRWTYCRRRTSAEEARLPPGSRGLLFLGETLHYLAASSTPGVLPPFFQRRLERYGPIFRTNLVGEDLVVSLDAELNAHVLKQEERGFQIWYPPSFMRVFGADNITAKLGVLHHYMRTLVLRLFGHQTVRSVLLHDVQRSARDELRSWLGRPDVEVRTATSRMIFGVTAKKLISHDDAASGETLWRCFHDWTSGLLSFPVSIPGTTFYRCMQGRKKVMTMLKQQLVERRRNAAERETTEDFFDLVIDELNKPDPMMDESTALDLLFTMLFASHETTSMVLTVILKYLTDNPKALQELTEEHERILESRADPGSDLTWEEYRSMKFTSHVIHESLRLANIALAMFRKANQDVHINGYTIPKGSKIMMCALASHLNTEVYEDPSVFNPWRWKDIPEPVGTSKDFMAFGGGLRLCAGAEFSKMQMAMFLHYLVTNYSWKPVSGGTMLFYPGLQFPEGFHIQLLPKIPNVVP

SEQ ID NO: 4740 - protein, 496 aa, Zea mays
  Clone ID: PAT_MRT4577_148098C.1.pep
MVLSHASSGRDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTDKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYRNIMQNCQDNAAILREGIAATGRFGVLSKDAGVPLVAFSLRDSSRFSVFDVSENLRRFGWIVPAYTMPADAEHVAVLRVVVREDFSRSLAERLVSDVRKILRELDARATHAVRVATATAEQSGDGVVAKKSVLEIEREVAARWMNAVNKKKTGVC

SEQ ID NO: 4741 - protein, 415 aa, Zea mays
  Clone ID: PAT_MRT4577_148101C.1.pep
MLLATVHLLTACPLFLQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSCQIIAQYYQLIRLGFEGYRNIMENCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVATATAEQSGDSVVAKKSVLEIEREVAARWRNAVNKKKTGVC

SEQ ID NO: 4742 - protein, 520 aa, Zea mays
  Clone ID: PAT_MRT4577_148134C.1.pep
MAEQHKGPTNRVASDGLPDGVAPPRKKSNVRFAFACAILASMTSILLGYDIGVMSGAALFIKEDLKISDVEVEVLLGILNLYSLIGSFAAGRTSDWIGRRLTIILAAVIFFVGAFMMGFSVNYPMLMAGRFVAGIGVGYALMIAPVYTAEVSPASARGFLTSFPEVFINFGILLGYVSNYAFSRLPLRLGWRVMLGIGAAPSVVLALMVLGMPESPRWLVMKGRLADAKVVLGKTSDTPEEAAERLADIKAAAGIPQELDGDVVAVPKKRDSEEARVWKELILSPTPAMRRILLSGIGIHFFQQASGIDAVVLYSPRVFKAAGITSDNQLLGTTCAVGVTKTLFILVATFLLDRVGRRPLLLASTGGMVVSLVGLGFGLTVIGHHQEGTTIPWAIGVCIASILGVVAFFSIGLGPITWVYSSEIFPLHLRALGCALGVGLNRVTSGVISMTFLSLSKGITIGGSFFLYAGIASLAWVFFFTYLPETRGRTLEQMGGLFGIPNMAGDSDQLTSSRPRRRRP

SEQ ID NO: 4743 - protein, 482 aa, Zea mays
  Clone ID: PAT_MRT4577_148316C.1.pep
MMMMMMAGEHVLAALGTLLLASLLTLVLNHFLPLLLNPKAPRGSFGWPLLGETLRFLTPHASNTLGGFLEDHCSRYGRVFKSHLFCTPTVVSCDQDLNHFILQNEERLFQCSYPRPIHGILGKSSMLVVLGEDHKRLRNLALALVTSTKLKPSYLGDIEKIALHVVGAWRRHGGVRVVAFCEEARKFAFSVIVKQVLGLSPEEPVTARILEDFLAFMKGLISFPLYIPGTPYAKAVRARERISSTVKGIIKERRSAGSWNKQGDFLDVLLSSNELSDEEKVSFVLDSLLGGYETTSLLISMVVYFLGQSAQDLDLVKREHDSIRSNKGKEECLTSEDYKKMEYTQQVINEALRCGNIVKFVHRKALKDVKYKEYLIPSGWKVLPVFTAVHLNPSLHGDAQQFQPCRWEGTSQGTSKRFTPFGGGPRLCPGSELAKVETAFFLHHLVLNYRWRIDGDDIPMAYPYVEFQRGLPIEIEPTSPES

SEQ ID NO: 4744 - protein, 147 aa, Zea mays
  Clone ID: PAT_MRT4577_148470C.1.pep
AKQGLAEFVPSFVKPSFGNGTVLDKSDFRGSSGKTILDRPEPSKSNNSDDEAHQFWHKQLPDDIIPDFTSFEKVEQGPELSLAGLSLNAPPFYGTTSSRFSREYHELSSPVTKGLELELEHTNMLYEDKSNWEQNYIGDLHIANGNQ

SEQ ID NO: 4745 - protein, 178 aa, Zea mays
  UNSURE (1)..(178): unsure at all Xaa locations
  Clone ID: PAT_MRT4577_148473C.1.pep
  unsure (1)..(178): unsure at all Xaa locations
MGQSPERATYQLIDRREASMYSESRGEARDFARVRNTCFEQARQAYLVGNKALAKELSMKGQAYNVQMKAAHEKAREAIYRQRNPVSSQRGGGDHLIDLHGLHVNEAIHILKGELTALKSAARAAGERMQVMVCVGTGHHTKGSRTARLPXXAVEQFLLDEGLQYTQPQAGLLRVMVY

SEQ ID NO: 4746 - protein, 154 aa, Zea mays
  UNSURE (1)..(154): unsure at all Xaa locations
  Clone ID: PAT_MRT4577_148474C.1.pep
  unsure (1)..(154): unsure at all Xaa locations
AKQGLASMYSESRGEARDFARVRNTCFEQARQAYLVGNKALAKELSMKGQAYNVQMKAAHEKAREAIYRQRNPVSSXQRXGGDHLIDLHGLHVNEAIHILKGELTALKSAARAAGERMQVMVCVGTGHHTKGSRTARLPIXVEQFLLDEGLQYT

SEQ ID NO: 4747 - protein, 156 aa, Zea mays
  Clone ID: PAT_MRT4577_148475C.1.pep
MSSLNKVVSNSGDACSVLASKVTSLNPNAAEFVPSFVKPSFGNGTVLDKSDFRGSSGKTILDRPEPSKSNNSDDEAHQFWHKQLPDDIIPDFTSFEKVEQGPELSLAGLSLNAPPFYGTTSSRFSRDITNYLLQLPRALLELEHTNMLYEDKALEQ

SEQ ID NO: 4748 - protein, 117 aa, Zea mays
  Clone ID: PAT_MRT4577_148478C.1.pep
ATTPIFALSAHPHLSAPVSVRTRPPPTSPWPSRIRSRTRPCSGRRARTAAGGRALFSLPRLRPAAPWASRLSALRISSSTGGKAVASVGRRERAEQLSKAGALFAQLFYCYFGCAQV

SEQ ID NO: 4749 - protein, 317 aa, Zea mays
  Clone ID: PAT_MRT4577_148479C.1.pep
TCYRFWERKLQFLGLDFNHTIEILTQPEMQDDATHNHTLNLPHSTPNFSTGDFPALPTAEDQNGFNQGNVDVLGMFNGRSSSAMPTGAGDFVSAVRKLASQNSGQWKFKKGPEYGNGISALSVPKQYSSSTKQSSGNKFQSISSGRVAPWLETGDAVASMYSESRGEARDFARVRNTCFEQARQAYLVGNKALAKELSMKGQAYNVQMKAAHEKAREAIYRQRNPVSSQRGGGDHLIDLHGLHVNEAIHILKGELTALKSAARAAGERMQVMVCVGTGHHTKGSRTARLPIAVEQFLLDEGLQYTQPQAGLLRVMVY

SEQ ID NO: 4750 - protein, 380 aa, Zea mays
  UNSURE (1)..(380): unsure at all Xaa locations
  Clone ID: PAT_MRT4577_148480C.1.pep
  unsure (1)..(380): unsure at all Xaa locations
MSSLNKVVSNSGDACSVLASKVTSLNPNAAEFVPSFVKPSFGNGTVLDKSDFRGSSGKTILDRPEPSKSNNSDDEAHQFWHKQLPDDIIPDFTSFEKVEQGPELSLAGLSLNAPPFYGTTSSRFSREYHELSSPVTKGLELELEHTNMLYEDKSNWEQNYIGDLHIANGNQDLHYDSESGVSFSDSFASEYVAPSDGLFAPLEYLASQFPGFSAESLAELYYANGCDFNHTIEILTQLEMQVDATPNHTLNLPHSTPNFSTGDFPALPTAEDQNGFNQGNVDVLGMFNGRSSSAMPTGAGDFVSAVRKLASQNSGQWKFKKGPEYGNGISALSVPKQYSSSTKQSSGNKFQSISSGRVAPWLETGDAVASMYSEXRGEAR

SEQ ID NO: 4751 - protein, 96 aa, Zea mays
  Clone ID: PAT_MRT4577_148566C.1.pep
MVLVSAAKMSVRGKGGKGLGKGGAKRHRKVLRDNIQGITKPAIRMLSRRCGVNRISELIYEETRSVLKNFLENVIRYSVTYTEHARRKTVNGMDDY

SEQ ID NO: 4752 - protein, 137 aa, Zea mays
  Clone ID: PAT_MRT4577_14870C.1.pep
QCNKKSSRNGEQHHGPLLHGLRRQGRERAVVVRLRRGPRDDAQDGGEGQASGGVREPVVRPRPRAVPGPTVRRATEAFAELKVKELKNGRLAMFSMFGFFVQAIVTGKGPLENLADHIADPVNNNAWAYATNFVPGK

SEQ ID NO: 4753 - protein, 354 aa, Zea mays
  Clone ID: PAT_MRT4577_148772C.1.pep
MHPKARIHADPVREVDHFDCLPDSLVLLILNKVEDVRSLGRCYAVSKRLCGLVSLVHDVYVKIDRVVAVDGDAEGTLNLSSPKPRSIFSHFLKLMLFTIIKPFHNMRSPNGTARPLFPQLSQHSPAQVLRNFTHVRNLRIELPSGDVGTEEGVLLKWRAEYGSTLENCVILGGTRVDRKPVGGEHEPALEDNGSMPESFYTNGGLKLRVVWTISSLIAASTRHYLLRSIINGHPTLQSLVLTDADGQGTLCMGAKQLEEFRENQLSASACSNRTQVPACNMKLKYAPYVELPGGMALQGATLVAIKPSPEGSNGSHPNRKEAEGFVFGAFDGPFKAAVKALMKRRTYLLEMNGF

SEQ ID NO: 4754 - protein, 190 aa, Zea mays
  UNSURE (1)..(190): unsure at all Xaa locations
  Clone ID: PAT_MRT4577_14878C.1.pep
  unsure (1)..(190): unsure at all Xaa locations
MASSTMALSSTAFAGKAVNVPSSSAFEXARVTMRKTARKAKPAAASASPWNDPDRVLNLSPLSGEPPSYLTGEFPADYRCYTAKLSLDPXTFAKNRELEVIHSRWAMLGALGCVFPELLARNGLADDPEAFAELKVKELKNGRLAMFSMFGFFVQAIVTGKGPLENLADHIADPVNNNAWAYATNFVPGK

SEQ ID NO: 4755 - protein, 179 aa, Zea mays
  UNSURE (1)..(179): unsure at all Xaa locations
  Clone ID: PAT_MRT4577_148808C.1.pep
  unsure (1)..(179): unsure at all Xaa locations
PPVRPRVRVLIIAILNDGTIMTISKDSXKPPAVXDSWXLKEIFATGIVLGSYLSLMTDIVFWAIHKTDLFSNNFGVRTIRDRDHEMMFALHLQMSIASHALIFFTRPPSWFLVERPVLLLVTAILLAQLVNTFLAVYTNWGLGWIKGIGCGWTGVDWLYSIVNYFPLDLLKFLIRYMLI

SEQ ID NO: 4756 - protein, 235 aa, Zea mays
  UNSURE (1)..(235): unsure at all Xaa locations
  Clone ID: PAT_MRT4577_14887C.1.pep
  unsure (1)..(235): unsure at all Xaa locations
PAARASTCSLSTGEPPSYLTXEFPXDYGXWDTAGMTADPETXAKNXELEVIHXRWAMLXGALGXCVFPRAXLARNGVKFGKGXVWFKGRAPQIFXSEGGXLDYLGKPQALXTRQSILAIWAXCQVVLMGAXVEGXYRIAGGRLXGEVVDPXLYPWRGSFDPXLAWPNDPXAFSEXLRVKELRXGRLPMFXSCFGFFVQAIVXTGKGAXLKNLAGHIADPVNNXAWAYATNFVPGN

SEQ ID NO: 4757 - protein, 286 aa, Zea mays
  Clone ID: PAT_MRT4577_148946C.1.pep
IRHEGYDRVMAYKFHEDEHGEVFAEITKPGIEPYIGLHYPATDIPQAARFLFMKNKVRMICDCRARSVKIIEDEALSIDISLCGSTLRAPHSCHLKYMENMNSIASLVMAVVVNENEEDDEPEPEQPPQQQKKKRLWGLIVCHHESPRYVPFPLRYACEFLAQVFAVHVNKEFELEKQIREKSILRMQTMLSDMLFKESSPLSIVSGSPNIMDLVKCDGAALLYGDKVWRLQTAPTESQIRDIAFWLSEVHGDSTGLSTDSLQDAGYPGAASLGDMICGMAVAKIT

SEQ ID NO: 4758 - protein, 98 aa, Zea mays
  UNSURE (1)..(98): unsure at all Xaa locations
  Clone ID: PAT_MRT4577_149075C.1.pep
  unsure (1)..(98): unsure at all Xaa locations
MAGRSFSCQPQLVAAAAVLAAALLLLAAVAWTASAVVSCGEVTTSVAPCLMFAMVSAASPYVVICSGVRXINSLASFATYRQVTCNCLTSMXRGASGA

SEQ ID NO: 4759 - protein, 237 aa, Zea mays
  UNSURE (1)..(237): unsure at all Xaa locations
  Clone ID: PAT_MRT4577_149280C.1.pep
  unsure (1)..(237): unsure at all Xaa locations
TTNFRDEGGFPPHIHENKERLXLSKAAIENAGYTRKVGIGMDVAASEFFGEKDKTYDLNFKEENNDGSNKISRDSLKDLYKSFVYEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 4760 - protein, 240 aa, Zea mays
  Clone ID: PAT_MRT4577_149284C.1.pep
GQDATIVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 4761 - protein, 40 aa, Zea mays
  Clone ID: PAT_MRT4577_149388C.1.pep
YRVTVRFRHGVSVRSTFGLGVGTPVVPFVCSLLGNDTTEA

SEQ ID NO: 4762 - protein, 145 aa, Zea mays
  UNSURE (1)..(145): unsure at all Xaa locations
  Clone ID: PAT_MRT4577_149407C.1.pep
  unsure (1)..(145): unsure at all Xaa locations
MALSVEKTSSGRXYKVKDLSQADFGRLEIELAEVEMPGLMACHAEFGPSKPFAGARISGSLHMTIQTAVLIETLTALGAEVRWCSCNIFFTQDHPAGGIGRELGGGVGWKGETLEEYWWRTERWLDXTRGXGPHLILDNGWDDTL

SEQ ID NO: 4763 - protein, 485 aa, Zea mays
  UNSURE (1)..(485): unsure at all Xaa locations
  Clone ID: PAT_MRT4577_149410C.1.pep
  unsure (1)..(485): unsure at all Xaa locations
MALSVEKTSSGREYKVKDLSQADFGRXEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 4764 - protein, 428 aa, Zea mays
  UNSURE (1)..(428): unsure at all Xaa locations
  Clone ID: PAT_MRT4577_149511C.1.pep
  unsure (1)..(428): unsure at all Xaa locations
MSAEFCAAAGVVAMELGVGDVLGLQQGIAITAPSPRDSDLGLLKRAGLTQAAAAAPYPSPFLDEEKMLRFSKAAHTLHSGLDFGGPGEQAFLLSRTKMPFTPSQWMELEHQALIYKYLNAKAPXIPSSLLISISKSFRSSNRVSWRPLYQGYTNADSDPEPGRCRRTDGKKWRCSKEAMADHKYCERHINRNRHRSRKPVENQPKKTTKEVPAAAGSLPCAGPQGSLKKAKVNDSKPGTVSYWADSLNRTMLSREKANKPTEDSSLLLTSTNSQPTLSLLSQLKQQNKPDKLGPTLENESNPDTILKAWGGNQPSHKSISSTERHDAESLQSVLQNFSLAQNEKMESEKNKYSDSVLVSSTFYSADGPRATCLTPNMTQVKQDCISSSWEMPQGGPLGEILTNSKNSKDLSKCKPRSYGWLLNLDHAP

SEQ ID NO: 4765 - protein, 423 aa, Zea mays
  UNSURE (1)..(423): unsure at all Xaa locations
  Clone ID: PAT_MRT4577_149626C.1.pep
  unsure (1)..(423): unsure at all Xaa locations
MDKLSGSARLMIVSDLDHTMVDHHDEENLSLLRFGALWESVYCEDSLLVFSTGRSPTLYKELRKEKPMLTPDITIMSVGTEITYGEAMVPDDGWEEYLNNKWDRNIVVAETVSFSELKLQPETEQRPHKVSFFVDKKNAQEVIKSVAERLDKCGLDAKIIYSGGQDLDILPQGAGKGQALAYLLEKLSSCGKPPNNTLVCGDSGNDAELFSIPGVHGVMVSNAQEELLQWYTENAKDNPKIIHSNERCAAGIIQAIGHFKLGPNISPRDLQFXXAKEASFKPTDAVVKFYVLYEKWRRAEVPKSDSVIKYFKNITHANGVTIHPAGLELSLHASIDALGSCYGDKQGRKYRAWVDRLFITQTGSDSWVGRFDLWESEGDVRVCSLSSLALILKAESPEGFVLTHIQKTWLNGYSSGVEQAFKL

SEQ ID NO: 4766 - protein, 451 aa, Zea mays
  UNSURE (1)..(451): unsure at all Xaa locations
  Clone ID: PAT_MRT4577_149629C.1.pep
  unsure (1)..(451): unsure at all Xaa locations
MDKLSGSARLMIVSDLDHTMVXRPTHILVCLKLSVCKLFILLGWLKLAXDHHDEENLSLLRFGALWESVYCEDSLLVFSTGRSPTLYKELRKEKPMLTPDITIMSVGTEITYGEAMVPDDGWEEYLNNKWDRNIVVAETVSFSELKLQPETEQRPHKVSFFVDKKNAQEVIKSVAERLDKCGLDAKIIYSGGQDLDILPQGAGKGQALAYLLKKLSSCGKPPNNTLVCGDSGNDAELFSIPGVHGVMVSNAQEELLQWYTENAKDNPKIIHSNERCAAGIIQAIGHFKLGPNISPRDLQFPYAKEASFKPTDAVVKFYVLYEKWRRAEVPKSDSVIKYFKNITHANGVTIHPAGLELSLHASIDALGSCYGDKQGRKYRAWVDRLFITQTGSDSWVGRFDLWESEGDVRACSLSSLALILKAESPEGFVLTHIQKTWLNGYSSGVEQAFKL

SEQ ID NO: 4767 - protein, 125 aa, Zea mays
  Clone ID: PAT_MRT4577_149992C.1.pep
MAVEGDKKMVTLKSSDGEEFEVKKAVAMDSQTIRHMIEDDCANNGIPLTNGYSKSLFKVIEYCNKHVHAVDGAVAVLKAGFDDVGAVCANSKRVFGEDSKNWDADFVKVDQATLFDLILAANYLN

SEQ ID NO: 4768 - protein, 77 aa, Zea mays
  Clone ID: PAT_MRT4577_150003C.1.pep
MAAADVEYRCFVGGLAWATSNESLENAFASYGEILDSKVITDRETGRSRGFGLVTLFYENSMLDAIKNMNGMELDGR

SEQ ID NO: 4769 - protein, 364 aa, Zea mays
  Clone ID: PAT_MRT4577_150025C.1.pep
MSGMAARIGEWKPVMAMLIFDLISAVTTALIKKALQEGLDRLVLITLRQLVATVFLAPIAYFRERSTRPKLTLEILVYLFFSAAFGAALSQYTFFYGLQYTTATFAITFTNVAPVLTFLIAVLLRVESLSMKNKAGAAKIAGTLTSFAGVMLLTLYKGVSLTHQQAGEASPEDHNLGAAAASPSDRKSWTLGTLALLANCLCFSFWLLLQSRLTKKYPALYSSTAYMFLISSMQGGALTAAIQRRASVWLLTRPIEIVTVLYTGIMGSGVGYVLMTWCVEKRGPVFTSAFIPVIQIMVAMVDFFFLHENLYLGSVLGSILLILGLYILLWGKKRDASSSAAAKEEEDGEKEDEEEEDKEKQVRS

SEQ ID NO: 4770 - protein, 70 aa, Zea mays
  UNSURE (1)..(70): unsure at all Xaa locations
  Clone ID: PAT_MRT4577_150162C.1.pep
  unsure (1)..(70): unsure at all Xaa locations
GANRFQRINRKXEATRQNCLRQRTSPYPSRAHHFFSGKANRSFLPPSAQAITIRNPATRLXLLHMRAKDN

SEQ ID NO: 4771 - protein, 78 aa, Zea mays
  Clone ID: PAT_MRT4577_150265C.1.pep
TVVVVAPTPVATVAASAATQAGNGRNDRWGPRDQVILFSHVMFTLVQRGYHRSSRLLMPICVFDCKVPMCQVLMLCLS

SEQ ID NO: 4772 - protein, 78 aa, Zea mays
  Clone ID: PAT_MRT4577_150347C.1.pep
EVLRGSVSRVSGSRWAASDVEYPLLGTAASPEPRTTTSSTTPSGPTVKPSSPRLFLDRETQRSLRFRLRHLSPRTRAM

SEQ ID NO: 4773 - protein, 64 aa, Zea mays
  Clone ID: PAT_MRT4577_150619C.1.pep
GAELVVDLDSLPGQQQRAIRTARYPTASPFAVRRSHMSCSLHVVVLRSCNFWRVAVVFGSGCRI

SEQ ID NO: 4774 - protein, 94 aa, Zea mays
  UNSURE (1)..(94): unsure at all Xaa locations
  Clone ID: PAT_MRT4577_150645C.1.pep
  unsure (1)..(94): unsure at all Xaa locations
GDPAGDFVPGRFLGEEGSKLLQYVYWSHGREAENPRVGNKQGPGKNFVVLVGRLLLVELFLRXDPFPPEVGKELVGPRVIFPGVPKAPSGPGSE

SEQ ID NO: 4775 - protein, 120 aa, Zea mays
  Clone ID: PAT_MRT4577_150676C.1.pep
PNMMPFMMVPTMMSSKTIASMMPSLIMPNLVSPIMMPSMKLSMMTLSMMPSIMMLSMIPTMMMSSMVSSMIMSNMMAVPQCYSDSFSLIKLTLLLPFMFSSTFVAIGPMFLQKPSLGAAF

SEQ ID NO: 4776 - protein, 549 aa, Zea mays
  UNSURE (1)..(549): unsure at all Xaa locations
  Clone ID: PAT_MRT4577_150748C.1.pep
  unsure (1)..(549): unsure at all Xaa locations
MNTVALLSLAPQLLIKPSLTCFSRKGVGRYGGIKVYAVLRDDGAEFAKNNNLEALFHVDDPGPRVPIKKGKFLDVNEALEVVRFDIQYCDWRARHDLLTIMVLHNKVVEVLNPLAREFKSIGTLRKELAELQQELAKAHNQVHLSETRVSSALDKLAHMETLVNDRLLPPDGASSTSTAQPTSLVPSTSSTARVRAKKPPRRGLNVSGPVKPYNPSLKNFWYPVAFSSDLKDDTMVPIACFEEQWVIFRGKDGRPGCVQNTCAHRACPLHLGSVNEGRIQCPYHGWEYSTDGKCEKMPSTKMLNVRIQSLPCFEQEGMVWIWPGDDPPKATIPSLLPPSGFTVHAEIVMELPVEHGLLLDNLLDLAHAPFTHTSTFAKGWSVPSLVKFLTPASGLQGYWDPYPIDMEFRPPCMVLSTIGISKPGKLEGKSTQQCSTHLHQLHVCLPSSRNKTRLLYRMSLDFAPWLKHVPLMHLLWSHFAEKXVSQCDKVLNEDLRLVLGQQERMINGANVWNWPVSYDKLGVRYRLWRDTVERGSERLPFSNQAESGS

SEQ ID NO: 4777 - protein, 59 aa, Zea mays
  Clone ID: PAT_MRT4577_150830C.1.pep
SQHPRVSRIILDHRALPGHLRPALPGAHGERSRCAGQRCLLLGAVAAGAGLCAAPCAVV

SEQ ID NO: 4778 - protein, 147 aa, Zea mays
  UNSURE (1)..(147): unsure at all Xaa locations
  Clone ID: PAT_MRT4577_151076C.1.pep
  unsure (1)..(147): unsure at all Xaa locations
HLLAQNVRAQQVLQLVLANFDAYYQHQQFLPFTQLPAVNSDSHLQQHHQPFSQLSDAYPHQFLPFMQVTALNSHVYQQQQQLLPFSQLAGVSPVTFXTQPQLLPFXQQAAPNAVTLLQLQQSLPFNHLALTNASAFYHHPVGGGALF

SEQ ID NO: 4779 - protein, 116 aa, Zea mays
  UNSURE (1)..(116): unsure at all Xaa locations
  Clone ID: PAT_MRT4577_151226C.1.pep
  unsure (1)..(116): unsure at all Xaa locations
EGAARAAHTKHNIVPTISSKLFSLLIVGDLSASAATATIFPKCSHAPIASLLPPYXISPAVSSICENPILQPYRIQQAITVSILPLSPLFLQQSLTLLHQLPFVHLLAQNIMAQHL

SEQ ID NO: 4780 - protein, 63 aa, Zea mays
  UNSURE (1)..(63): unsure at all Xaa locations
  Clone ID: PAT_MRT4577_151308C.1.pep
  unsure (1)..(63): unsure at all Xaa locations
XKXXXRXDPGXDVAXXASLPPGSCHXXKHVMREAXAPRTSAGAHXCLFVFDXSRLRVADYXGT

SEQ ID NO: 4781 - protein, 234 aa, Zea mays
  Clone ID: PAT_MRT4577_15138C.1.pep
IAGLISIDLARDMLQVHPNSNALVISTEIITPNFYHGSRRDMLLPNCLFRMGAAAILLSNRRREARRAKYRLVHVVRTHKGADDRAYRCVYEEEDDEGHSGISLSKELMAIAGEALKSNITTMGPLVLPMSEQLLFFFRPVGRKVINNKWKPYIPDFKLAFEHFCIHAGGRAVIDELHKNLELSPRHVEASRMTLHRFGNTSSSSLWYELAYIEAKGRMRKGDRVWQIGFGSGF

SEQ ID NO: 4782 - protein, 83 aa, Zea mays
  Clone ID: PAT_MRT4577_151489C.1.pep
GRPTRTGKAAQENVHQQAEADSDEGREKGEGEANNWHRAPPTGMQQGEEHKEEQRQSSDWERDLPAKTLRGLLGENEDPTRQG

SEQ ID NO: 4783 - protein, 147 aa, Zea mays
  Clone ID: PAT_MRT4577_151621C.1.pep
MPVPLAPYPAPPAPFTPPNGAQSQLVCTGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCSFVTSVGSRSPAAELIVSLKVL

SEQ ID NO: 4784 - protein, 162 aa, Zea mays
  Clone ID: PAT_MRT4577_151622C.1.pep
MPVPLAPYPAPPAPFTPPNGAQSQLVCTGCRNLLMYPAGATSVCCAVCSTVTAVPAPGTEMAQLVCGGCHTLLMYIRGATSVQCSCCHTVNLAMEANQVAHVNCGNCRMLLMYQYGARRLPLFRCYSYCKTTCVSHEKQRTNRQVSLYSDLTWCRAEAQQLS

SEQ ID NO: 4785 - protein, 143 aa, Zea mays
  Clone ID: PAT_MRT4577_151624C.1.pep
MPVPLAPYPAPPAPFTPPNGAQSQLVCTGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCSFVTSVGTSPGAEQKPSS

SEQ ID NO: 4786 - protein, 171 aa, Zea mays
  UNSURE (1)..(171): unsure at all Xaa locations
  Clone ID: PAT_MRT4577_151786C.1.pep
  unsure (1)..(171): unsure at all Xaa locations
VIQGGIGPAGLSAXDLHVLDLTQQRPRWHRVVVQGPGPGPRYGHVMALVGQRFLLTIGGNDGKRPLADVWALDTAAKPYEWRKLEPEGEGPPPCMYATASARSDGLLLLCGGRDANSVPLSSAYGLAKHRDGRWEWAMAPGVSPSPRYQHAAVFVNARLHVSGGALGXGRM

SEQ ID NO: 4787 - protein, 117 aa, Zea mays
  Clone ID: PAT_MRT4577_151969C.1.pep
MTASQSSMSGGGEPGVRTVVWFRRDLRVEDNPALAAAARTAGEVVPAYVWSPEEDGPYYPGRVSRWWLSQSLKHLDASLRRLGAWRLVTRRSSDAVVALIDLVRSTGATHLFFQPTL

SEQ ID NO: 4788 - protein, 1003 aa, Zea mays
  UNSURE (1)..(1003): unsure at all Xaa locations
  Clone ID: PAT_MRT4577_152093C.1.pep
  unsure (1)..(1003): unsure at all Xaa locations
MIVQPIELRAWTAFPGSAQEGIGRMAASVSRAICVQKPGSKCTRDREATSFARRSVAAPRPPHAKAAGVIRSDSGAGRGQHCSPLRAVVDAAPIQTTKKRVFHFGKGKSEGNKTMKELLGGKGANLAEMASIGLSVPPGFTVSTEACQQYQDAGCALPAGLWAEIVDGLQWVEEYMGATLGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARGWGKCCVSGCSGIRVNDAEKLVTIGGHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALSGDLGTFMAWVDDVRKLKVLANADTPDDALTARNNGAQGIGLCRTEHMFFASDERIKAVRQMIMAPTLELRQQALDRXAVSEVLDQRGVGELVKFATERGRKARPNLKVGIXGEHGGEPSSVAFFAKAGLDYVSCSPFRVPIARLAAAQVLV

SEQ ID NO: 4789 - protein, 278 aa, Zea mays
  Clone ID: PAT_MRT4577_152094C.1.pep
HWVPRGRPGRIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKFATERGRKARPNLKVGICGEHGGEPSSVAFFAKAGLDYVSCSPFRVPIARLAAAQVLV

SEQ ID NO: 4790 - protein, 978 aa, Zea mays
  UNSURE (1)..(978): unsure at all Xaa locations
  Clone ID: PAT_MRT4577_152095C.1.pep
  unsure (1)..(978): unsure at all Xaa locations
MIVQPIELRAWTAFPGSAQEGIGRMTASVSRAICVQKPGSKCTRDREATSFARRSVAAPRPPHAKAXAGVIRSDSGAGRGQHCSPLRAVVDAAPIQTTKKRVFHFGKGKSEGNKTMKELLGGKGANLAEMASIGLSVPPGFTVSTEACQQYQDAGCALPAGLWAEIVDGLQWVEEYMGATLGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARGWGKCCVSGCSGIRVNDAEKLVTIGGHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEXPYTYQVLDQRGVGELVKLATERGRKARPNLKVGICGEHGGEPSSVAFFAKAGLDYVSCSPFRVPIARLAAAQVLV

SEQ ID NO: 4791 - protein, 882 aa, Zea mays
  Clone ID: PAT_MRT4577_152101C.1.pep
MAPVQCARSQRVFHFGKGKSEGNKTMKELLGGKGANLAEMASIGLSVPPGFTVSTEACQQYQDAGCALPAGLWAEIVDGLQWVEEYMGATLGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARGWGKCCVSGCSGIRVNDAEKLVTIGGHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKLATERGRKARPNLKVGICGEHGGEPSSVAFFAKAGLDYVSCSPFRVPIARLAAAQVLV

SEQ ID NO: 4792 - protein, 126 aa, Zea mays
  Clone ID: PAT_MRT4577_152170C.1.pep
EVIAVHGKAIGGVPAKKATSTISNAVLQFHVGRIASFLMAVKYAKRVSSGSPVYLTTVLEYLAAEVLELAGNASRYNKKTRIVPRHIQLAVRNDEELTKLFAVSTIASGCVMPNIHQHLLPNKAAF

SEQ ID NO: 4793 - protein, 55 aa, Zea mays
  Clone ID: PAT_MRT4577_152177C.1.pep
HTSRERPVSFKGSASSTPRPEQMSTMRMASKVWFHRSSAILSGDQYLCYGICRHL

SEQ ID NO: 4794 - protein, 293 aa, Zea mays
  Clone ID: PAT_MRT4577_152258C.1.pep
SRPAGVALSASATPPPPARSLLFPHFTLTRDVNTCSLVVDTVGEYHSGVGAKRNGRRKGKKGKKGKQDAPVTDFVPVKTQIRLDENTANNEAAGAAAEPVFVVGEAVNDSLPVVASESDFSRGKYLIYIGGGERCKSMNHFIWGFLCALGEAQFLNRTLVMDLNVCLNARYTSSGKDEERDFRLYFDFEHLKQSASVIDQSQFWQDWGQWHKKDRLKNFYTEDIRMTPMKLRDIKDTLIMRKFGNVEPDNYWSRVCEGETEGIIKRPWHFLWKLPRLMEIVSAIASRMNWDFD

SEQ ID NO: 4795 - protein, 58 aa, Zea mays
  Clone ID: PAT_MRT4577_152259C.1.pep
CRNVTGLARRCSRSTATPLCSERRLLANCLCGIPQIPVWTVYVTYRDGLINQTDLSQL

SEQ ID NO: 4796 - protein, 94 aa, Zea mays
  UNSURE (1)..(94): unsure at all Xaa locations
  Clone ID: PAT_MRT4577_152260C.1.pep
  unsure (1)..(94): unsure at all Xaa locations
PNLDRDTSPDSLLMALNDKVGAGRYLYIATXWDENSEWFTETKELSNGQPVEFDGYMRIAVDTEVFLRGKRHVETFNELTRDCKDGVNTCSASS

SEQ ID NO: 4797 - protein, 192 aa, Zea mays
  Clone ID: PAT_MRT4577_152261C.1.pep
CDTEAPVDCTGDRELFRVRMRAAIERFPDLHFYRFGRPVAVPGSPMECDLAWRFRPAADAIGTGRTTYYKDYRRFTLTRDVNTCSLVVDTVGEYHSGVGAKRNGRRKGKKGKKGKQDAPVTDFVPVKTQIRLDENTANNEAAGAAAEPVFVVGEAVNDSLPVVASESDFSRGKYLICIGGGERCKSMNHLFG

SEQ ID NO: 4798 - protein, 124 aa, Zea mays
  UNSURE (1)..(124): unsure at all Xaa locations
  Clone ID: PAT_MRT4577_152369C.1.pep
  unsure (1)..(124): unsure at all Xaa locations
PVNQAQSRGGGGGGGGYGGGRGGGGFGGGRRDGGFGGGGGFRGRREGGGGGFXGGGGYCGRRVGGGGGFRGGGGGWWDCCVGPSWLRPGCLICLSCRGSVRFCPRVSVRSPFGLGVGSPGGPFV

SEQ ID NO: 4799 - protein, 88 aa, Zea mays
  Clone ID: PAT_MRT4577_152373C.1.pep
TPYSESYIHLSAHHLINSPSMTQLPRPPSGFSCRCVRRGIDENYDGVIYQYASSSYVKEGYIEPRAVIYPTDDEDVFKAIEYARTNDV

SEQ ID NO: 4800 - protein, 79 aa, Zea mays
  UNSURE (1)..(79): unsure at all Xaa locations
  Clone ID: PAT_MRT4577_152422C.1.pep
  unsure (1)..(79): unsure at all Xaa locations
MAAKILCLLMLLGLSASAATATIFPRCSQAPIATLLPPYLSPTVSSVXCDNPILQPYRXIQQTITXAGILPXHPLLLQQ

SEQ ID NO: 4801 - protein, 446 aa, Zea mays
  Clone ID: PAT_MRT4577_152459C.1.pep
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEKNNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 4802 - protein, 446 aa, Zea mays
  Clone ID: PAT_MRT4577_152461C.1.pep
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 4803 - protein, 238 aa, Zea mays
  Clone ID: PAT_MRT4577_152504C.1.pep
MSAASKKLFQAARSLVLSASNRSVLAAEGRTAALATLTNFGRKTLPTAYLSYHKQGSHHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVN

SEQ ID NO: 4804 - protein, 237 aa, Zea mays
  Clone ID: PAT_MRT4577_152506C.1.pep
MSGSASRKLFQAARSIVLSASQRSSFSVLAAEGRTAALANFGRKILPSACSYHRQGSHAASGWGAIAAAVPAAVYMLQDQEAHAAEMERTFIAIKPDGVQRGLISEIVNRFERKGYKLVAIKLIVPSKGFAEKHYHDLKERPFFNGLCDFLSSGPVLAMVWEGEGVIKYGRKLIGATDPQKSEPGTIRGDLGVVVGRNIIHGSDGPETAKDEIALWFEPKELVSYTSNAEKWVYGVN

SEQ ID NO: 4805 - protein, 234 aa, Zea mays
  Clone ID: PAT_MRT4577_152508C.1.pep
MSGSASRKLFQAARSLVLSASQRSVLAAEGRTAALANFGRKTLPTAYSYHKQGSHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVN

SEQ ID NO: 4806 - protein, 161 aa, Zea mays
  UNSURE (1)..(161): unsure at all Xaa locations
  Clone ID: PAT_MRT4577_152531C.1.pep
  unsure (1)..(161): unsure at all Xaa locations
MTDSGDDHFESKADAVASKTYPKXGGTGRKNGFFVINNRPCKVVEVXSTSKTANNEHDXCHFVAIDIFNGKWLEHIVPSSHNCDIPHANRTEYHMIDISDDGSVRLLTSHGDTXDDLRLPTDETLVAHIREGIXKXKDLVETVQTAMWEEQICAMKDGGPQ

SEQ ID NO: 4807 - protein, 87 aa, Zea mays
  UNSURE (1)..(87): unsure at all Xaa locations
  Clone ID: PAT_MRT4577_152593C.1.pep
  unsure (1)..(87): unsure at all Xaa locations
LFSISGSEFVEMFVGVGASRVRELFKTAKENAPYIVYVDEIDAVVRHRGTGIGGGNEXREQTLNQXLTGMDGFEGNTGITVLLPLSI

SEQ ID NO: 4808 - protein, 62 aa, Zea mays
  UNSURE (1)..(62): unsure at all Xaa locations
  Clone ID: PAT_MRT4577_152730C.1.pep
  unsure (1)..(62): unsure at all Xaa locations
LEYLEERXLKDLVKKHSELVRYPICLWTEKTTEKEISDDEHEEEKKDAEEGKVEDVDEENEE

SEQ ID NO: 4809 - protein, 223 aa, Zea mays
  UNSURE (1)..(223): unsure at all Xaa locations
  Clone ID: PAT_MRT4577_153066C.1.pep
  unsure (1)..(223): unsure at all Xaa locations
MERLSTNQLYSSGVPVTVPTSLPCIPVSLDESFPRLPDAQSVLMERELRSTPLPPHQTTVAPIRGLFHSNTGSVGPLCSPPSVRFSSHSNPEQYPNHNSYNSQVPSTASSSTLNYGSQYGGFEPSITDFPRDIEPTWCPDPVESILGYSGDVPAGNNLTGTTSIGASDDLTKQTEWWTEFMNEDWKDMVDNPTSQKLNRLGNPVHHPTQXTISYPTTVSSQIC

SEQ ID NO: 4810 - protein, 121 aa, Zea mays
  UNSURE (1)..(121): unsure at all Xaa locations
  Clone ID: PAT_MRT4577_153096C.1.pep
  unsure (1)..(121): unsure at all Xaa locations
NCGRSRAYSCGWATPLLDISACADDAFLTXSDIKLNHAILGGEKHLPMCDELGSTSIVEYMAGRATQNSIMVAQWMLQTPGASSYMXCIGKDKFGEEMKKNAQAAGVTAHYYQDETAPTGT

SEQ ID NO: 4811 - protein, 177 aa, Zea mays
  UNSURE (1)..(177): unsure at all Xaa locations
  Clone ID: PAT_MRT4577_153097C.1.pep
  unsure (1)..(177): unsure at all Xaa locations
MGNPLLDXSAVVDDAFLTKYDIKLNNAILAEEKHLPMYDELASKSNVEYRAGGATQNSIRVAQWMLQTPGATSYMGCIGKDKFGEEMKKNAQAAGVTAHYYEDETAPTGTCAVCVVGGERSLIANLSAANCYKSEHXKRPENWALVEKAKYXYIAGFFLTVXSADFIQVVXEHACRK

SEQ ID NO: 4812 - protein, 178 aa, Zea mays
  UNSURE (1)..(178): unsure at all Xaa locations
  Clone ID: PAT_MRT4577_153098C.1.pep
  unsure (1)..(178): unsure at all Xaa locations
MAGREGVLLGMGNPLLDISAVVDDAFLTKCDIKLNNAILAEEKHLPMYDELAGGGGVEYLAGGATQNSIRVAQWMLQTPGXXSYMGCIGKDKFGEEMKKNAQAAGVTAHYYEDETAPTGTCAXCVVGGERSLLANLXAAPCFKSEHLXRPENWALVEKAKYIFLAGFFLSVSPDSIQL

SEQ ID NO: 4813 - protein, 84 aa, Zea mays
  Clone ID: PAT_MRT4577_153226C.1.pep
THTPHTAPAQLSSADQDNQSWLCRARVAAAAPLLLLLLVAAAAQLVSSVSPADSDIRHKSCRTTHYPPACEQSLASYRSSSSTR

SEQ ID NO: 4814 - protein, 99 aa, Zea mays
  UNSURE (1)..(99): unsure at all Xaa locations
  Clone ID: PAT_MRT4577_153353C.1.pep
  unsure (1)..(99): unsure at all Xaa locations
GSPAYGLVGERIEMRASDAEYRCFVGDLAWTTHDHSLHNGFSTYGEVLETRIILHRETHRSHEYDLYTFSTXEAMRNAIQGLNGKKLDCRYITICEGQH

SEQ ID NO: 4815 - protein, 101 aa, Zea mays
  UNSURE (1)..(101): unsure at all Xaa locations
  Clone ID: PAT_MRT4577_153561C.1.pep
  unsure (1)..(101): unsure at all Xaa locations
MAANMLCLLMLLGIYASAATDTIFPHCSQAPIAYLLTTYLSPAVYSVCENTILHPYRIQQAIAAGILPLXPLFLQQSSALLHSLPLVHSSAQNILAQQLQQ

SEQ ID NO: 4816 - protein, 137 aa, Zea mays
  UNSURE (1)..(137): unsure at all Xaa locations
  Clone ID: PAT_MRT4577_153600C.1.pep
  unsure (1)..(137): unsure at all Xaa locations
HGTGNXGGMGQLGEHGGXXGMGGGQFQPAREEHKXXGGILHRSGSSSSSSSEXDDGXMGGRRKKGIKEKIKEKLPGGHKDDQHATATTGGAYGQQGHTGSAYGQQGHTGGSYATGTEGTGEKKGIMDKIKEKLPGQH

SEQ ID NO: 4817 - protein, 179 aa, Zea mays
  UNSURE (1)..(179): unsure at all Xaa locations
  Clone ID: PAT_MRT4577_153667C.1.pep
  unsure (1)..(179): unsure at all Xaa locations
SPLFLXQHPSALLQQXPFGPLGAQHIRAQQLQHLVLATLAAYSQPPQFLPFTQLAALNSAAYLPTQFPFSQLVAASPQQFFPFTHLAALTSAAYLQQQQLLPFTQLADVTPAAFLTPPQLFPFYLHATPNAGPLLHLPQLLPFTHLAFQNPPVFPQNPLIGGPPFRLLMSYSSIMKFFG

SEQ ID NO: 4818 - protein, 221 aa, Zea mays
  Clone ID: PAT_MRT4577_153677C.1.pep
MDRKRIKDALEKHLERSSPSTSRGVVSKERERLAAGKLPSSLGKAEVSDGEEFETDSEDSDVSGSEGEDTSWISWFCTLRGNEFFCEIDDDYIQDDFNLCGLSNQVPYYDYALDLILDIESSNDDGFTEEQNELIESSAEMLYGLIHARYILTSKGLAAMLEKFKNYYDFGRCPRVYCCGQPCLPAGQSDVPRSSTVKIYCPKCEELNYPRSKYQGSILLI

SEQ ID NO: 4819 - protein, 111 aa, Zea mays
  UNSURE (1)..(111): unsure at all Xaa locations
  Clone ID: PAT_MRT4577_153694C.1.pep
  unsure (1)..(111): unsure at all Xaa locations
SSPSSPRILSSSXVTSVCENPIFXTPTGIQHGISHAGILILYHPLFLQHXSRALLQSVTLLVHLIGXNIMGTYNYIQLVLANXLAAYSHQQQFLPFNQLGSLNSASYLQQQ

SEQ ID NO: 4820 - protein, 100 aa, Zea mays
  UNSURE (1)..(100): unsure at all Xaa locations
  Clone ID: PAT_MRT4577_153777C.1.pep
  unsure (1)..(100): unsure at all Xaa locations
LSTEFPAFAAGALQSYKVGAEAISKIESLPGXSMQALCNTAVXEVFDLTGYDWVVAYIFHEDEHGGGGGVITKRGIEPCLGLHYAATDIPQAAKFLLMKN

SEQ ID NO: 4821 - protein, 424 aa, Zea mays
  Clone ID: PAT_MRT4577_153882C.1.pep
MAARAADENRRPAAGKPAPGVRDMASRRALTDIKNLVGAAPYPYAVAKKPMLQKSKRDEKQPALASSRPMTRKFAASLASKGQPECQPIVADPEPEVCQQKESVGDGTVDIDVELYELVDGSDSDIDMGATENKDIMNEDELLMDIDSADSGNPLAATEYVKELYTFYRENEAKSCVRPDYMSSQQDINSKMRAILIDWLIEVHYKFELMDETLFLTVNVIDRFLEKEVVPRKKLQLVGVTALLLACKYEEVSVPVVEDLVLISDRAYTKGQILEMEKLILNTLQFNMSVPTPYVFMKRFLKAADADKQLELASFFMLELCLVEYQMLNYRPSHLAAAAVYTAQCAINRCQHWTKVCESHSRYTSDQLLECSRMMVDFHQKAGTSKLTGVHRKYSTYKFGCVAKILPAQFLLESGGTPPPSGAN

SEQ ID NO: 4822 - protein, 80 aa, Zea mays
  Clone ID: PAT_MRT4577_153884C.1.pep
MARIGASHVLLVVLLLSAVLSSGSARVPRERPDAMLPAGQTAAMAEMTVPGEGQSSGPAFGVAAHESKRLSPGGPDPQHH

SEQ ID NO: 4823 - protein, 69 aa, Zea mays
  UNSURE (1)..(69): unsure at all Xaa locations
  Clone ID: PAT_MRT4577_153932C.1.pep
  unsure (1)..(69): unsure at all Xaa locations
YQLIYISKDGFVSLLTSNGNPKDDLRLPTDXTPVAQIKERFXNGQDPVVTVQSSMGEEQICALKDVGPK

SEQ ID NO: 4824 - protein, 67 aa, Zea mays
  Clone ID: PAT_MRT4577_153979C.1.pep
GDSLEEFLTKATPDKNLIRLLICMGDARGTIAVKVRAASCGESACVKSFGDEQLAVDRRANRLLFEA

SEQ ID NO: 4825 - protein, 578 aa, Zea mays
  UNSURE (1)..(578): unsure at all Xaa locations
  Clone ID: PAT_MRT4577_154033C.1.pep
  unsure (1)..(578): unsure at all Xaa locations
MSNHNAPCDIPKPASVDEFLAKNGKKKKSFMSGLFRKKGRGADKKLLSRRDIVFDLEGRSGDRMDLLETSAAVRKSFSDRHCTTRIENLTLSCLDSPRRPNVDTREYRVFVGTWNVGGKPPDSSVNLQEFLQIEGLPDIYVLGFQEIVPLNAGNVLVVEDNEPAGKWMDLIYQALNRPPPHQDGQSSGDELSPPPSTSSSHYPSRPQGAARDPSNAAAIPKTSSGGMLCAQKPPPPLKMVSKCYRVDNALVKTCTCMSDPSTMQLRAREMREFXSAASRPPPPRRAAAPTTTRWPPSKAATRGAXGGMNYCLVARKQMVGIFLSVWVRRELVQYVGHLRVDCIGRGIMGRLGNKGCIAMSMTLHHTSICFVCCHLASGEKEGDEVRRNSDVAEILKNAQFPRICKVPGQRVPEKIIDHDRIIWLGDLNYRVSLSYEETKTLLEDNEWDILLEKDQLAMERQAGRVFKGWKEGKIYFAPTYKYKQNSDSYLWETAKSKKKRRTPAWCDRILWHGQGIEQLQYIRGEFRLSDHRPVCSVFVIEADVDSGSKIRKGYSTLDARIHCESPEIPKRHSFYDDF

SEQ ID NO: 4826 - protein, 126 aa, Zea mays
  UNSURE (1)..(126): unsure at all Xaa locations
  Clone ID: PAT_MRT4577_154109C.1.pep
  unsure (1)..(126): unsure at all Xaa locations
AYSKQEQFLPYNQLAALTCGANVQQQLPFSQLAGAYPQQFLPFNQLTALNSDAYLQQQQLPPFSQXTDVSPIAFLTQQQLLPFHVRFEPSAGTLLQLHRLQPFSQHALTXNTAAFXQQPIIGGALL

SEQ ID NO: 4827 - protein, 124 aa, Zea mays
  UNSURE (1)..(124): unsure at all Xaa locations
  Clone ID: PAT_MRT4577_154174C.1.pep
  unsure (1)..(124): unsure at all Xaa locations
MAAKIFCLLMLLGISASAATATIFPQCSQAPIAFLLPPYLSPALPSVXENPRGGPYRIQQANQGGIXLPVSPLDLQQSSDLLQQLPSLHLLEHNMKGKHLQQLELSNLGNYSQKQEFIRFNQQR

SEQ ID NO: 4828 - protein, 107 aa, Zea mays
  Clone ID: PAT_MRT4577_154234C.1.pep
MSGSSGSGVWVFKNGVMQLEQPAAAASRKALVYVPTNEVVRSVEALERRLGTLGWERYYENRSIVQLHKRDGGADLITIPRDFASLRSTHMYDVVVKNRDHFKVVDA

SEQ ID NO: 4829 - protein, 117 aa, Zea mays
  Clone ID: PAT_MRT4577_154241C.1.pep
RNIPVKEAQSPPALGTAAGGYGGARGGGGFGGGGPRNGGGGFGGGAGGSGGAGGSGGGGGGYGGGNRGGGFGNSAGNWRNLPVGPARPSYPVRSRDVSPSPKGLFSFVSFGVAPLGF

SEQ ID NO: 4830 - protein, 90 aa, Zea mays
  Clone ID: PAT_MRT4577_154243C.1.pep
AGFGGGGPRYGGGGYAGGAAGYGAAGGSGGGGGGYGGGTRGGGYGNSAGNWRNLPVGPARPSYPVRSRDVSPSPKGLSSFVPFVVAPLCF

SEQ ID NO: 4831 - protein, 61 aa, Zea mays
  Clone ID: PAT_MRT4577_154376C.1.pep
GYGGGRGKGGYGGGGPRYGGGGYSGGAGYGGGGGGYGGGGGGYGGGNRGGGYGKSDGNWRK

SEQ ID NO: 4832 - protein, 360 aa, Zea mays
  Clone ID: PAT_MRT4577_154389C.1.pep
MEAWPDDFRCPITLEVMTDPVILPSGHTFERRSIQSWLDGGHLTCPVTNLPLPPSPPLIPNHALRRLIAAVSPSAAASLVPAEGGAHARQEAVSAAAAAAVPARPASPVPALLRLAKSGAAGRKEVLESGSAAVLLRHAEAGDEAAARALLHLSLDGDDTRVGLVADGAVDALSAAVSRGGAAAASAATALTSLATVDVNKCTIGAHPSAIPALAGLLRRGGPRERREAATALYELCKLPENRRRAVREGAAPALADFAAAGSARAVEVLGLLARCREGRQELCRVPGVVSVLTGAAGSGNARAIEQALLVLNWICSESNELAVEAIKLQAFDLCEALVNDDNCKIAKNAVDLARTLEKA

SEQ ID NO: 4833 - protein, 63 aa, Zea mays
  UNSURE (1)..(63): unsure at all Xaa locations
  Clone ID: PAT_MRT4577_15444C.1.pep
  unsure (1)..(63): unsure at all Xaa locations
MAAFNKLGGLLRHSALVSGITGGSXPAVFNAXRLMFTKVGRGGXDWGVDDLKLKEAFSRFGEV

SEQ ID NO: 4834 - protein, 64 aa, Zea mays
  Clone ID: PAT_MRT4577_154488C.1.pep
VKPLIPKFARMIRKRSHDFLPFPTTRRSRPRAKTSKPDSLPRTRPNPRSRHLSGRRAAAAARGP

SEQ ID NO: 4835 - protein, 50 aa, Zea mays
  Clone ID: PAT_MRT4577_154566C.1.pep
LAGADIKKALEIVPANRDVKLEYKFLKEKFKGSTKKAANFYSNMFAKMTK

SEQ ID NO: 4836 - protein, 135 aa, Zea mays
  Clone ID: PAT_MRT4577_154720C.1.pep
FLLLGFVTHGKGVLSHAVAAGISELEGVVFEVVITFALVYTVYATAADPKKGSLGTIAPIAIGFIVGANILAAGPFSGGSMNPARSFGPAVAAGNFAGNWVYWVGPLVGGGLAGLVYGDVFIGGSYQQVADQDYA

SEQ ID NO: 4837 - protein, 231 aa, Zea mays
  Clone ID: PAT_MRT4577_154721C.1.pep
MVKLAFGSVGDSFSATSIKAYVAEFIATLLFVFAGVGSAIAYGQLTNGGALDPAGLVAIAIAHALALFVGVSVAANISGGHLNPAVTFGLAVGGHITILTGVFYWVAQLLGATVACLLLGFVTHGKAIPTHAVAGISELEGVVFEVVITFALVYTVYATAADPKKGSLGTIAPIAIGFIVGANILAVAAGDFAGNWVYWVGPLVGGGLAGLVYGDVFIGGSYQQVADQDYA

SEQ ID NO: 4838 - protein, 341 aa, Zea mays
  Clone ID: PAT_MRT4577_154722C.1.pep
MEVALKESPTLPKASFTILSCLIALFAAGRKTCLARARSELERIGCCRTRGRTRGRTRGRTRGRTRGRTRGQAQSLRAPAKSCGREEQRNKMVKLAFGSVGDSFSVTSIKAYVAEFIATLLFVFAGVGSAIAFGQLTNGGALDPAGLVAIAVAHALALFVGVSVAANTSGGHLNPAVTFGLAVGGHITVLTGLFYWVAQLLGASVACLLLRFVTHGKAIPTHGVSGGTTELEGVVFEIVITFALVYTVYATAADPKKGSLGTIAPIAIGFIVGANILAAGPFSGGSMNPARSFGPAVAAADFAGNWVYWVGPLIGGGLAGLVYGDVFIGGSYQQVADQDYA

SEQ ID NO: 4839 - protein, 138 aa, Zea mays
  UNSURE (1)..(138): unsure at all Xaa locations
  Clone ID: PAT_MRT4577_154723C.1.pep
  unsure (1)..(138): unsure at all Xaa locations
LPPSRREFRDIYVIFELMESDLHQVIKANDDLTAEHHQFFLYQLLRGMKYIHAASVFHRDLKPKNILANADCKLKICDFGLARVSFNDTPSAIFWTDYVATRWYRAPELCGSFFSXGKNVVHQLDLMTDLLGTPSAES

SEQ ID NO: 4840 - protein, 253 aa, Zea mays
  Clone ID: PAT_MRT4577_154726C.1.pep
MQDMMVKLAFGSVGDSFSATSIKAYVAEFIATLLFVFAGVGSAIAYGQLTNGGALDPVGLVAIAIAHALALFVGVSVAANISGGHLNPAVTFGLAVGGHITILTGVFYWVAQLLGATVACLLLGCRTHGKAIPTHAVAGINELEGVVIEVVITFALVYTVYATAADPKKGSLGTIAPSAIGFIVGANILAAGPFSGGSMNPARSFGPAVAAGNFAGNWVYWVGPLVGGGLAGLVYGDVFIGGSYQQVADQDYA

SEQ ID NO: 4841 - protein, 250 aa, Zea mays
  Clone ID: PAT_MRT4577_154729C.1.pep
MVKLAFGSVGDSFSVTSIKAYVAEFIATLLFVFAGVGSAIAYGQLTNGGALDPAGLVAIAIAHALALFVGVSVAANISGGHLNPAVTFGLAVGGHITILTGVFYWVAQLLGATVACLLLGFVTHGKAIPTHAVAAGISELEGVVFEVVITFALVYTVYATAADPKKGSLGTIAPIAIGFIVGANILAAGPFSGGSMNPARSFGPAVAAGNFAGNWVYWVGPLVGGGLAGFIYGDVFIGGSYQQVADQDYA

SEQ ID NO: 4842 - protein, 126 aa, Zea mays
  Clone ID: PAT_MRT4577_154853C.1.pep
IRLELESIIFLDRETQRSRGFGLVTFSTEEAMRNAIQGMNGKELDGQNITVNEAQSRGGRRGSGGGYSGGRGGSGYSRGGRHDGCSGYCGGRRSYGGCGCYGGGGGGYSCGNRGGCYGYYHGNWRN

SEQ ID NO: 4843 - protein, 37 aa, Zea mays
  Clone ID: PAT_MRT4577_154868C.1.pep
KNGVVGWGRQWRSKTVFLVASLSDYHLKRFAQVICRL

SEQ ID NO: 4844 - protein, 50 aa, Zea mays
  Clone ID: PAT_MRT4577_154932C.1.pep
TKAGRGLLSSGLGSVDSLCDNLGKKIKQHKVQKDDTDLLIRTTWHLHRQI

SEQ ID NO: 4845 - protein, 98 aa, Zea mays
  Clone ID: PAT_MRT4577_155037C.1.pep
PRVRSRVRPRVRSSGAPCLGYAMGSSVSSSAACYSCVRSLNSRASSTADRHATCNCLNSMTGRLGGSVSMANSANIPGKCCDSVGVPISLTVDCTKIN

SEQ ID NO: 4846 - protein, 78 aa, Zea mays
  Clone ID: PAT_MRT4577_155113C.1.pep
MADNAKAAAAHARPESSQEEEEDWKEAEGDVAEVDRAATNGAGEGGVPTDRPIRVYADGIYDLFHFGHAKSLEQAKKS

SEQ ID NO: 4847 - protein, 180 aa, Zea mays
  Clone ID: PAT_MRT4577_155451C.1.pep
ACKYEEVSVPVVEDLVLISDRAYTKGQILEMEKLILNTLQFNMSVPTPYVFVKRFLKAADADKQLELVSFFMLELCLVEYQMLNYRPSHLAAAAVYTAQCAINRCQQWTKVCESHSRYTGDQLLECSRMMVDFHQKAGTGKLTGVHRKYSTYKFGCAAKILPAQFMLESGGTAPPPSGAI

SEQ ID NO: 4848 - protein, 49 aa, Zea mays
  Clone ID: PAT_MRT4577_155761C.1.pep
HQHDVICIKCTENPKNLKKATQTNRTIQLVWTGRRRSPSRLQQELSRQK

SEQ ID NO: 4849 - protein, 72 aa, Zea mays
  Clone ID: PAT_MRT4577_15580C.1.pep
WTLLAPLLSSMLLVGLAAGSDDDEDGGRIRKPHFNYGKFNADPWTEGQATSQCGRHSLTQPTERGSWCDADH

SEQ ID NO: 4850 - protein, 263 aa, Zea mays
  UNSURE (1)..(263): unsure at all Xaa locations
  Clone ID: PAT_MRT4577_155911C.1.pep
  unsure (1)..(263): unsure at all Xaa locations
MASSSPDLADDGFAAPRLFSQGVSYTYDDVIFLPGYIGFPADAVDLSTRLSRRVPLSIPCVASPMDTVSEAAMAAAMASLGAAAVVHCNTEPHSQAAIVRAAKSRRLPFVSSVPFFSPSSSPTLNDFAGSEYALVTERGDSLSRLVGIAVAADAASREVPISVSEYMRPTPRSASSAFDFEEAATFLADEGLDYAPLVSDDGEVVDLITAKDVERIRSYPKLGKPSLGAXGKFVVAASIGTREXDDRXRLEQLVKAGXNAIVI

SEQ ID NO: 4851 - protein, 502 aa, Zea mays
  UNSURE (1)..(502): unsure at all Xaa locations
  Clone ID: PAT_MRT4577_155915C.1.pep
  unsure (1)..(502): unsure at all Xaa locations
MASSSTDLADDGFAAPRLFSQGVSYTYDDVIFLPGYIGFPADAVDLSTRLSRRIPLSIPCVASPMDTVSEAAMAAAMASLGAAAVVHCNTDPHAQAAIVRAAKSRRLPFVSSVPFFSPSSAPTLNDFAGSEYALVTERGDSLSRLVGVAVAADAASREVPVSVSEYMRPTPRSASAXFDFEEAATFLGXDKGLDYAPLVSDDGEVVDLITAKDVERIRSYPKLGKPSLGANGKFVVAASIGTREDDKGRLEQLVKAGANAIVIDSSQGNSIYQLDMIKFAKKMYPEVDLIGGNVVTIAQAQNLIQAGVDGLRVGMGSGSICTTQEVCAVGRGQATAVYKVSSYAKDHNVPVIADGGISNSGHIVKALSLGASTVMMGSFLAGSHEAPGTYEYKDGRRVKKYRGMGSLEAMTKGSDARYLGDTLKLKVAQGVVGAVADKGSVLRFIPYTMQAVKQGLQDLGADSLQSAHDLLRSETLRLEVRTGAAQAEGGIHGLVSYEKKAF

SEQ ID NO: 4852 - protein, 79 aa, Zea mays
  UNSURE (1)..(79): unsure at all Xaa locations
  Clone ID: PAT_MRT4577_155953C.1.pep
  unsure (1)..(79): unsure at all Xaa locations
YMMFQFYFCPAGEGPFFGCPGPHPFPCSRGVLFPPFKKWMFXQRLFRGGGPFQLPGVAXWPTDTPARGLCLGFCPVCLE

SEQ ID NO: 4853 - protein, 424 aa, Zea mays
  Clone ID: PAT_MRT4577_155978C.1.pep
MENLRSQNCHQGVAMEGVKFAPEKANTNRRALSDIKNIIGGPHQHLAVSKRALSEKPAAAAAANAKDQAGFVGHRPVTRKFAATLATQPTVALLDPIGSERLKRNADTAFHTPADMESTKMTDDSPLPMVSEMDEMMSPELKEIEMEDIEEAAPDIDSGDAGNSLAVADYVDEIYRFYRKTEGASCVPTNYMSSQTDINEKMRGILIDWLIEVHYKLELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEMLQFCPSMLAAAAIYTAQCTINGFKSWNKCCELHTRYSEEHLMVCSRMMVELHQRAAHGKLTGVHRKYNTSRYSYAAKSEPATFLLDA

SEQ ID NO: 4854 - protein, 283 aa, Zea mays
  Clone ID: PAT_MRT4577_156281C.1.pep
PTRPRTRGRDDSYQKWRWQPAGCDLPRFDARLLLERLRNKRLMFVGDSLNRNQWESMVCLVQSVIPDRGQKTLTKFVNGGSSNVFYAHEYNATVEFYWAPFLVESNSDNPKVHSVPDRVIQWHAIAKHARNWIGVDYLVFNTYIWWLNTLDMKVLKQGSSFDDQGGSTEYVEVDRPVAYKEVLTTWAKWVDRNIDPNRTTVFFMGMSPNHITPEAWGNKGGIKCAMETLPIASNRSAALDVGTDWRLYAGAREVLPTLRRVPVHFVDITALSELRKDAHTLVH

SEQ ID NO: 4855 - protein, 460 aa, Zea mays
  UNSURE (1)..(460): unsure at all Xaa locations
  Clone ID: PAT_MRT4577_156283C.1.pep
  unsure (1)..(460): unsure at all Xaa locations
RGAEAGPTRPGGALTRRSLRRPRRRRRXATAALRGVVSVPQTCDLYRGSWVYDEVSAPVYKEGECEFLTEQVTCMRNGRRDDSYQKWRWQPAGCDLPRFDARLLLERLRNKRLMFVGDSLNRNQWESMVCLVQSVIPDRGQKTLTXRQRRVXNVFYAHEYNATVEFYWAPFLVESNSDNPKVHSVPDRIIQWHAIAKHARNWIGVDYLVFNTYIWWLNTLDIKVLKQGSSFDDQGGSTEYVEVDRPVAYKEVLTTWAKWVDRNIDPNRTTVFFMGMSPNHITSMASAKKTAGRRGKKKKRVPEFRVPVSDPGFSGTDRVLVIPYPTRIRGSISGPEAWGNKGGIKCAMETLPIASNRSAALDVGTDWRLYAGAREVLPTLRRVPVHFVDITALSELRKDAHTSVHTLRQGKLLTPEQQADPKTYADCIHWCLPGLPDTWNQFLYARIASSPWPNDAQAQQ

SEQ ID NO: 4856 - protein, 367 aa, Zea mays
  UNSURE (1)..(367): unsure at all Xaa locations
  Clone ID: PAT_MRT4577_156356C.1.pep
  unsure (1)..(367): unsure at all Xaa locations
GEHPSDRIKLPGNAMLGEGKPENQNHAIIFTRGXHYMEETLKMRNLLQEFLKKHDGVRYPSILGVREHIFTGSVSSLAWFMSNQETSFVTIGQRVLANPLRVRFHYGHPDIFDRLFHLTRGGVSKASKIINLSEDIFAGFNSTLREGNVTHHEYMQVGKGRDVGLNQISLFEAKIANGNGEQTLSRDVYRLGHRFDFFRMLSCYYTTIGFYFSTMITVWTVYVFLYGRLYLVLSGLDEALATGKRFIHNEPLQVALASQSFVQLGFLMALPMMMEIGLERGFRTALSDFVLMQLQLASVFFTFSLGTKTHYYGTTLLHGGAEYRATGRGFVVFHAKFAENYRLYSRSHFVKGIELMILLIVYEIFGQ

SEQ ID NO: 4857 - protein, 723 aa, Zea mays
  UNSURE (1)..(723): unsure at all Xaa locations
  Clone ID: PAT_MRT4577_156358C.1.pep
  unsure (1)..(723): unsure at all Xaa locations
IGTSSRPGKLPGDPHPEDIQPRIPTYPSLRVAYIDEVEEPSKDKNKKIEKVYYSALVKAAVTKPDDPXVQKLDQXIYRIKLPGNAMLGEGKPENQNHAIIFTRGEGLQTIDMNQEHYMEETLKMRNLLQEFLKKHDGVRYPSILGVREHIFTGSVSSLAWFMSNQETSFVTIGQRVLANPLRVRFHYGHPDIFDRLFHLTRGGVSKASKIINLSEDIFAGFNSTLREGNVTHHEYMQVGKGRDVGLNQISLFEAKIANGNGEQTLSRDVYRLGHRFDFFRMLSCYYTTIGFYFSTMITVWTVYVFLYGRLYLVLSGLDEALATGKRFIHNEPLQVALASQSFVQLGFLMALPMMMEIGLERGFRTALSDFVLMQLQLASVFFTFSLGTKTHYYGTTLLHGGAEYRATGRGFVVFHAKFAENYRLYSRSHFVKGIELMILLIVYEIFGQSYRGAIAYIFITFSMWFMVVTWLFAPFLFNPSGFEWQKIVDDWTDWNKWISNRGGIGVPPEKSWESWWEKEQEPLRHSGKRGTVLEIVLSLRFFIYQYGLVYHLNITTHTKSVLVYCISWVIIFVILLVMKTVSVGRRKFSAEFQLVFRLIKGLIFITFISIIIILIAIPHMTVQDIFVCILAFMPTGWGLLLIAQTMRSAISHMGLWGSVKALARGYEIIMGLLLFTPIAFLAWFPFVSEFQTRMLFNQAFSRGLQISRILGGHKKDRAARNKE

SEQ ID NO: 4858 - protein, 630 aa, Zea mays
  Clone ID: PAT_MRT4577_15635C.1.pep
MESGLVASHRLRVPPPSASAGHHHLIRHRHAHAPVAAAPLRLSLPRHLPRSTPLRLPAALPLRHCLPPLRAASAAAAAVPAPGDDASPKFLGVETKTIKKIVPLGLMFFCILFNYTILRDTKDVLVVTAKGSSAEIIPFLKTWVNLPMAVGFMLLYTKLADVLSKEALFYAVIFPFIAFFGAFAYVLYPMRDAIHPTALADRLLASLGPSFLGPVAILRVWSFCLFYVMAELWGSVVISVLFWGFANQITTVEEAKEFYPLFGLGANVALIFSGRTVKYFSNMRKNLGPGVDGWAISLKAMMSIVVVLGLVITGIYWGVNKFVIDNSSVPVVERKKKDKPKLSMGESMKVLLSSRYVRDLATLVVAYGISINLVEVTWKSKLKAQFPSPNEYSSFMGDFSTATGIATFTMMLLGRVILRKFGWGVAATITPAVLLLTGVGFFSLILFGEPLTPLMTKFGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDLQFSSLAKQELGREKLLKTQAVETVAEVVGTGNGSLQETLASEPSANGAATKQSQEPESTAPEKSGQQSQ

SEQ ID NO: 4859 - protein, 256 aa, Zea mays
  Clone ID: PAT_MRT4577_156363C.1.pep
MARGSMAAVLAVLAVAALRCAPAAAELPLVEHPAKNDGSLSLLVVGDWGRNGTYNQSRVAEQMGKVGERLDIDFVVSTGDNFYENGLTGVHDQQFEESFTNIYTAQSLQKPWYLVLGNHDYRGDALAQLDPVMRKLDERFVCMRSFVVNAEMVEFFFIDTTPFQLKYWTHPKDSHYDWRGVAPRENYIANLLKDLDEAMKKSTAKWKIAVGHHTMRSVSDHGDTEELLQLLLPVLEVNGIDFYINGHDHCFEHITS

SEQ ID NO: 4860 - protein, 345 aa, Zea mays
  UNSURE (1)..(345): unsure at all Xaa locations
  Clone ID: PAT_MRT4577_15637C.1.pep
  unsure (1)..(345): unsure at all Xaa locations
TGIYWGVNKFVIDNSSVPVVERKKKXTWQIFYCSSSCVYGSLLNGSANITFQDKPKLSMGESMKVLLSSRYVRDLATLVVAYGISINLVEVTWKSKLKAQFPSPNEYSSFMGDFSTATGIATFTMMLLGRVILRKFGWGVAATITPAVLLLTGVGFFSLILFGEPLTPLMTKFGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDLQFSSLAKQELGREKLLKTQAVETVAEVVGTGNGSLQETLASEPSANGAATKQSQEPESTAPEKSGQQSQ

SEQ ID NO: 4861 - protein, 249 aa, Zea mays
  UNSURE (1)..(249): unsure at all Xaa locations
  Clone ID: PAT_MRT4577_156652C.1.pep
  unsure (1)..(249): unsure at all Xaa locations
MDLLDAGHRHSSELPAAGADMEGASVLPLSGAAYQPYVSELLSFSIERLHKEPELLRVDGERVRRQMQEVAVENYAAFIAASEALSFVRAQLEGFDKHLEALVEEIPNLTSGCTEFVESAHQILEERKLNQTLLANHSTLLDLLEIPQLMDTCIRNGNYDEALDLEAFVSKISKLHPDLPVIQGLAAEVKKTIQSLISQLLQKLRSNIQLPECLRIVAHLRRIGVFSESELCLQFXCREAWLSGILDDL

SEQ ID NO: 4862 - protein, 163 aa, Zea mays
  UNSURE (1)..(163): unsure at all Xaa locations
  Clone ID: PAT_MRT4577_15666C.1.pep
  unsure (1)..(163): unsure at all Xaa locations
MASSTMCXLSSTALRRXAVNVPXSSAFXXARVTMRKTASNAKPAEAFGRPWYGPYRVLYLGPLSGEPPSYLTGEFPGDYXDDXTARLSVDPETFAKNLELEVIHSRCDMLGALGCIFPDLLARNGVKFREAVCPHDGSQIFSEGGLDYLENPSLIHAQSILAI

SEQ ID NO: 4863 - protein, 51 aa, Zea mays
  Clone ID: PAT_MRT4577_156727C.1.pep
QCHNVTLIPSRALYINIYNLSCSCPTAVAIWPMSFLKALRWCCFLDISICV

SEQ ID NO: 4864 - protein, 650 aa, Zea mays
  Clone ID: PAT_MRT4577_156728C.1.pep
MARFEVNGKSVQGVDLLRRRHWPSRLDFWPFLALYALWLLLAVPALDFTDALIILAALSAAHILTFLFTAWFVDFRAFVGYSKVKDIHAANTCKVTPAKFSGSKEIVPLHKQKNVASTSAAGETEEIYFDFRKQRFIYSAEKDNFLKLRYPTKELIGHYGKGTGYGTEAKISTAVDKWGRNVFEYPQPTFQKLMKEQIMEPFFVFQVFCVVLWCLDAYWYYSLFTLFMLFLFESTMAKNRLKTLTELRRVKVDSQIVLTYRCGKWVKIPGTELLPGDIVSIGRSTSGEDRSVPADMLLLAGSAIVNEAILTGESTPQWKVSIAGRSPDDMLSIKRDKNHILFGGTKVLQHTADKSVNLRAPDGGCLAFVLRTGFETSQGKLMRTILFSTERVTANNKESGLFILFLLFFAIIASGYVLVKGLEDPTRSRYKLLLSCSLIITSVIPPELPMELSIAVNTSLIALARRGIFCTEPFRIPFAGKVDICCFDKTGTLTSDDMEFQGIVTLEGDTDLISDANKLPLRTQEVLSSCHALVFVDNKLVGDPLEKAAIKGIDWIYTSDEKAMSKKPGGQPVQIVHRYHFASHLKRMSVIVRIQQKFYAFIKGAPETIQEKLVDLPAAYVETYKKYTRQGSRVLALAYKLLPEMPVSFC

SEQ ID NO: 4865 - protein, 95 aa, Zea mays
  UNSURE (1)..(95): unsure at all Xaa locations
  Clone ID: PAT_MRT4577_156763C.1.pep
  unsure (1)..(95): unsure at all Xaa locations
GYLGLCGGAIAAADVEYRCFVGGLAWDTINKSLENAFACYREILDSKVITDRDDGXRSRGFGFATFCYENSMLDSIKNMNGKELDGRNITVNHAQ

SEQ ID NO: 4866 - protein, 90 aa, Zea mays
  Clone ID: PAT_MRT4577_156772C.1.pep
NMTGKELDGRNIPVNQAQSRAGAGAAGGYGGGPGGGGYGGGPRDGGYGGGGGYAGRPKGGGAGYGGGGGYAGRPEGGGGGYGGGGGGWRD

SEQ ID NO: 4867 - protein, 159 aa, Zea mays
  Clone ID: PAT_MRT4577_156775C.1.pep
MAAADVEYRCFVGGLAWATSNESLENAFASYGEILDSKVITDRETGRSRGFGFVTFSSENSMLDAIENMNGKELDGRNITVNQAQSRGGGGGGGGGGYGGGRGGGGYGGGRRDGGYGGGGGYGGRREGGGGGYGGGGGYGGRREGGGGGYGGGGGGWRD

SEQ ID NO: 4868 - protein, 157 aa, Zea mays
  UNSURE (1)..(157): unsure at all Xaa locations
  Clone ID: PAT_MRT4577_156792C.1.pep
  unsure (1)..(157): unsure at all Xaa locations
MAAADVEYRCFVGGLAWATSNESLENAFASYGEILDSKVITDRETGRSRGFGFVTFSSENSMLDAIENMNGKELDGRXITDNQAQSRGGGGGGGGYGGGRGGGGYGGXRRDSCYGGGGGCGGRREGGGGGYRGGGGFGGRREXGGGGYXGGGGGWRD

SEQ ID NO: 4869 - protein, 257 aa, Zea mays
  Clone ID: PAT_MRT4577_156793C.1.pep
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGYGGGRRDGGYGGGGGYGGRREGGGGGYGGGGGYGGRREGGGGGYGGGGGGGWRDKRSLPRGRAEAGRVRQLAERADQRDPGDAAQAVLHADPGAGGLEGRGVPLHRPQGQRPGHQPQPAHQPQPPRQLLRQARPLGLPVLLITPIHSIDPSAG

SEQ ID NO: 4870 - protein, 190 aa, Zea mays
  Clone ID: PAT_MRT4577_156873C.1.pep
MQTTGPASPDKPPVVDPEADDKVEEGARAKEDDAAKVSGEDEDEEEQEGRRGRRQRRRRGGAAGDSSVAMVKRELLARCLTCPLCDRLLRKATTISECLHTFCRNCIYNKINDEDLDHCPVCKIDLGCTPVDKLRADHNIQDVRSKVFPFKRKKVNAEEAESPIMLPVKVKERSISSLVVNTPRVTQQLH

SEQ ID NO: 4871 - protein, 160 aa, Zea mays
  Clone ID: PAT_MRT4577_156911C.1.pep
MNDSEEHHFKLKADAGAFKTYPQQAGTVRKNGSIVIKNRPCEVEEVSTSQTGQHGHAKCHFVAIDILNGKKLEDIGASSHNWDIPHANRTDADLIDISHDGLVSLLTSDGNTKDDLILPTDETLVAQIKEGFESGEALAATVQSAMEEEQICALKDVGTQ

SEQ ID NO: 4872 - protein, 181 aa, Zea mays
  UNSURE (1)..(181): unsure at all Xaa locations
  Clone ID: PAT_MRT4577_156944C.1.pep
  unsure (1)..(181): unsure at all Xaa locations
TGSKQAITAGILPLSPLFLQQXSSALLHQXLPLVHLLAQNIRAQQLQXLVLANLSAYSQQQQFLPFNQLAALNSASYLQQQQLPFSQLPDAXHQLFLTLYSLAALIYYVYLQQQQVISFRQLAVVIHATFLIQSQLLPFRQHAAPNAGSLLQLQHLLPFKQLAFTKPPAFFLQLIIVGALF

SEQ ID NO: 4873 - protein, 45 aa, Zea mays
  Clone ID: PAT_MRT4577_157023C.1.pep
PKHLNLHLYNITGFHMGNRNAYDIKQNHPVRKITYASSGIDWFAL

SEQ ID NO: 4874 - protein, 101 aa, Zea mays
  Clone ID: PAT_MRT4577_157113C.1.pep
GLSVATSKTGEHGHAKCQGVAIDIYNGKKLEDIGPSSHNWDIPHVNRTEYQLIDISEDGFASLLTSDGNTKDDLRLPTDETLGAQIKGGYESGKDLCVTVQ

SEQ ID NO: 4875 - protein, 138 aa, Zea mays
  UNSURE (1)..(138): unsure at all Xaa locations
  Clone ID: PAT_MRT4577_157123C.1.pep
  unsure (1)..(138): unsure at all Xaa locations
MAEEKHHHHHLCHHKKDEEQIAVGGYGESAVYTEATVTAVVFTGENXSSXYKKEEKEHKHKQHLRXAGAIDACTLKLYQKHEAKNDPEHAHLHMIEEDVAVEDDVGSGGFSFHEHHXKKKDHKEAIEVCCQNKHHLFV

SEQ ID NO: 4876 - protein, 415 aa, Zea mays
  UNSURE (1)..(415): unsure at all Xaa locations
  Clone ID: PAT_MRT4577_157125C.1.pep
  unsure (1)..(415): unsure at all Xaa locations
MGGVGEGDAWADQEQGNGGGSRGVGGGGGEAKRSEIYTYEAAWHIYAMNWSVRRDKKYRLAIASLLEQVTNRVEVVQLDEASGDIAPVLTFDHQYPPTKTMFMPDPHALRPDLLATSADHLRIWRIPSSDDAEDGAASANNNNGSVRCNGTQQPGIELRSELNGNRNSDYCGPLTSFDWNDADPRRIGTSSIDTTCTIWDVEREAVDTQLIAHDKEVYDIAWGGAGVFASVSADGSVRVFDLRDKEHSTIIYESGSGGSSGGGSNSGAGDGGTASPTPLVRLGWNKQDPRYMATIIMDSPKVVVLDIRYPTLPVVELHRHHAPVNAIAWAPHSSCHICTAGDDMQALIWDLSSMXLVAMAVAMGMVTQPLEXAEGGLDPILAYTAGAEIEQLQWSATQPDWVAIAFANKLQILRV

SEQ ID NO: 4877 - protein, 104 aa, Zea mays
  UNSURE (1)..(104): unsure at all Xaa locations
  Clone ID: PAT_MRT4577_157295C.1.pep
  unsure (1)..(104): unsure at all Xaa locations
AKDDVASYKAVIHVTDPTPASPTADDSKALVIAEXLQLNXPEKPAPPTQGGSTDRDLAIARGETDKRNFMIKAWEENGMTKADTKADDKVSAIGLCENSNKAPI

SEQ ID NO: 4878 - protein, 628 aa, Zea mays
  UNSURE (1)..(628): unsure at all Xaa locations
  Clone ID: PAT_MRT4577_157312C.1.pep
  unsure (1)..(628): unsure at all Xaa locations
MGGGADEVVKVVDLEDGEGEEEAEAAAAEGSSMEMGMLPRMPVRVLLAEGDDSTRHVISALLRKCGYRVAAASDGVKAWDLLKEKSFKVDLVLTEVELPLMSGFLLLSTIMEHDASKNIPVIMMSSHDSVSMVFKCMLKGAADFLVKPIRKNELRNLWQHVWRKQLANGGPNVQHIQREENLAERIQQKTGVTKADNLDRDVPCKNRECSEQESDAQSSCTRSELEAESKQTDNILEYKQSTQRHLSIPSHKNVELNXDRPKYKELRVITXPASEDDLSPKKRTCLNENNSXSFKRYGXVHIMENQQKYNTQWEVDTMRTTSRGNDEKGSIPAHQLELSLRRTDYGKLENHEKNDRRTLNHSTSSAFSLYNCRAVPTLGNAGDGQLCSTSETLVDVENKNGDSADPSQDMTETNRPPIRVVPVPVQGLTFDGQPFWNGTPVASLFYSQSTPPIWNSKTSMWQESTPQATSLPQKSPQNEPNEMGAKPVINAGEQFAMGPPSASGKQLHVEILNDDPRHISPMTGESGISTVLDSTRNTLSSSGCDSISNQITAPTESSNVYKDVPETPSAEGSRHLSQREAALNKFRLKRKDRCFEKKVRYQSRKLLAEQRPRVKGQFVRQDHSIQGS

SEQ ID NO: 4879 - protein, 630 aa, Zea mays
  UNSURE (1)..(630): unsure at all Xaa locations
  Clone ID: PAT_MRT4577_157315C.1.pep
  unsure (1)..(630): unsure at all Xaa locations
MGGGADEVVKVVDSEDGEGEEEEAEAAAAEGSSKETPMLPRMPVRVLLAEGDDSTRHVISALLRKCGYRVAAASDGVKAWDILKEKSFNIDLVLTEVELPLMSGFLLLSTIMEHDASKNIPVIMMSSHDSVSMVFKCMLKGAADFLVKPLRKNELRNLWQHVWRKQLAXAGPMCSTYKKRISQXMEQKTGVTKADNLNSDGPHKNRECSEQESDAQSSCTRSELEAESKQTNNILEYMQSTERHLFIRSHKDLELNGETKTRTKGNNLIPTREDDLLPKKRTCLNDNDSERTSRDMELVHIMDNQQKHDTQRDVDTMRTTSRGNDEKNSIPAHQLELSLRRTDYGKLENHEKNDRRTLNHSTSSAFYLYNCRTASSLGNAGDGQLCSTSETLVDVENRNGDLAALSEDTTETNRPPIRVVPFPVPVQCFTFDGQPFWNGTPVASPFYPQSAPPIWNSKTPTWQESTPQATSLPQKSQQNEPVEMDAKPVENAEEQFVVGPPSASGKQLHVEIPKDGLRHISPVTGESGISTVLDSTRNTLSSSGCDSTSNRITASTEPSSNVYRGVPETARAEGLRHLSQREAALNKFRLKRKDRCFEKKVRYQSRKLLAEQRPRVKGQFVRQDHSIQGS

SEQ ID NO: 4880 - protein, 40 aa, Zea mays
  UNSURE (1)..(40): unsure at all Xaa locations
  Clone ID: PAT_MRT4577_157603C.1.pep
  unsure (1)..(40): unsure at all Xaa locations
TSAKHLLNSGHWVLQXFFLLQASRRPSRELPGLWSIGRVG

SEQ ID NO: 4881 - protein, 363 aa, Zea mays
  Clone ID: PAT_MRT4577_157626C.1.pep
MVVMGKEQQHEEEEVQGKVVQEEVQVVQETVVPVPSEEDKEAEAALVHKISSLAAAIAKLPSLSPSPEVNALFTELVTACIPRSSVDVERLGPELQEMRGGLIRLCADAEALLEAHYSDLLASFDNPLEHLSLFPYINNYILLSQLEHGLLARHVPGPAPARVAFVGSGPLPLSSLVLAARHLPGASFDNYDICGEANDRARRLVRGDGALQARMAFRTSDVADVTRELASYDAVFLAALVGMAAEEKARVVAHLGRHMAPGAALVVRSAHGARGFLYPVVDPGEIRRGGFDVLAVHHPEGEVINSVIIARKPVAVDAHATGGVGHAHAHAHGAVLNRPCLCCEMEARAHQKMEEVAVEQLPS

SEQ ID NO: 4882 - protein, 129 aa, Zea mays
  Clone ID: PAT_MRT4577_157778C.1.pep
VFSLPQSVFCCFYGENSAPFSKDCKLAYFVCLEEVGCYPGKGWSAFLVKRVFGVHLLLSFFLFKSLRSRGCRLVSPPARLFVRRMLSFNMCSFVAPCLVHLYPPSFRWSAGFSPIGKPVWVNFFLKPSF

SEQ ID NO: 4883 - protein, 219 aa, Zea mays
  UNSURE (1)..(219): unsure at all Xaa locations
  Clone ID: PAT_MRT4577_15782C.1.pep
  unsure (1)..(219): unsure at all Xaa locations
RGGRNKIKKKKKNPRVGPVLLWFGISVPLVFVGSYLGFKKPAMEPPVKTSKIPRQIPEQAWYMNPLFTILIGGVLPFGAVFIELFFILTSIWLHQFYYIFGFLFLVFVILVITCAEIAVVLCYFQLCSEDYMWWWRSYLTSGSSALYLFLYAAFYFFTKLQITKLVSGILYFGYMFLASYAFFVLTGTXSYAFFVLNGKIGFCAXFWFTRLIYSSVKID

SEQ ID NO: 4884 - protein, 62 aa, Zea mays
  Clone ID: PAT_MRT4577_1578C.1.pep
ANNNIGVVIALWAPIILVYFMDTQIWYAIFSTLIGGVYGACRRLGEIRTLGMLRSRFESLPK

SEQ ID NO: 4885 - protein, 89 aa, Zea mays
  Clone ID: PAT_MRT4577_157903C.1.pep
QPRHQPHTNREHDHHHLPKSPKMANQPCEGQVRYGTVWSYSSKDIVVNVYLKSSSHIYTSRVRHTSDEPYKFQQLNTIRRQLYTRCRTR

SEQ ID NO: 4886 - protein, 118 aa, Zea mays
  UNSURE (1)..(118): unsure at all Xaa locations
  Clone ID: PAT_MRT4577_157931C.1.pep
  unsure (1)..(118): unsure at all Xaa locations
IRLEVSSTYFSRTSTQTVLATLLKDPIELSAYRDRRFKGTQEENEAGLLAWTTLYIGNMSFYTTEEQAYELLYLAGKIKKIMIGLEQNSKIPCXIXFVLYYSREDAENAVKYMSGTML

SEQ ID NO: 4887 - protein, 65 aa, Zea mays
  Clone ID: PAT_MRT4577_157970C.1.pep
HVYESSMERDREEEEDRRGSGNMLVRGCSIHSYLTSTVPKCKPFHELRNPHVAIYIFVITNRGKR

SEQ ID NO: 4888 - protein, 806 aa, Zea mays
  Clone ID: PAT_MRT4577_158122C.1.pep
MRKWALSSALLLLFLLTTLPDPAKKLQVNAEESSYDLANPPKVEEKLGAVPHGLSTDSEVAQREAESISRKTLRSSAEKFEFQAEVSRLMDIIINSLYSNKDIFLRELISNASDALDKIRFLSLTDKEVLGEGDTAKLEIQIKLDKEKKILSIRDRGIGMTKEDLIKNLGTIAKSGTSAFVEKMQSGGDLNLIGQFGVGFYSVYLVADYVEVVSKHNDDKQYVWESKADGSFAISEDTWNEPLGRGTEIRLHLRDEAKEYLEEDKLKDLVKKYSEFINFPIYLWSTKEVDVEVPTDEDETSEEEDSTPETTEEETEEDEDEEKEKKPKTKTIKETTSEWELLNDVKAVWLRSPKEVTDEEYSKFYHSLAKDFGDDKPMGWSHFTAEGDVEFKALLFIPPKAPHDLYESYYNSNKSNLKLYVRRVFISDEFDDLLPKYLSFLKGIVDSDTLPLNVSREMLQQHSSLKTIKKKLIRKALDMIRKLAEEDPDEYSNKDKTDEEKSEMEEKKGQYAKFWNEFGKSIKLGIIEDATNRNRLAKLLRFESTKSDGKLASLDEYISRMKSGQKDIFYITGSSKEQLEKSPFLERLTKKNYEVIFFTDPVDEYLMQYLMDYEDKKFQNVSKEGLKLGKDSKLKELKESFKELTDWWKKALESENVDSVKISNRLHDTPCVVVTSKYGWSANMEKIMQAQTLSDSSKQAYMRGKRVLEINPRHPIIKELRDKVAQDNESEELKHTARLVYQTALMESGFNLPDPKEFASSIYKSVQKGLDLSPDATVEEDEAEEQPEVEEKEPEPEPSSYDKDEL

SEQ ID NO: 4889 - protein, 115 aa, Zea mays
  Clone ID: PAT_MRT4577_158138C.1.pep
DRLTQAKPYLSDGVVQGLVDPRLGDGYDCGQLRRLMFVASLCVRAAAVWRPTMTQVVELLESGEISQEQWQMPEKEEQDELWDFDDLDDFDEDDYDDESDSPSISSSACSIHPDD

SEQ ID NO: 4890 - protein, 68 aa, Zea mays
  UNSURE (1)..(68): unsure at all Xaa locations
  Clone ID: PAT_MRT4577_158232C.1.pep
  unsure (1)..(68): unsure at all Xaa locations
MSAGASEQXRTFGPKESGCHKGNVIGSAIGDPLKNTLGPSLNIQIKLMTVESLIFATLFASLGGLLFG

SEQ ID NO: 4891 - protein, 85 aa, Zea mays
  UNSURE (1)..(85): unsure at all Xaa locations
  Clone ID: PAT_MRT4577_158338C.1.pep
  unsure (1)..(85): unsure at all Xaa locations
MVXASLLKSCLLPKKSEWGATRXPSXPRPATVSVVVRACXYADELVKTXKTIGWVGAACRTMGWCRWWSWRCCWTVRSGSSGRSG

SEQ ID NO: 4892 - protein, 126 aa, Zea mays
  UNSURE (1)..(126): unsure at all Xaa locations
  Clone ID: PAT_MRT4577_158355C.1.pep
  unsure (1)..(126): unsure at all Xaa locations
PTLSAAAAIGRNSAVVFAWKGETLEEHWWCTERWLNWREGVGHHLIVDDGGVPTLFIHKGVKAXDAYEMTGNIQEPGSTDSAEIKNVLTIIRDRLKVDPMKYRKMNEWLVGLSEETTTGVKRLYQM

SEQ ID NO: 4893 - protein, 79 aa, Zea mays
  Clone ID: PAT_MRT4577_158398C.1.pep
CVNIPTKMKNSEPDFLKLYLVNQNNYHSIKQKLECYRCSTTSPPHCPHRHLMQKRDEQYARICFPQIQRHPLFNTKYYF

SEQ ID NO: 4894 - protein, 222 aa, Zea mays
  UNSURE (1)..(222): unsure at all Xaa locations
  Clone ID: PAT_MRT4577_15848C.1.pep
  unsure (1)..(222): unsure at all Xaa locations
MSDSSEPSKEGSSANGSSALQKTGAWSSILSTLVQQASVYGLAAGYCLSASLLSIINKWAIMKFPYPGALTALQYLTSVVGVLLCGQAKLIEHDGLNFATMWKFLPAAVMFYISIFTNSELLLHANVDTFIVFRSAVPIFVAIGETLYLHQPWPSFKTWLSLSTILGGSVIYVFTDNQFTVTAYSWAVAYLASMSIDFVYIKHVVMTIXLNTWGLVLYXNLE

SEQ ID NO: 4895 - protein, 365 aa, Zea mays
  Clone ID: PAT_MRT4577_158569C.1.pep
MVMMMRSCLGGGLLPVAVMLCLNVVAAVMVSLVKVAMDGGMKPLVIVTLQQLTAAVFLAPIAFFKERKSRPKLTLEIFAYIFVSAALGAALRQYMIFVALRYTTATFVTAFSNIAPVLTFLLAVATRSEALDLKSRTGLAKLLGTLVSLAGAMVLTLYKGVALTHAAAASQDHQQHSHGRLPPSAADSRGKWTLGTVAILGNCVCLSCWFLLHGRLAKKYPHVYSCNALMSLLSFLQVAVVGLCTQRSISPWIVTSKFNILTVLYAGIVGCGVSFVLVTWCIEKRGAVFVAAFIPVVQIIVSVIDFSILHEQLYLGSVLGSVLVIGGLYLLLWGKRQEALHCPPPPPKVAEEDPADKEQQQVQHN

SEQ ID NO: 4896 - protein, 121 aa, Zea mays
  UNSURE (1)..(121): unsure at all Xaa locations
  Clone ID: PAT_MRT4577_158709C.1.pep
  unsure (1)..(121): unsure at all Xaa locations
IASSSCMLAMCSGQPKMSQSVLIAFRNVGDDATGAALAIDAFFPFACTDAIXEACYNSIGIIAQPVRSNNDEDAVACCIKYGVSLVLTDVRHFKLYPSCSMAGHLSVRSYGLYTNLRQLLL

SEQ ID NO: 4897 - protein, 68 aa, Zea mays
  Clone ID: PAT_MRT4577_15871C.1.pep
MEYGQQGQRGHGATGHVDQYGNPVGGVKHGTGGMRHGTGTGGGMGQMGEHGGAGMGGRQIQPAREEYK

SEQ ID NO: 4898 - protein, 168 aa, Zea mays
  UNSURE (1)..(168): unsure at all Xaa locations
  Clone ID: PAT_MRT4577_158906C.1.pep
  unsure (1)..(168): unsure at all Xaa locations
RAIQLSLAAPFQQAELEGGWWGWLSLSLVHGGREKHHHHHLFHHKRDEEQLAAGGYGESAEYTEATVTGGGGTXXEXYHEYKKEEKEHKHKQHLGEGGAIAXGAFALYEKHEAKKDPEHAHRHKSEEEVSAAGGVWSGGFAFHEPHEKKKDHKEAXEAGGEKKHHXFG

SEQ ID NO: 4899 - protein, 78 aa, Zea mays
  UNSURE (1)..(78): unsure at all Xaa locations
  Clone ID: PAT_MRT4577_158952C.1.pep
  unsure (1)..(78): unsure at all Xaa locations
MAAADVEYRCFVGRLAWASSNEXLENAIDTYVEVLDSKVITDRXTGMSRGVGNGTFTSENCMLDAIDHMNRKEIHGRN

SEQ ID NO: 4900 - protein, 111 aa, Zea mays
  UNSURE (1)..(111): unsure at all Xaa locations
  Clone ID: PAT_MRT4577_159050C.1.pep
  unsure (1)..(111): unsure at all Xaa locations
MAAKIFCLLMLLGISASAATATIFPQCSQAPIASLLTPYLSPAVCSACXNPIRXPYRIQHAIAPGILPLSPXFLQQSSALIQQXPMVHLLSQYIMAQQLQQLVLANLAVYS

SEQ ID NO: 4901 - protein, 472 aa, Zea mays
  Clone ID: PAT_MRT4577_159255C.1.pep
MAFYRGLTAVSRLRSRMAQEATTLGGVRWLQMQSASDLDLKSQLQELIPEQQDRLKKLKSEHGKTQLGNITVDMVLGGMRGMTGMLWETSLLDPEEGIRFRGLSIPECQKVLPTAVKGGEPLPEGLLWLLLTGKVPTKEQVDALSKELLARSTVPAHVYKTIDALPVDAHPMTQFTTGVMALQVESEFQKAYDNGLPKSKFWEPTYEDCLNLIARLPPVASYVYRRIFKSGKSIEADNSLDYAANFSHMLGFDDPKMLELMRLYVTIHTDHEGGNVSAHTGHLVGSALSDPYLSFAAALNGLAGPLHGLANQEVLLWIKSVIEETGSGVTTDQLKDYVWKTLKSGKVVPGFGHGVLRKTDPRYSCQREFALKHLPKDPLFQLVSKLYEVVPPILTELGKVKNPWPNVDAHSGVLLNHFGLSEARYYTVLFGVSRSMGIGSQLIWDRALGLPLERPKSVTMEWLENYCKNKAA

SEQ ID NO: 4902 - protein, 245 aa, Zea mays
  Clone ID: PAT_MRT4577_159256C.1.pep
MAFFRGLTAVSRLRSRMAQEATTLGGVRWLQMQSASDLDLKSQLQELIPEQQDRLKKLKSEHGKVQLGNITVDMVLGGMRGMIGMLWETSLLDPEEGIRFRGLSIPECQKVLPTAVKGGEPLPEGLLWLLLTGKVPTKEQVDALSKELLERSTVPAHVYKAIDALPVTAHPMTQFTTGVMALQVESEFQKAYDNGLPKSKFWEPTYEDCLNLIARLPPVASYVYRRIFKGGKSIETDNSLDYAAI

SEQ ID NO: 4903 - protein, 73 aa, Zea mays
  UNSURE (1)..(73): unsure at all Xaa locations
  Clone ID: PAT_MRT4577_15928C.1.pep
  unsure (1)..(73): unsure at all Xaa locations
MSFLQHHSTSYHSGETNARAXDNTGQVMGATHEKGREAKHKASDASDRAMGMGHDSMEATMDKARACSDQTMV

SEQ ID NO: 4904 - protein, 230 aa, Zea mays
  Clone ID: PAT_MRT4577_15942C.1.pep
MSANVGESTSGGSSNDAAGGSFECNICFELPQEPIVTLCGHLFCWPCLYRWLHIHAHSPECPVCKALVEEDKLVPLYGRGKDRVDPRSKNMPEGEIPHRPTGQRPAPAPQADANNNFANANPNANPWFMGTGVPLANARWGNYAFSAAFGGLFPMLSFQVHGFPDAAAYAQPAGFHYGYGHGHGFHGGHMGHAHGVHRQAPLGQQQQADIYLKALLFMIGILVIASLIAF

SEQ ID NO: 4905 - protein, 146 aa, Zea mays
  UNSURE (1)..(146): unsure at all Xaa locations
  Clone ID: PAT_MRT4577_159546C.1.pep
  unsure (1)..(146): unsure at all Xaa locations
EAHVASQQSAAKIYXCLWLLGVSESAATGTIXPQGSQAAIGSLLPPYLSPAACSVCENPMLAPYRIQQAISAGILXPYTPLLLQQSSVLLQQIHFGALXLAQNIRAQQLQXLVLANLAAYSQQQQCLTCNQLAALDSASYLLQQQL

SEQ ID NO: 4906 - protein, 92 aa, Zea mays
  UNSURE (1)..(92): unsure at all Xaa locations
  Clone ID: PAT_MRT4577_159559C.1.pep
  unsure (1)..(92): unsure at all Xaa locations
EAISKMHNMSAADFTSARTLIDEYDLYGLVAYSKHHIHSEVPDIYRLAARXTQGAFVHVAHFEQFGVTLTEAAMNGXHIIATINGTPAEINQ

SEQ ID NO: 4907 - protein, 54 aa, Zea mays
  UNSURE (1)..(54): unsure at all Xaa locations
  Clone ID: PAT_MRT4577_159638C.1.pep
  unsure (1)..(54): unsure at all Xaa locations
FMILPTGASSFKEAMSVGIXVYHNLKSIIKINYCQDATNVVDECVLAXNIKENK

SEQ ID NO: 4908 - protein, 284 aa, Zea mays
  Clone ID: PAT_MRT4577_159688C.1.pep
MAPLGDGGAAAAAASNNLVVSFGEMLIDFVPDVAGLSLAESGGFVKAPGGAPANVACAIAKLGGAGPGPGAAARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNAWGGICTTKKGAIPALPTVATAQDLIAVPPRHCPPPPRPSSSTSSVSVH

SEQ ID NO: 4909 - protein, 335 aa, Zea mays
  UNSURE (1)..(335): unsure at all Xaa locations
  Clone ID: PAT_MRT4577_159689C.1.pep
  unsure (1)..(335): unsure at all Xaa locations
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLRXALKFSNACGAICTTXKGAIPALPTVATAQDLIAKAN

SEQ ID NO: 4910 - protein, 335 aa, Zea mays
  Clone ID: PAT_MRT4577_159691C.1.pep
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 4911 - protein, 380 aa, Zea mays
  Clone ID: PAT_MRT4577_159693C.1.pep
MAPPPQPQHNRLAFPSPPAPVSLSLLSDSLSRSRVHLAAASKRDQMAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 4912 - protein, 109 aa, Zea mays
  Clone ID: PAT_MRT4577_159754C.1.pep
VDFSSPSGSFSGSRGSPGVGFIDKRSQMAASDVQYRSFAGRLSWTTDDHSLHNAFSTYSEVLESKIILHRETQRFRRFRFVTLCTEEAMRNAIEGMNSKVLDGRNINDN

SEQ ID NO: 4913 - protein, 57 aa, Zea mays
  Clone ID: PAT_MRT4577_159790C.1.pep
ARCLLTHNISAVLLHTAPNVGPSYNCTIAAFDQLALQTHSVLPTTHIGGPSLDCYEL

SEQ ID NO: 4914 - protein, 163 aa, Zea mays
  UNSURE (1)..(163): unsure at all Xaa locations
  Clone ID: PAT_MRT4577_159876C.1.pep
  unsure (1)..(163): unsure at all Xaa locations
ITMDPTKFRPSSSHDTTXVTTTNAGAPVGNDNEALTVGPRGAILLEDYHLIEKVAHFARERMPQRVGHARGAYDKGLYECTHDETALTCADLLRALGVRTXVIVRLSTAIHERGCPETIRDPRGFPVRLYTREDNWDLVGNNFPVFFIRDGIKFPDVIHAVKP

SEQ ID NO: 4915 - protein, 488 aa, Zea mays
  Clone ID: PAT_MRT4577_159877C.1.pep
MTHRNMLWTHQSVNPEWEQRHVQVQPGSSYYAGTASDPSNLGVQVAVGVPGNTANVGICDLRNHECPHVHNSYPHAGVTSRFVFPTTMYSPSMSAAAVNIYIPQTQSFGLGSVLPPSLHNQVSTGIIDESSSSVNFGDSAIGFMKRKNAVVAGSHNFLHGFAGSSSSVHVPQNPVHGAWNPSSQSNCLPSSAASNLPEYHNSNGWPYLEESSADASNSFSSVAACPELAPHGNYLYPACHISQSNTWVPQPAGYGVPQWGYSNAVVNPPDMSNGPLPHFCQNSMQAPQIQVPHQQSIGNNVVHGLNPSATGLPLHPRMLALPFNAEHTFGHQVHPPLINQANNGALRILPYQNATVMDHSRIYEAGHVIDEHSDMRLDVDNMTYEELVALQEQIGDVNTGLTESYIQENLRSSFHVPGAASMSDQFSELSLENDACIICQEEYKAKELIGTLECGHKYHVNCIKQWLMMKNLCPICKTTALSSDRRNG

SEQ ID NO: 4916 - protein, 493 aa, Zea mays
  Clone ID: PAT_MRT4577_159882C.1.pep
FCLQFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMEPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKANM

SEQ ID NO: 4917 - protein, 496 aa, Zea mays
  Clone ID: PAT_MRT4577_159884C.1.pep
ITMDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 4918 - protein, 496 aa, Zea mays
  UNSURE (1)..(496): unsure at all Xaa locations
  Clone ID: PAT_MRT4577_159885C.1.pep
  unsure (1)..(496): unsure at all Xaa locations
FCFALQFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPAHXPLPPRPVAGRREKATIRKPNDFKQPGERYRSWDADRQDRFVRRFADSLGHPKVSQELRSIWIDLLAKCDASLGMKIATRLNMKPNM

SEQ ID NO: 4919 - protein, 497 aa, Zea mays
  UNSURE (1)..(497): unsure at all Xaa locations
  Clone ID: PAT_MRT4577_159887C.1.pep
  unsure (1)..(497): unsure at all Xaa locations
ITMDPTKFRPSSSHDTTVTTTNAGAPVWNDNEALTVGPRGPILLEDYHLIEKVAHFARERIPERVVHARGASAKGFFECTHDVTSLTCADFLRAPXGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 4920 - protein, 121 aa, Zea mays
  UNSURE (1)..(121): unsure at all Xaa locations
  Clone ID: PAT_MRT4577_160252C.1.pep
  unsure (1)..(121): unsure at all Xaa locations
ILLYLSATGFTGTMSPQCSQATIASLLPPYLSPPESSVCXNPILQPYKIQQAITAGILPLSPXLSLQQSSTLLHHLPSMHXLSQNISPQQLQQLCLTYLATYSQQQHFLSFNQLASFNSAS

SEQ ID NO: 4921 - protein, 48 aa, Zea mays
  Clone ID: PAT_MRT4577_160263C.1.pep
GAGHRDVDDGYGGVDDYGDGDGYGGGDAGFAGGNRDDGYRNSHGNWSN

SEQ ID NO: 4922 - protein, 106 aa, Zea mays
  Clone ID: PAT_MRT4577_160335C.1.pep
NKMVVRRLRRWLLCRRIRQLRRALEKMTGGARSTKLSCVASVLFTIVQSVYGRWYRVCCCPSVFLIQGRPVSVVSNVFILRLPADPRIGQHGLRIDGACYPRQALL

SEQ ID NO: 4923 - protein, 165 aa, Zea mays
  Clone ID: PAT_MRT4577_160418C.1.pep
MSSSGPLLATGTHHTGRQPEVLWAQRSEKIFLTISLPDAKDVVLKTDPKGLFNFSAVVHGEPFSFTLELFDSILSEGSKTKTKMGLRNIICSIQKEKKGWWKRLLKSEEKHPYIKVDWNKWCDEDEESEFSGDSDGGFDEANEGDESDDDDGMLYLPDLEKLRGK

SEQ ID NO: 4924 - protein, 481 aa, Zea mays
  UNSURE (1)..(481): unsure at all Xaa locations
  Clone ID: PAT_MRT4577_160568C.1.pep
  unsure (1)..(481): unsure at all Xaa locations
MATTRPRGGGGAASGALVMAIVVLLLLPPYGAGAEECEDGGISSRARAGDRVEALPGQPAVAFAQYSGYVAVDRDRGRALFYWLTEAVGDDAAAKPLVLWLNGGPGCSSVAYGASEEIGPFRIKPNGTGLFLNKYSWNREANLLFLESPAGVGFSYANTTSDLKTSGDERTAQDALQFLVSWMSRFPQYRHRDFYIAGESYAGHYVPQLARKIVEYNEASPHPFINLKGILVGNAETGNYYDNIGTVTYWWTHAMISDRTYKAILRWCNFSSSSISRPCNRAMSYAMNHEFGDIDQYSIYTPSCAAXXARANATVLRFKNTLVRRRRSSGYDPCTETYAERYYNRMDVQRAMHANTTGIPYRWTACSDVLIKTWQDSEFSMLPTYKKLMKAGLRIWVFSGDTDSVVPVTATRFAISHLGLKIKTRWYPWYSAGQVGGWSEVYEGLTFASVRGAGHEVPLFQPRRAFRMFRSFLAGEPLPKS

SEQ ID NO: 4925 - protein, 378 aa, Zea mays
  Clone ID: PAT_MRT4577_160779C.1.pep
MSAATACMPLVLDPSPLHGSAAMADAVERRQPGGMETTKTGSEGTLGRVVRSQVFGNEDDDRAGHGDGDEVSKPRAVVHTLTCERKPLFEGFALWRSIGRPELPELDPILSFDEFEFSAPAGFLDHPHRGFENVTYMLEAASGGISYHDFSGHKGTINPGDVQWLTAGRGVVHAEMPAAGQGVQRGINIWINLSAADKMVEPRYQDLASHDIPAAAADAAGGVSVKVIAGECLGARSPLRPRTPALCLDVALRPGARLRQPVPRGWSACAYVIHGEAAFGTASGEGNGASTATARTLVVFGGDGDGVELRGDAAGQGARVMLVAARSHGEAVARDGPFVMNTREEVDQAREDYRHRRNGFEMADGWTSDHASAAEKHS

SEQ ID NO: 4926 - protein, 260 aa, Zea mays
  Clone ID: PAT_MRT4577_160794C.1.pep
MFPPGLIHHRPDAPVPGDGATRSGPGGPSLVLTADPKPRLRWTADLHERFVDAVAQLGGPEKATPKTILRTMGVKGLTLFHLKSHLQKYRLGKQSGKEGSEQSKDASYLLDAQSGMSVSPRVPAQDMKESQEVKEALRAQMEVQRRLHEQVEVQKRVQIRMEAFQKYIDSILESACKMVTEQFASSGFSISDPDLPEISPGGVVMCGGPTDTLSSSVFNQLSVSSIGSHSPGGKPSPSPSGMECPPLLLHKSHELKRRSS

SEQ ID NO: 4927 - protein, 446 aa, Zea mays
  UNSURE (1)..(446): unsure at all Xaa locations
  Clone ID: PAT_MRT4577_160925C.1.pep
  unsure (1)..(446): unsure at all Xaa locations
MATRNHRAAAAPQPANRGAARVAGKQKAAAAGTRRALGDIGNVVSDALDRAIKLPEGIHRPITRSFGAQLMKAALANKNADAAVAPAQPVAARAVTKPARKVTTKNVPRPGAGQAPKENKKPSAEGAAAGSGRSVQKNRRKKPACTLSTVLSARSKAACGLTEKPKEPIEDIDKFDGDNQLALVDYVEDIYTFYKTAQHESRPIDYMGNQPELSPRMRSILADWLIESHRRFQLMPETLYLTIYIVDRYLSLQPTPRRELQLVGVAALLIACKYEEIWAPEVNDLIHIADGAFNRSQILAAEKAILNSMEWNLTVPTPYHFLLRFAKAAGSADEQLQHTINFFGELALMDYGMVMTNPSTAAACAVYAARLTLGRSPLWTETLKHHTXPQRAADHGRXAKTLVGSHAASASPDXARLKAVYQKYATEQFGRVALHPPAPTALPDLV

SEQ ID NO: 4928 - protein, 128 aa, Zea mays
  UNSURE (1)..(128): unsure at all Xaa locations
  Clone ID: PAT_MRT4577_160953C.1.pep
  unsure (1)..(128): unsure at all Xaa locations
LRAQHIRAQHLQQLVLANLXAGYSQHQRVVTFNQLGPWNYASNAQLLQLQFRQLPAAYREQFLAFNHLTALNSAAYIQQLQLLPFKQLAGVSPATFLTHPQSLPIYHHVXPNAGTLLQVQQSLPFNQL

SEQ ID NO: 4929 - protein, 97 aa, Zea mays
  UNSURE (1)..(97): unsure at all Xaa locations
  Clone ID: PAT_MRT4577_160962C.1.pep
  unsure (1)..(97): unsure at all Xaa locations
CRRRRSLHSCSPAVFCGGRLPEPVRCSCALSSRAATCDSGEIGSAAASGSRTAAGPGRCGGKGTGRWRSKPAHSLTPTADHPNRTRRRRRYGLLWXR

SEQ ID NO: 4930 - protein, 79 aa, Zea mays
  Clone ID: PAT_MRT4577_160976C.1.pep
RCSARCLYSYWEEHSKCLTDDYMMLDSLAADLNTEERPYILSLVPSYKGTSSLKLGAVIGPSTGHLAKEAGDVVSLDFI

SEQ ID NO: 4931 - protein, 73 aa, Zea mays
  Clone ID: PAT_MRT4577_161126C.1.pep
RTVTQLLSWYIMGGCCRCWCITSEAVRARARADIYDQQYVDEQESWASIFDGSYSASAIVALYTNMDTFTPDT

SEQ ID NO: 4932 - protein, 558 aa, Zea mays
  Clone ID: PAT_MRT4577_161280C.1.pep
MHAVYELFERMAYYGISSNLIIYLTDKLHQGTVEASNNVTNWSGTVFLTPLLGAYVADAYLGRYWTFVVGSAIYLLGMVLLVLSVSVPALKPPPCGAGGVCPQASALQLGAYFGGLYIVALGNGGTKPNISTIGADQFDEFDPRERTHKLSFFNWWMFTIFLGILFSSTVLVYLQDNVSWSVGYGIPTLGLMVSISVFLAGTRLYRHRVPQGSPFTSMGRVLAAALWKWSVPVPADAKELHELDVEEYARKRRFRMDSTDAMAFLNKAAAVAVPSGGPASTPAWSLCTVTQVEETKQILRLVPLLVAMIVPCTLIAQTNTLFVKQGTTMDRHMGPRFEIPAASLGAFVTLTMLVAVVVYDRVFVRAVRRYTKDPRGITILRRMGTGMLLQVATMAVASAIESRRLAYARSHGLDATGGQLGLTIFALLPQFVLMGLADAFLVVGKIEFFYDQAPESMKSLGTAMSLTAYGIGNFLSSFLLSTVTRVTRDRGHAWVTNNLNASNLDYYYAFLTALGAVNFVAFLALSARYRYKAQSTDTIDAAVGLGTEKAKLQAEPLG

SEQ ID NO: 4933 - protein, 176 aa, Zea mays
  UNSURE (1)..(176): unsure at all Xaa locations
  Clone ID: PAT_MRT4577_16136C.1.pep
  unsure (1)..(176): unsure at all Xaa locations
MALRTLASKNALSFALGGAARPSAASARGVTTVALPDLSYDFGALEPAISGEIMRLHHQKHHATYVANYNKALEQLDAAVAKGDASAVVQLQGAIKFNGGGHVNHSIFWKNLKPISEGGGEPPHGKLGWAIDEDFGSFEALVKRMNAEGAALQGSGWVWLALDKRXKKLSVETTAN

SEQ ID NO: 4934 - protein, 100 aa, Zea mays
  UNSURE (1)..(100): unsure at all Xaa locations
  Clone ID: PAT_MRT4577_161386C.1.pep
  unsure (1)..(100): unsure at all Xaa locations
PAGPGLPSPSSPVPFPHLHRSDSRVLPPLPAWRSLCEKTSCGREYNVKDLSQEDFRRLQIELXEVEMPGLMACRVKIGPSKTFIDDRISMSLHMTIHTSD

SEQ ID NO: 4935 - protein, 61 aa, Zea mays
  Clone ID: PAT_MRT4577_161406C.1.pep
LLGGSWMLSRRRIEGSMSKTGFWCRSASEFFFLYISLRTRSCPLVISQTTLLAPIMPSLNM

SEQ ID NO: 4936 - protein, 79 aa, Zea mays
  UNSURE (1)..(79): unsure at all Xaa locations
  Clone ID: PAT_MRT4577_161669C.1.pep
  unsure (1)..(79): unsure at all Xaa locations
MVLSIENTWAGREYKVKDLSQADLRRLEIELAEVEMPSLMACRTXFSPTKPFASARISGSIHMTIQTGVLIETLSRLGA

SEQ ID NO: 4937 - protein, 369 aa, Zea mays
  Clone ID: PAT_MRT4577_161720C.1.pep
MAMMVDPPNGMASQGKHYYTMWQTLFEIDTKYVPIKPIGRGAYGIVCSSVNRETNEKVAIKKINNVFDNRVDALRTLRELKLLRHLRHENVIALKDIMMPAHRRSFKDVYLVYELMDTDLHQIIKSSQPLSNDHCQYFLFQLLRGPKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMGEADLAFIDNPKARKYIKSLPYAPGAPFTGMYPQAHPLAIDLLQKMLVFDPSKRISVTEALEHPYMSPLYDPSANPPAQVPIDLDIDENLGVDMIREMMWQEMIHYHPEVLTRISM

SEQ ID NO: 4938 - protein, 369 aa, Zea mays
  Clone ID: PAT_MRT4577_161721C.1.pep
MAMMVDPPNGMASQGKHYYTMWQTLFEIDTKYVPIKPIGRGAYGIVCSSVNRETNEKVAIKKINNVFDNRVDALRTLRELKLLRHLRHENVIALKDIMMPAHRRSFKDVYLVYELMDTDLHQIIKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMGEADLAFIDNPKARKYIKSLPYAPGAPFTGMYPQAHPLAIDLLQKMLVFDPSKRISVTEALEHPYMSPLYDPSANPPAQVPIDLDIDENLGVDMIREMMWQEMIHYHPEVLTRISM

SEQ ID NO: 4939 - protein, 74 aa, Zea mays
  Clone ID: PAT_MRT4577_16178C.1.pep
KKKNKKKKLNKKKKKKKKRKGKKKKKKKKKKKKKKKKKKKKKKKKKRGAPFKEPNFTSPSFQNKSFFKGPPNLN

SEQ ID NO: 4940 - protein, 407 aa, Zea mays
  Clone ID: PAT_MRT4577_161959C.1.pep
MASLCDFCGKQRSMIYCRSDAASLCLSCDRNVHSANALSRRHTRTLLCDRCGSQPASVRCLEDNASLCQNCDWNGHDAESGASGHKRQAINCYSGCPSSAELSRIWSFITDIPTVAAEPNCEDGLSMMTIDDSDVTNHHGASDDKRLLEIANTALMSDPPSPDKLKSPTGSSSGDGFDVMTLATDQPAGPVSATPKVPNARDDDKFNDGMYEDLCVDDADLTFEDYEELFGTSHIRTEELFDDAGIDGYFELKETPPFYFNEQPKAMQIECGNVVSADCAMSNPGARADSSLCIPVRQVRSSISHSLSGLTGESSAGDHHDCGVSPMLLMGEPPWHSPGGPEGSVAGGSRDSALTRYKEKKKRRKFDKKIRYASRKARADVRKRVKGRFIKAGEAYDYDPLSQTRSY

SEQ ID NO: 4941 - protein, 364 aa, Zea mays
  Clone ID: PAT_MRT4577_161960C.1.pep
MVPLCGFCGKQRSMIYCRSDAASLCLSCDRSVHSANALSRRHRRTLLCDRCGLQPASVRCLEDNTSLCQNCDWNGHDAASGASGHKRQAINCYSGCPSSAELSRIWSFIIDIPTVAAEPNCEDGLSMMTIDDSDVTNHHGASDDKRLLEIANTALMSDPPSPDKLKPLIGSSSGDGFDVLPLATDQPAGPVSATPKVPYARDDNKFNDGMYEDLCVDDADLTFENYEELFGTSHIRIEELFDDAGIDSYFEMKETPPFDFNEQPKIVQLQCSDVVPADCAMSNPGERADSSLCIPVRQVRSSISHPLSGLTGESSAGDHQDCGVSPILLMGEPPWHSPGPEGSLAGGSRDSALTRYKEKKKRRM

SEQ ID NO: 4942 - protein, 108 aa, Zea mays
  UNSURE (1)..(108): unsure at all Xaa locations
  Clone ID: PAT_MRT4577_162088C.1.pep
  unsure (1)..(108): unsure at all Xaa locations
TAPRSTDRWNHSXGXSLVXWPRTWPXAACSRRRXSXVXATCVSSGWXIIKKXLMXPLVIIRXVSXRSSSSXSCTSYVTCXSTYYXSRAXXQXXWXCFAGSLFSSCVAF

SEQ ID NO: 4943 - protein, 154 aa, Zea mays
  UNSURE (1)..(154): unsure at all Xaa locations
  Clone ID: PAT_MRT4577_162166C.1.pep
  unsure (1)..(154): unsure at all Xaa locations
GTQPAALPHTKPGGGLPQDRGAGEAQPPPQPPGPAADDAAASGGERQAARDRAQQHRTGGRRPAEKKAGAAETAAAAAAANGKAXXHAAKGPGXATPXEAXEKGPREKXXXXTXXNNGXGXNKPXXXATXXXXPSXPTXXQXXHRXPXTHXGDE

SEQ ID NO: 4944 - protein, 495 aa, Zea mays
  Clone ID: PAT_MRT4577_16218C.1.pep
MTMDPTKFRPSSSHDTTVTTTNAGAPVWNDNEALTVGPRGPILLEDYHLIEKVAHFDRERIPERVVHARGASAKGFFESTHDVTSLTCADFLRAPGVRTPVIVRFSQVIPEPGSGRTIRDARGFAVKFYTREGNWDLLGNNFPVFFIRDGIKFPDVIHAFKPNPRSHVQEYWRVFDFLSHLPESLHTFFFLFDHVGVPSDYRHMEGFGVNTYTFVSAAGKAQYVKFHWKPTCGERSILTDEEARVGGRNHSHTQDLYDSIAAEGSFPEWTLYVQVMDPAQQEQYDFDPLDDTKTWPEDLLPLRPVGRLVLDRNVDNFLNENEQLAFGPGLVVPGIYYSDDKMLQCRVFAYADTQRYRLGPNYLMLPVNAPRCGTHNNHYDGAMNLMHRDEEVDYYPSRHARRCGRAAPTPLPPRPVAGRREKATIRKPNDFKQPGERYRSWDADRQDRFVKAIRRLARTPKRQPELRSIWIDLLAKVDASLGMKIATRLNMKANM

SEQ ID NO: 4945 - protein, 130 aa, Zea mays
  UNSURE (1)..(130): unsure at all Xaa locations
  Clone ID: PAT_MRT4577_162288C.1.pep
  unsure (1)..(130): unsure at all Xaa locations
MEDDKKEGKYRGVRKRPWGKFAAEIRDPERGGSRVWLGTFDTAEEAARAYDRAAFTMKGATAVLNFPTXEDQLPRLPAAGPAXGSSSSTTSSAPASRGRARVPDSEKVELECLDDRVLEELLAEDKYNKN

SEQ ID NO: 4946 - protein, 371 aa, Zea mays
  Clone ID: PAT_MRT4577_162559C.1.pep
MSARDRETAEALVRLAASLDGAVLGLGTAAVAVASWVKYLAVSGQLRLVASATTASIADAHSLLSGDGAEPRIAAVRGYVRAHDKFFRAPFSGEAGVVTKHTQMCLFTEWRGIFGWTFDLHALLFRSWKEQIVTSFRSVPFVLVSTELGNPTGVVHINVDKADQPLPLTTVFHKLIPLETTPYTLFQTIIGNGYPIALLDEEKILPIGKKITAIGLCQAKDAESVEITSCPESPFFLSELTKDEMQAQLASRARILFWGSIVLGTLSVCLVGHAIYRGWTRIKLRREARHARQMFEEAEDAIHRDDSSDDDEIGDGQLCVVCLRKRRRAAFIPCGHLVCCSECALTIERTPHPLCPMCRQDIRYMMRVYDS

SEQ ID NO: 4947 - protein, 93 aa, Zea mays
  Clone ID: PAT_MRT4577_162639C.1.pep
KKDLLTGTYMPSTSLTGIYRVITYLDPSEHIHTKAKQLHFTLMRSRNDDVIPTFRSNFFSLFATADAEHAKGGKAEFNKLNDVTSFDFIGDAY

SEQ ID NO: 4948 - protein, 507 aa, Zea mays
  UNSURE (1)..(507): unsure at all Xaa locations
  Clone ID: PAT_MRT4577_162655C.1.pep
  unsure (1)..(507): unsure at all Xaa locations
MVSERQQAAGKVAAFNLTEAGFGDGSDLLDDDGRERRTGTLVTASAHIITAVIGSGVLSLAWAIAQLGWVIGPVVLLAFSAITWFCSSLLADCYRAPPGPGQGKRNYTYGQAVRSYLGESKYRLCSLAQYVNLVGVTIGYTITTAISMGAIKRSNCFHSRGHGADCEASNTTNMIIFAGIQILLSQLPNFHKLWWLSIVAAVMSLAYSSIGLGLSIAKIAGXHAWQLLYVRSISHSESRLLIDXGGVHVKTSLTGAAVGVDVTAAEKVWKTFQSLGDIAFAYTYSNVLIEIQDTLRSSPPENVVMKKASFIGVSTTTAFYMLCGVLGYAAFGSDAPGNFLTGFGFYDPFWLIDVGNVCIAVHLVGAYQVFCQPIYQFVEAWARGRWPDCAFLHAELAVVAGSSFTASPFRLVWRTAYVVLTALVATVFPFFNDFLGLIGAVSFWPLTVYFPIQMYMAQAKTRRFSPAWTWMNVLSYACLFVSLLAAAGSVQGLVKDLKGYKPLFKVS

SEQ ID NO: 4949 - protein, 65 aa, Zea mays
  UNSURE (1)..(65): unsure at all Xaa locations
  Clone ID: PAT_MRT4577_162693C.1.pep
  unsure (1)..(65): unsure at all Xaa locations
FGFLMLLGLPAIAATATIFPQXRKLPIVSLLPRYXNQGWSSXVCENPILQPYRIHQAFEVGILPL

SEQ ID NO: 4950 - protein, 39 aa, Zea mays
  Clone ID: PAT_MRT4577_162739C.1.pep
RPQRHHMPYFFFFRRKSIVVAISKTCVSPWDQADELTYF

SEQ ID NO: 4951 - protein, 491 aa, Zea mays
  Clone ID: PAT_MRT4577_162877C.1.pep
MAPSPPRRAALLLATVLLLAAAGSTPGATAAGIFQVRRKFTAGVGGGAGANISALRAHDGTRHGRLLAAADLPLGGLGLPTDTGLYYTEIKLGTPPKHYYVQVDTGSDILWVNCITCEQCPHKSGLGLDLTLYDPKASSTGSMVMCDQAFCAATFGGKLPKCGANVPCEYSVTYGDGSSTIGSFVTDALQFDQVTRDGQTQPANASVIFGCGAQQGGDLGSSNQALDGILGFGEANTSMLSQLTTAGKVKKIFAHCLDTIKGGGIFSIGDVVQPKVKTTPLVADKPHYNVNLKTIDVGGTTLQLPAHIFEPGEKKGTIIDSGTTLTYLPELVFKEVMLAVFNKHQDITFHDVQGFLCFQYPGSVDDGFPTITFHFEDDLALHVYPHEYFFANGNDVYCVGFQNGASQSKDGKDIVLMGDLVLSNKLVIYDLENRVIGWTDYNCSSSIKIKDDKTGATSTVNSHDLSSGWKFHWHMSPVLLLVTTVCSYLIC

SEQ ID NO: 4952 - protein, 317 aa, Zea mays
  Clone ID: PAT_MRT4577_163021C.1.pep
MAATVSSFPVVNMEKLETEERATAMEVIRDGCENWGFFELLNHGISHELMDEVERLTKAHYATFREAKFQEFAARTLEAGEKGADVKDVDWESTFFVRHLPASNLADLPDVDDRYRQVMEQFASEIRKLSERLLDLLCENLGLEPGYLKAAFAGSDGPTFGTKVSAYPPCPRPDLVDGLRAHTDAGGIVLLFQDDQVSGLQLLRGGEGGDVPAIRHAIVANVGAGLGVITTGPCTGVMHPVLTRPDGHRMSGPSCPNPRAGALVRRGPALVGAAQERRGEAPHPRFVLEDYMNLYVRHKFEAKEPRFEAMKSAIATA

SEQ ID NO: 4953 - protein, 319 aa, Zea mays
  Clone ID: PAT_MRT4577_163023C.1.pep
MAATVSFPVVNMEKMETEEKATAMEVIRDACENWGFFELLNHGISHELMDEVERLTKAHYANFREAKFQEFAARTLEAGDKGADVKDVDWESTFFVRHLPASNLADLPDVDDHYRQVMKQFASEIQKLSEKLLDLLCENLGLEPGYLKSAFAGSNGPTFGTKVSAYPPCPRPDLVDGLRAHTDAGGIILLFQDDQVSGLQLLKDGEWVDVPPMRHAIVVNIGDQLEVITNGRYKSVMHRVLTRPDGNRMSIASFYNPGADAVIFPAPALVGAAGAEEERAGQARYPRFVFEDYMNLYVRHKFEAKEPRFEAMKSAIATA

SEQ ID NO: 4954 - protein, 323 aa, Zea mays
  Clone ID: PAT_MRT4577_163024C.1.pep
MAATVSFPVVNMEKLETEERDTAMAVIRDACENWGFFELLNHGISHELMDEVERLTKAHYATFREAKFQEFAARTLAAAGDEGADVSDVDWESTFFVRHLPASNLADLPDVDDHYRQVMKQFASEVQKLSEKVLDLLCENLGLEPGYLKAAFAGSDGGPTFGTKVSAYPPCPRPDLVAGLRAHTDAGGLILLLQDDQVSGLQLLRGGDGGEWVDVPPLRHAIVANVGDQLEVVTNGRYKSAVHRVLARPDGNRMSVASFYNPGADAVIFPAPALVGEEERAEKKATTYPRFVFEDYMNLYARHKFEAKEPRFEAMKSSAIATA

SEQ ID NO: 4955 - protein, 318 aa, Zea mays
  UNSURE (1)..(318): unsure at all Xaa locations
  Clone ID: PAT_MRT4577_163025C.1.pep
  unsure (1)..(318): unsure at all Xaa locations
MAATVSSFPVVNMEKLETEERATAMEVIRDGCENWGFFELLNHGISHELMDEVERLTKAHYATFREAKFQEFAARTLEAGEKGADVKDVDWESTFFVRHLPASNLADLPDVDDRYRQVMEQFASEIRKLSERLLDLLCENLGLEPGYLKAAFAGXSDGPTFGTKVSAYPPCPRPDLVDGLRAHTDAGGIVLLFQDDQVSGLQLLRGGEWVDVPPMRHAIVANVGDQLEVITNGRYKSVMHRVLTRPDGNRMSVASFYNPGADAVIFPAPALVGAAEEDRAEAAYPSFVFEDYMNLYVRHKFEAKEPRFEAMKSAIATA

SEQ ID NO: 4956 - protein, 226 aa, Zea mays
  Clone ID: PAT_MRT4577_163140C.1.pep
METVVGDLMATELRLGLPGTVDDCSQPQLVKATPPSTPRGKRRATADAVEEAAGAEEASKRDAETAPPAAKAPVVGWPPVRSYRKSCFQQASSKQAAAAKQEAAAAAPGCTASSAAATNTTSSSSAAVVVGSFVKVSMDGAPYLRKVDLRMYRGYRELREALEAMFVSSSSANNLSEFAVTYEDKDGDLMLVGDVPFEMFASTCKKLRIMKRSEATGLGSSSARQQ

SEQ ID NO: 4957 - protein, 122 aa, Zea mays
  Clone ID: PAT_MRT4577_163214C.1.pep
MAVKGGKGLLAAKTTGAKSTDRDKDRKKAPVSRFSRAGLKFRGGRIHRQLKSGAFAHGRVGATAAVYSAAILEYLTAEVLELAGNASRDLKVKRITPRHLKLAIRGDEELDTLIKGTIAGGG

SEQ ID NO: 4958 - protein, 54 aa, Zea mays
  Clone ID: PAT_MRT4577_163449C.1.pep
RQPRHRGREQVHHRGAPLGHPGARGAPPAGRTQGAHIGRNIALRAMQADARTGA

SEQ ID NO: 4959 - protein, 168 aa, Zea mays
  Clone ID: PAT_MRT4577_163452C.1.pep
MAEKKMVTLRSSDHEEFEVEEAVAMKSEIIRLLIEDDCADNAIPLPNVDSKTLALVIEYCNKHVHAVAADDSAAAETSNASSAAGGGDVDLKKWDAEFVKVEQATLFDLILAANYLDIKGLLDLTCQTVADMMKGKSPEEIRRTFNIKNDFTEEEEEEIRRENSWAFD

SEQ ID NO: 4960 - protein, 164 aa, Zea mays
  Clone ID: PAT_MRT4577_163642C.1.pep
PLFLQQSSALLQQLPLVRLLAHNIRAHHIHHLVLANLVAYSQQQQCLPFTQLDALSSASYMHHHHLPFRQLSVAYPQQFLPFTHLSALSSLAYLQQHHLLPLRQLDGVSPVTFLTHPQLWPFYQRAAPIAGTLLHLHHLLPLTQLALSNPPAFYHHPITGGALS

SEQ ID NO: 4961 - protein, 109 aa, Zea mays
  UNSURE (1)..(109): unsure at all Xaa locations
  Clone ID: PAT_MRT4577_163700C.1.pep
  unsure (1)..(109): unsure at all Xaa locations
PAGARIGLSRTYLLYYTLGSDTTAIGRPCSALFXLPGXCASATSGDHIPGXHLPPVMXLGTLXPWLQYXMMQQELGSLMACPCLMLQQLXLAYPLQSMAVXMMPQMMTP

SEQ ID NO: 4962 - protein, 135 aa, Zea mays
  UNSURE (1)..(135): unsure at all Xaa locations
  Clone ID: PAT_MRT4577_163757C.1.pep
  unsure (1)..(135): unsure at all Xaa locations
MAARGKAIGAGAAKKASLRSSKAGLQFPVGRIARVLKAGKYAERVCAGAPAYLAAVLEYLAAEVLXELAGNAARDTKKTRIVPSHIQLAVRNNQELTKLLCGATITSGGVMPNIHQHLLPKKAAYSKATVLYVHN

SEQ ID NO: 4963 - protein, 134 aa, Zea mays
  Clone ID: PAT_MRT4577_163759C.1.pep
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATIASGGVMPNIHQHLLPKKAASSKASVDDDDN

SEQ ID NO: 4964 - protein, 672 aa, Zea mays
  Clone ID: PAT_MRT4577_163763C.1.pep
MDQLRPEPAAGAHEIEKTAAPDVESEPAAAVPEPERVPPWREQVTARGMVAALLIGFVYTVIVMKLSLTTGLTPTMNVSAALLAFLALRGWTRALGRLGIACRPFTRQENTVVQTCVVACYTIGFGGGFGSFLLGLDKKTYELSGVSTPGNVPGSYREPAIGWMTGFLLAVSFVGLLTLLPLRKVLVIDYKLTYPSGTATAVLINGFHTPQGDKNAKIQVRGFLKYFGISFLWSFFQWFYTAGDHCGFAQFPTFGLQAFNQTFSFDFSLTYVGAGMICSHLVNLSLLFGAVVSWGVMWPLIGKQKGNWYPADASQNSMTGIYGYKAFLCIALLVGDGLYNFVKVIAITVKNIRERSRRKNLNRVADADTMALDDMQRDEVFNRDNIPTWLSYAGYAALSLIAVIAIPIMFREVRWYYVVVAYALAPALGFCNAYGTGLTDMNMGYNYGKIALFVLAAWAGKDSGVVAGLVGCGLVKQLVLVSADLMHDFKTGHLTLTSPRSMLVGQAVGTLMGCVLAPLTFMLFYRAFDVGEPDGYWKAPYALIYRNMAILGVEGFSALPRHCLQLCAGFFAFAVLANLARDLLPRRLARLVPLPMAMAVPFLVGASFAVDMCVGSLVVFAWHKLDGKKAALLVPAVASGLICGDGIWTFPSSLLALAKVKPPICMKFTPGS

SEQ ID NO: 4965 - protein, 68 aa, Zea mays
  Clone ID: PAT_MRT4577_164044C.1.pep
GSVEGQWGAADVEYRCFVGGLAWATIIESLENAFASYGKILDFKVYTDRQTGGSRGLGYGTFFYVNSM

SEQ ID NO: 4966 - protein, 70 aa, Zea mays
  UNSURE (1)..(70): unsure at all Xaa locations
  Clone ID: PAT_MRT4577_164214C.1.pep
  unsure (1)..(70): unsure at all Xaa locations
GKNNGSEKENLAGRAPPVNSSSSRGELPKPPPRVPPPKPPPPPPEPPAPPKPPPPPAKPPPPXXPPPPKP

SEQ ID NO: 4967 - protein, 67 aa, Zea mays
  Clone ID: PAT_MRT4577_164249C.1.pep
GVTRLTGVIVQSLQSDKEVFLHERVSNASGAGEMLGFGSVSGASVLDDGGELVIVSEPDLEAGTITI

SEQ ID NO: 4968 - protein, 159 aa, Zea mays
  Clone ID: PAT_MRT4577_164254C.1.pep
MSRCKPVGGESPAADGPDPRRPMSETPCSVQPGVLPLLGKPYFTCILCKSHVNQPFQVVVPKSLAPFLPGTTVPATVTWHGRSWEMRFTGGRQIQRLEAGWRGFALDNGLKLGDGCVFELVDGRAERVVFRVQVLRADIPAEIRERAGGYTSSSPILID

SEQ ID NO: 4969 - protein, 323 aa, Zea mays
  Clone ID: PAT_MRT4577_164353C.1.pep
MAAGRELVVSFGEMLIDFVPTVAGVSLAEAPAFLKAAGGAPANVAIAVSRLGGGAAFVGKLGDDEFGRMLAAILRDNGVDGGGVVFDAGARTALAFVTLRADGEREFMFYRNPSADMLLTADELNVGLIRRAAVFHYGSISLIAEPCRTAHLRAMEIAKEAGALLSYDPNLREALWPSREEARTQILSIWDQADIVKVSEVELEFLTGINSVEDDVVMKLWRPTMKLLLVTLGDQGCKYYTRDFHGAVPSFKVQQVDTTGAGDAFVGALLRRIVKDPSSLQDEKKLVESIKFANACGAITATKKGAIPSLPTETEVLQLIEKA

SEQ ID NO: 4970 - protein, 85 aa, Zea mays
  UNSURE (1)..(85): unsure at all Xaa locations
  Clone ID: PAT_MRT4577_16442C.1.pep
  unsure (1)..(85): unsure at all Xaa locations
KSQSHSSESINKEIEAAHMEALYKEVQAATRDDLSVVKSTKQPPKXHKRYIPKKLTYEQSKAILIERLNQLTSSGGADIDAEDDE

SEQ ID NO: 4971 - protein, 160 aa, Zea mays
  UNSURE (1)..(160): unsure at all Xaa locations
  Clone ID: PAT_MRT4577_164467C.1.pep
  unsure (1)..(160): unsure at all Xaa locations
MSDSEEHHFESKADAVASKTYPQQDGTARKNGFIGIRNRPCKGAEVSTSRSGKHGHAKCHFAAIYIFNGRKLEXIVPSSHNXDIPHVNRTEHQXIDISXDGFVSLLTSDGNTKDDRTLPTDDTLVAQIKEGFDSGKDLVETVQSAMGEEQICALNDAAPK

SEQ ID NO: 4972 - protein, 161 aa, Zea mays
  UNSURE (1)..(161): unsure at all Xaa locations
  Clone ID: PAT_MRT4577_164472C.1.pep
  unsure (1)..(161): unsure at all Xaa locations
MSDSEEHHFESKADAGAPKTYPHKAGTVRKNGFIVIMNRPCHDVEASTSKTAKHGHAKCHFXVAIDIFNGNELEQIVPSSHNWDIPHVNRTEYQLIDISEDGFASLLTSXGSTKDDLRLPTDETLVAQIREGFQSXKDLVETVQTAMGEEHICAMKDVGPK

SEQ ID NO: 4973 - protein, 193 aa, Zea mays
  UNSURE (1)..(193): unsure at all Xaa locations
  Clone ID: PAT_MRT4577_164476C.1.pep
  unsure (1)..(193): unsure at all Xaa locations
VRRSRRSQSIAIRPLFSPCSSASFLIQPTQGSPCRDSEEHHFESKADAGASKTYPQQAGCARRNGFIAIKNRPCKAVEASTSXTGKHGHAKCHFVAIDIFNGKKLEDIVPSSHDCDITHVNRTDYHLIDISEDEFVSLLTSHGYTNDDVILPSDETLVRQIQERLESEKDLVVTDQSAMGEVHICALNDVGPK

SEQ ID NO: 4974 - protein, 151 aa, Zea mays
  UNSURE (1)..(151): unsure at all Xaa locations
  Clone ID: PAT_MRT4577_164477C.1.pep
  unsure (1)..(151): unsure at all Xaa locations
SKADVGSLKTYPYXVGTVRKNGFIIINNRPCEVVEVSTSKTGKHGHAKCHFVAIDIFNGKKLEDIVPSSHNCDIPHESRTDYHVIDISKDGLVILLTSHGNTKDDLRLPSDXTLVVQIXEGFESGKDLDVTVXQFAMGEEQICALNDDAPK

SEQ ID NO: 4975 - protein, 197 aa, Zea mays
  UNSURE (1)..(197): unsure at all Xaa locations
  Clone ID: PAT_MRT4577_164479C.1.pep
  unsure (1)..(197): unsure at all Xaa locations
PDKPGIAVSDSEEHHFKSKADAGSSKTYPQQDGTVRKNGFIDIKNRPCKVVEVSTSKTGNHGHAKCHFVDIDIFDGKKLQDIVPSSRDCDIPHENRTEYQLIDISXDGFESLLTSDGXTNDDLRLPTDETLEAQIKEGVESAKDLVVTVQSAIAEEHICALNDVAPKELPCLAILLSRNLYRIKKRIKDCYRDIHLA

SEQ ID NO: 4976 - protein, 160 aa, Zea mays
  UNSURE (1)..(160): unsure at all Xaa locations
  Clone ID: PAT_MRT4577_164482C.1.pep
  unsure (1)..(160): unsure at all Xaa locations
MSDSEENHFKSKADAGXCKTYPEHDGTVRNNGFISIENRPCKDGEVSTXKTGKHGHAECHFVAIDILHGKKLEDIGPSAHNCDIPHVNRTEHQLIDISEDGFVSLLTSDGNTNDDLTLPTDETLVVQIKEGFESGKDLVVTVQSAMGEEHICALKDVGPK

SEQ ID NO: 4977 - protein, 182 aa, Zea mays
  UNSURE (1)..(182): unsure at all Xaa locations
  Clone ID: PAT_MRT4577_164510C.1.pep
  unsure (1)..(182): unsure at all Xaa locations
PLSISLLLRLLLEPAKTEHRHVRSSEEHRFESKADAGASKTYPQQGGTGRKNGFIVIKNRPCKVVEVSTSKTGKHGHAKCHFVXAIDIFNGKRLEDIVPSSHNCDIPHANRTEYQLIDISEDGFVSLLTSHGDTRDDLTLPTDETLVDQIEEGFESGKDLAETVQSAMGEEHICALKDVGPQ

SEQ ID NO: 4978 - protein, 101 aa, Zea mays
  Clone ID: PAT_MRT4577_164511C.1.pep
MGGAVMVAIAASIGNLLQGWDNATIAGAVLYIKKEFNLQSEPLIEGLIVAMSLIGATVITTFSGAAADCVGRRPMLVASAVLYFVSGLVMLWAPSVYILLL

SEQ ID NO: 4979 - protein, 173 aa, Zea mays
  UNSURE (1)..(173): unsure at all Xaa locations
  Clone ID: PAT_MRT4577_164518C.1.pep
  unsure (1)..(173): unsure at all Xaa locations
MSDSEEDHFXSKADAGASKTYPQQAATDRKNGFIVIKNRXPARSVEASTSETGKHVHAKCHFVAINIFHGKKLEEIVPSSHNXCDIPDVKRTEYQLIEISEDGFESLLTSDGNTKDDLILPTDETLVAHIKEGFEGGKDLVETVQSAMGEEQICALKELAQVLTCLGILYLKT

SEQ ID NO: 4980 - protein, 160 aa, Zea mays
  UNSURE (1)..(160): unsure at all Xaa locations
  Clone ID: PAT_MRT4577_164521C.1.pep
  unsure (1)..(160): unsure at all Xaa locations
MSDSEEHDFESKADAGASRTYPQQGATVRKNGFIVIKNRPCKDAEDSTSKTGKHGHPKCHFVTIDLCTGKKLEDIVPSSHNCDIPHVNRTEHQLIDISEDGFVSLLTSDGNTNDELKVPTDETLVAQIKEGFXAIKDLVVTVQSAMGEDQICAMKDVDPK

SEQ ID NO: 4981 - protein, 161 aa, Zea mays
  UNSURE (1)..(161): unsure at all Xaa locations
  Clone ID: PAT_MRT4577_164523C.1.pep
  unsure (1)..(161): unsure at all Xaa locations
MWDSEEHHFESRADAGACKTYPQQAGTVRENGVIVIKNRPCGGGEVSTSKTGKHGHAKCHFVAIDIFNGXKKLEDIVPSSHNCDIPHVNRTEYQLIEISEEGFVSLLTSEGNTKEELRLPTDETLVGQIKEGXESGKDLVVTVQSAMGEEXICALKDVGPK

SEQ ID NO: 4982 - protein, 161 aa, Zea mays
  UNSURE (1)..(161): unsure at all Xaa locations
  Clone ID: PAT_MRT4577_164524C.1.pep
  unsure (1)..(161): unsure at all Xaa locations
MSDSEEHHLESKADAGASKTYPQQAGTVRKNXGSIGIKNRPCKAAEGPTXKDWXHGHAKCHFAAIDISNGKKLEDIVPSRHNCDIPHENRTEYQVIDISEDGCVSLLTXDGNTKDDLRLPTEETLVAQIKEGIESGKDPVGTVQSAMGEEQICALKDDGPK

SEQ ID NO: 4983 - protein, 155 aa, Zea mays
  UNSURE (1)..(155): unsure at all Xaa locations
  Clone ID: PAT_MRT4577_164528C.1.pep
  unsure (1)..(155): unsure at all Xaa locations
EHHFESKADAGASNTYPQHAATGRKNGFIVIKNRPCKVVQVSTSKTGKHGHAKCHFVAINIFSVKKLGDIVPSSHNCDIPYVNRTEYQLIDISEDVFVSLLTSYGNTKDDLRLPTDDTLVVQINESFXSGKDLVVTVQSAMGXEQICALNDVAPK

SEQ ID NO: 4984 - protein, 124 aa, Zea mays
  UNSURE (1)..(124): unsure at all Xaa locations
  Clone ID: PAT_MRT4577_164542C.1.pep
  unsure (1)..(124): unsure at all Xaa locations
IAVSDXXEHHFXSKADSGASKTYPHQAGTVRNNCFIVIKNRPCKVVEVSTSNTVNHGHAKCHFVAIDIFNCKKLXDIVPSSHNCDIPHLNRTEYHLIDISXDGFVSLLTSDGNTNDHLILPTDE

SEQ ID NO: 4985 - protein, 179 aa, Zea mays
  Clone ID: PAT_MRT4577_164545C.1.pep
FLLSLLLRLRLIHPRQGSPCTDSEEHHFESKADAGASKTYPQQAGTVRKNGFIVIKNRPCKVVEDSTSYTVKHEHDECHFVAIHIFHAKKIEDIVPSSHNCDIPHVNRTEYQLIDISEDGFVRLLTSDGNTNDDLRLPTDETLVAHIKEGFESGKDLVVTVQSAMGEEQICALKDVGPK

SEQ ID NO: 4986 - protein, 179 aa, Zea mays
  Clone ID: PAT_MRT4577_164549C.1.pep
MSIFLLIRLLMEPAKPGIAMSDSEEHHFESKADSRASKTYPQKAVTVRKNGFIVIKNRPCKDVEVSTSDTVKHGHATCHFVAIDIFNGKKLEDMDPSSHTCDIPHVNRTEYHLIDISYDGFGSLLTSDGNTKDDLKLPTDETLVGQIKEGFESGKDLVVTVQSDMVEEHICALKDVGPK

SEQ ID NO: 4987 - protein, 175 aa, Zea mays
  UNSURE (1)..(175): unsure at all Xaa locations
  Clone ID: PAT_MRT4577_164554C.1.pep
  unsure (1)..(175): unsure at all Xaa locations
MRTCSSARQMLLTRLSSVSCSSTAQQLHAGASKTYPQQAGTXVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPK

SEQ ID NO: 4988 - protein, 52 aa, Zea mays
  UNSURE (1)..(52): unsure at all Xaa locations
  Clone ID: PAT_MRT4577_164571C.1.pep
  unsure (1)..(52): unsure at all Xaa locations
RTYLFKTFYICSLITNVIAVHFQESEYSHSQQCEQLIHGSPXSITFLYTILI

SEQ ID NO: 4989 - protein, 160 aa, Zea mays
  Clone ID: PAT_MRT4577_164577C.1.pep
MSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPK

SEQ ID NO: 4990 - protein, 160 aa, Zea mays; identical to SEQ ID NO: 4989
  Clone ID: PAT_MRT4577_164581C.1.pep

SEQ ID NO: 4991 - protein, 214 aa, Zea mays
  Clone ID: PAT_MRT4577_164582C.1.pep
MRWYKKVAVAFKKKKKKDEVEDYDEKLIAYHPRLYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPK

SEQ ID NO: 4992 - protein, 93 aa, Zea mays
  Clone ID: PAT_MRT4577_164782C.1.pep
GPPGFGFLGNRIKMAASDVDYRGFIGGLPWATDDHSLNNAFSTYGKVLESKIILNRETQRSHGFSFVTFSTEEAMRNAIDGMNGNELDGRNIT

SEQ ID NO: 4993 - protein, 144 aa, Zea mays
  Clone ID: PAT_MRT4577_164831C.1.pep
NNNLHKPAWCGTKVQRPAPDSLHRELLPQRAECKPQTRSPSRPRQLRRVGNWALGVALRTRSCLRDRPKKKNGQMNEANQCVMSIRRRNNNGSTGNSRSVAFVVGVGFSRCRAAPPLLERDAHNKHAMCPFGRSYARWDLTVGK

SEQ ID NO: 4994 - protein, 329 aa, Zea mays
  Clone ID: PAT_MRT4577_165073C.1.pep
MAFFSHHHLQQPHAQQPVLPSFRNALPVPVDGQIPAPLTFFNPPPAFPEQPAQAPLVDAVGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKILRKIRDKEAEVETINKRNSELEDQIKHLGVEVGAWQHRAKYNESMINALKYNLEQVCAHQSKDFKEGCGDSEVDDTASCRDGGAINFQLTPKENRQPKDLTACRVCKSSEASMLLLPCRHLCLCKECESKLSICHMCQSSKILGMEIYYA

SEQ ID NO: 4995 - protein, 387 aa, Zea mays
  Clone ID: PAT_MRT4577_165077C.1.pep
MFCIPSYHFAICHPQLPRAHFAVFHSITPSPPSLSPQPFPLSHLLPPHLAMAFFSHHHLQQPHPQQAPPPNQQQPVLPSFRNALPVPVDGQIPAPLTFFNPPPAFPEQPAQTTLVDAVGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKIFRKIRDKEAEVETINKRNSELEDQIKHLGVEVGAWQQRAKYNESLINALKYNLEQVCAHQSKDFKEGCGDSEVDDTASCPYGGAVNLQLMPKENRQPKNLTACRVCKSSEACMLLLPCRHLCLCKECESKLSICPLCQSSKILGMEIYYA

SEQ ID NO: 4996 - protein, 129 aa, Zea mays
  UNSURE (1)..(129): unsure at all Xaa locations
  Clone ID: PAT_MRT4577_165108C.1.pep
  unsure (1)..(129): unsure at all Xaa locations
LTRPRTRGGVCLVLEKPPVTAFAHKTLLEGHYEAEAKAPASFGPVGAVLLENEHHKEIFIKEIKVVTGSDSSTXVTFGCNSWVHSKMDNPEKRMSLTLKSYLACDTPKGLEDLMKKDLHALRGDRHSER

SEQ ID NO: 4997 - protein, 276 aa, Zea mays
  Clone ID: PAT_MRT4577_165280C.1.pep
MEAVARSGDYLWRFVAETEWYNEVVLSAVAPGDWWRGLPHPVQSWMRNCVGGYLLYFISGFLWCFVIYYWKRHAYIPKDAIPTNEAMKKQIVVASKAMPFYCALPTLSEYMIESGWTRCYFNISEIGFSMYLCYMAMYLIFVEFGIYWMHRELHDIKPLYKYLHATHHIYNKENTLSPFAGLAFHPLDGILQAIPHVFALFLFPTHFRTHIALLFLEAVWTTNIHDCIHGKIWPVMGAGYHTIHHTTYRHNYGHYTIWMDWMFGTLNEPDDILKKA

SEQ ID NO: 4998 - protein, 230 aa, Zea mays
  UNSURE (1)..(230): unsure at all Xaa locations
  Clone ID: PAT_MRT4577_165318C.1.pep
  unsure (1)..(230): unsure at all Xaa locations
MAATRCCLLMLLGLCESAVTSTIHTTLLQAAIASLLPPYLXSGVIWNGENPNFQPYRIQHGIAAGILPLSPLLLQQXEPYYSQSPSLHLLAQNIRAQQLQQLELAYLAAYCHQQQYVTFNQLTGLNYASYXAQQQLRSSQLCAAYPQHFLPFIQLTALNSPAYLQDQHLLPFSQXLAGXSPATFLTQPQXLLSVYQHAVPNAGTLLPLQQLLPFNQLALKNPTGFXYQQP

SEQ ID NO: 4999 - protein, 111 aa, Zea mays
  UNSURE (1)..(111): unsure at all Xaa locations
  Clone ID: PAT_MRT4577_1653C.1.pep
  unsure (1)..(111): unsure at all Xaa locations
GSAGFGFEGEXRIEMASMDVDHRCFLGGLSWATDDHSLHNAFSTYGEVLEFKIILDRETHRSRGFGFVTFSTEEAMXTAIEGMXNCKELDGPNITVNEVHFPCGLGGCRRP

SEQ ID NO: 5000 - protein, 437 aa, Zea mays
  Clone ID: PAT_MRT4577_165462C.1.pep
MDAASRPPPPHGTGVRVRAPLVESVSCYCRLDTGLKTVVEARKFVPGAKMCMQPEVKQNKRKSRGSKKERCRTQAPLLPGLPDDLAIACLIRVPRLEQPKLRMVCKRWNRLLSGNYFYSLRKKIGVAEEWVYVFKRDREGKISWYAFDPLHQLWKSLPPVPQEYSEALGFGCAVLSGCYLYLFGGKDPLRGSMRRVVFYNARTNKWHRAPDMMRKRHFFGSCVINNCLYVAGGECEGIQRTLQSAEVYDPNRNRWACVTEMNNGMVPFIGVVYDGKWFLKGLDSHRQVTSEVYLPSSNTWSAIDDEMVTGWRNPSISFNGRLYSADCRDGCKLRVYDENTGTWTRFMDSKHHLGSSRAFEAAALVSLNGKLCVIRNNMSITLVDVSNPTMSVETDSARMWETVVRKGQHRSFVANLWSSIAGRNLKSHIIHCHVLQV

SEQ ID NO: 5001 - protein, 197 aa, Zea mays
  UNSURE (1)..(197): unsure at all Xaa locations
  Clone ID: PAT_MRT4577_165711C.1.pep
  unsure (1)..(197): unsure at all Xaa locations
GPLSPTVFSVXENPIVQPYRTQQAITGGLXPISPLSLQQSSALSPEIPLVHVVAQHFLSQHLQPLALANLAVYSEQQQFLTFKQLAVVNCALYAQQQQVPYRQICGVYPQDFFTYNQLTVLNSSAYSQQSHLLPFSQLAGVSRDTLLTQTQVLPLYQHAAPNAGTLLQLQQLVPLNQLAVTDPAAFYQQPMXGGALF

SEQ ID NO: 5002 - protein, 127 aa, Zea mays
  UNSURE (1)..(127): unsure at all Xaa locations
  Clone ID: PAT_MRT4577_165843C.1.pep
  unsure (1)..(127): unsure at all Xaa locations
FHEGSKADLEDFGVHSGDMESEXLGEWADDYGMXIKPLADKSTYFRDGLRTMTTAGYDATAHRVAKGKRXNQYRGIRQRPWGKRAAVISDSHKGAREWLGTLNSPDVDERAYDADARXIHGKKVKVH

SEQ ID NO: 5003 - protein, 70 aa, Zea mays
  Clone ID: PAT_MRT4577_165929C.1.pep
MSLLGRLVRFMVGRLDGMETPFKAVVVCVETKYIHASDGVRENQLLVQGFKLSPPAICWMMYPLPIPITL

SEQ ID NO: 5004 - protein, 158 aa, Zea mays
  UNSURE (1)..(158): unsure at all Xaa locations
  Clone ID: PAT_MRT4577_166188C.1.pep
  unsure (1)..(158): unsure at all Xaa locations
TDTNYQHTKHSFLPTTASKILCVLMLLGLCAIAATATILPHCSQAPITSLIAPYLSPALSSVCENXILXPYTIQQAIAAGMLHLSXSFLQQTSVLLQQSLLEHLLTQNIXSHQLQQLVLTNLAAYXSNMQFLPFNQLGXLNSVSYLQQQQLPMSQNTF

SEQ ID NO: 5005 - protein, 146 aa, Zea mays
  UNSURE (1)..(146): unsure at all Xaa locations
  Clone ID: PAT_MRT4577_166208C.1.pep
  unsure (1)..(146): unsure at all Xaa locations
HHTKHNRVPTKAGKVFYLLILLALFSSASTATIFPQSSQPPIPFLIPPYLSPAYSSLCXNPILQPYMIQQAIPVGILPLSPLFLQQSLSLLQHLPFVHLFAQNIMAQQLQQLVLSNXLLPYFYYQHFFQFNQLASLNSSFYLQQQQ

SEQ ID NO: 5006 - protein, 344 aa, Zea mays
  Clone ID: PAT_MRT4577_166288C.1.pep
MASSGYEGILLGMGNPLLDISAVVDEGFLAKYDVKPGNVILAEDKHLPMYDELASKSNVEYIAGGATQNSIRVAQWMLQIPGASSYIGCIGKDKFGEEMKKNAQAAGINAHYHEDDNAPTGTCAVCVVGGERSLIANLSAANCYKSEHLKKPENWALVEKAKYIYIAGFFLTVSPDSIQLVAEHAAATNKVFMMNLSAPFICEVFRDAQEKALPYVDYIFGNETEARTFAKVRGWEIENVEEIALKISQLPKASGTHKRITVITQGCDPVVVADDGKVKTFPVILLPKEKLVDTNGAGDAFVGGFLSQLVQEKSIDECVRAACYAANVVIQRSGCTYPEKPDFN

SEQ ID NO: 5007 - protein, 298 aa, Zea mays
  Clone ID: PAT_MRT4577_166289C.1.pep
MARYDELASKSNVEYIAGGATQNSIRVAQWMLQIPGASSYIGCIGKDKFGEEMKKNAQAAGINAHYHEDDNAPTGTCAVCVVGGERSLIANLSAANCYKSEHLKKPENWALVEKAKYIYIAGFFLTVSPDSIQLVAEHAAATNKVFMMNLSAPFICEVFRDAQEKALPYVDYIFGNETEARTFAKVRGWETENVEEIALKISQLPKASGTHKRITVITQGCDPVVVADDGKVKTFPVILLPKEKLVDTNGAGDAFVGGFLSQLVQEKSIDECVRAACYAANVVIQRSGCTYPEKPDFN

SEQ ID NO: 5008 - protein, 115 aa, Zea mays
  UNSURE (1)..(115): unsure at all Xaa locations
  Clone ID: PAT_MRT4577_166427C.1.pep
  unsure (1)..(115): unsure at all Xaa locations
APLLPPYLSPELSSVCQNPSLQPHRIXQQAIATGMLPSXPWVLQQSSAPXEGVPLVHLWAQNIRAQHLQQRVLPNLAVYXSNMRVLPVNQLAALNSASYLPQQQVPFNQLAAGYP

SEQ ID NO: 5009 - protein, 76 aa, Zea mays
  UNSURE (1)..(76): unsure at all Xaa locations
  Clone ID: PAT_MRT4577_166466C.1.pep
  unsure (1)..(76): unsure at all Xaa locations
SCLGFAMQICTRTDALDVARHTTAAVAKGFAIGSAALVSLALGGAFVSQSASSXTVYVLSLKVFIGLIVGVMLLFW

SEQ ID NO: 5010 - protein, 72 aa, Zea mays
  Clone ID: PAT_MRT4577_166560C.1.pep
RNGAGQHTSTAGTRSPVEQGTRPRHTSAYTPSQEKTTKTLDLVKLRTRAEPSPSVSHPNSHLTVQSSTSWSE

SEQ ID NO: 5011 - protein, 77 aa, Zea mays
  UNSURE (1)..(77): unsure at all Xaa locations
  Clone ID: PAT_MRT4577_166647C.1.pep
  unsure (1)..(77): unsure at all Xaa locations
DVEYRCFVXGLTWATDDHSLHNAFSTYGEVLEYKIILDRKTHRSRGFGFNTFSTNDAILNAMEGMNCKELDMSNITE

SEQ ID NO: 5012 - protein, 77 aa, Zea mays
  Clone ID: PAT_MRT4577_166663C.1.pep
LTHHSSKPISIYTSYCMFITKSTVLNGAAALRLCTMLCSDTMMNATEMRRQLYIMVCSLHQRISLRRLLSLASSRIT

SEQ ID NO: 5013 - protein, 63 aa, Zea mays
  Clone ID: PAT_MRT4577_166819C.1.pep
FFPKSKDFIFVRFVCYSPSSVFDCKVALCQLLVLCSSWAPADPCINQHGLWIYECCYSCQDLF

SEQ ID NO: 5014 - protein, 128 aa, Zea mays
  Clone ID: PAT_MRT4577_166846C.1.pep
LVAYFQQQQFFPFNQLAALNFAFYLQQQQFPFSQVPVASPQQFFPFNQLAALNFPVYFQQHQLFPFSQLVGVSPAPFLTHPQLLPFYQPVGPNAGPLLQLQQLLPFTHLVLPTLAVFSPHPIIGGALF

SEQ ID NO: 5015 - protein, 130 aa, Zea mays
  Clone ID: PAT_MRT4577_166849C.1.pep
ANLVAYFQQQRFFPFNQLGALNSAFYLQHQQLPFSQLPVASPQHFFPFNQLAALNFPVFLQQQQLLPFSQLVGVSPAPFLTQPQLLPFYQPVGPNAGPLLQLHQLLPFNHLVLTNLAVFSPHPLIGGALF

SEQ ID NO: 5016 - protein, 86 aa, Zea mays
  UNSURE (1)..(86): unsure at all Xaa locations
  Clone ID: PAT_MRT4577_166859C.1.pep
  unsure (1)..(86): unsure at all Xaa locations
NAFSSYHESLGSKVITDRETVRSRGFSFVTFSFENSMLDAIENMNGKELDCRNITVNHTXSRCRSCGGGGYVGCRSGXRGYRGGRR

SEQ ID NO: 5017 - protein, 215 aa, Zea mays
  Clone ID: PAT_MRT4577_166961C.1.pep
LHSRCIFQRMKNYTIYAVSITIRIVLGFMLIALIWKFDFAPFMVLIIAILNDGTIMTISKDRVKPSPLPDSWKLNEIFATGVVLGTYLALVTVVFFWLIHKTDFFTNKFGVESIRNTEFKEMSALYLQVSIVSQALIFVTRSRSWSFVERPGFLLVTAFLLAQLVATLIAVYANWDFARIKGIGWGWAGVIWLFSIVFYFPLDIFKFFIRFVLSG

SEQ ID NO: 5018 - protein, 292 aa, Zea mays
  Clone ID: PAT_MRT4577_167145C.1.pep
MEGKEEDVRLGANKFSERQPIGTAAQGAGAGDDDKDYKEPPPAPLFEPGELKSWSFYRAGIAEFVATFLFLYITVLTVMGVSKSTSKCATVGIQGIAWSFGGMIFALVYCTAGISGGHINPAVTFGLFLARKLSLTRAIFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 5019 - protein, 292 aa, Zea mays; identical to SEQ ID NO: 5018
  Clone ID: PAT_MRT4577_167152C.1.pep

SEQ ID NO: 5020 - protein, 1135 aa, Zea mays
  Clone ID: PAT_MRT4577_167226C.1.pep
MSLPSNNRRTCSRSSSARSKHSARVVAQTPVDAQLHAEFEGSQRHFDYSSSVGAANRPSASTSTVSTYLQNMQRGRYIQPFGCLLAVHPDTFALLAYSENAPEMLDLTPHAVPTIDQRDALGIGVDVRTLFRSQSSVALHKAATFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVISECRRSDLEPYLGLHYPATDIPQASRFLFMKNKVRMICDCCATPVKVIQDDSLAQPLSLCGSTLRASHGCHAQYMANMGSVASLAMSVTINEDEEEDGDTGSDQQPKGRKLWGLVVCHHTSPRFVPFPLRYACEFLLQVFGIQLNKEVELAAQAKERHILRTQTLLCDMLLRDAPVGIFTRSPNVMDLVKCDGAALYYQNQLLVLGSTPSESEIKSIATWLQDNHDGSTGLSTDSLVEAGYPGAVALREVVCGMAAIKISSKDFIFWFRSHTTKEIKWGGAKHEPVDADDDGRRMHPRSSFKAFLEVVKWRSVPWEDVEMDAIHSLQLILRGSLPDEDANRNNVRSIVKAPSDDMKKIQGLLELRTVTNEMVRLIETATAPVLAVDIAGNINGWNNKAAELTGLPVMEAIGRPLIDLVVTDSIEVVKQILDSALQGIEEQNMEIKLKTFHEHECNGPVILKVNSCCSRDLSEKVIGVCFVAQDLTRQKMIMDKYTRIQGDYVAIVKNPTELIPPIFMINDLGSCLEWNKAMQKITGIKREDAINKLLIGEVFTLHDYGCRVKDHATLTKLSILMNAVISGQDPEKLFFGFFDTDGKYIESLLTVNKRTDAEGKITGALCFLHVASPELQHALQVQKMSEQAATNSFKELTYIRQELRNPLNGMQFTCNLLKPSELTEEQRQLLSSNVLCQDQLKKILHDTDLESIEQCYMEMNTVEFNLEQALNTVLMQGIPLGKEKQISIERNWPVEVSCMYLYGDNLRLQQILADYLACALQFTQTAEGPIVLQVMSKKENIGSGMQIAHLEFRIVHPAPGVPEALIQEMFQHNPGVSREGLGLYISQKLVKTMSGTVQYLREADTSSFIILMEFPVAQLSSKRSKPSTSKF

SEQ ID NO: 5021 - protein, 85 aa, Zea mays
  UNSURE (1)..(85): unsure at all Xaa locations
  Clone ID: PAT_MRT4577_167251C.1.pep
  unsure (1)..(85): unsure at all Xaa locations
QQLLALPSXIMPVMMPQMMRPNMMSPLMIPRMISLMVFPSIIXQMMMPQCHCDAYSHIMLYQQXPFMNNPMAMTNSPMFLQQLIF

SEQ ID NO: 5022 - protein, 290 aa, Zea mays
  Clone ID: PAT_MRT4577_167305C.1.pep
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 5023 - protein, 290 aa, Zea mays; identical to SEQ ID NO: 5022
  Clone ID: PAT_MRT4577_167306C.1.pep

SEQ ID NO: 5024 - protein, 48 aa, Zea mays
  Clone ID: PAT_MRT4577_167427C.1.pep
YRVAVRLCHSVSVRSTCALGVGTPVVPFGCSRYETRRKKNEQGFCSQL

SEQ ID NO: 5025 - protein, 232 aa, Zea mays
  UNSURE (1)..(232): unsure at all Xaa locations
  Clone ID: PAT_MRT4577_16750C.1.pep
  unsure (1)..(232): unsure at all Xaa locations
MRKFQDSIKALQADIDHANAMASEFLRDYDGSVIQMRVAYSAVAHFLLQWTDCKLAGALGLLKVMLYKVCADGSSALPDWEMEASIREFYGVIFPSLLQLPSGITELDDRKQRKLCLKKFRSRDEQLSEVDTERELECGICLEXNVLPTCPHXLCMRCFEDWNEKSKSCPFCRACLEEVKPGSLWIYTDDSDVVDMDTLTRENIRRLFMYINKLPLVVLHVVDLDVYKYRIK

SEQ ID NO: 5026 - protein, 43 aa, Zea mays
  Clone ID: PAT_MRT4577_167607C.1.pep
ALLLVNVHIAWLCDHTVDHHIHHQQAIRWFNVEAPSDKHLSCS

SEQ ID NO: 5027 - protein, 673 aa, Zea mays
  UNSURE (1)..(673): unsure at all Xaa locations
  Clone ID: PAT_MRT4577_167692C.1.pep
  unsure (1)..(673): unsure at all Xaa locations
METRDTDATPLPYSYTPLPAADAASAEVSGTGRTRSRRRPLCAAALVLSAALLLAVAALVGVGSRPGAVGMTESAASSPTPSRSRGPEAGVSEKTSGASDDGGRLRGAGGNAFPWSNAMLQWQRTGFHFQPQKNWMNDPNGPVYYKGWYHLFYQYNPDGAIWGNKIAWGHAVSRDLIHWRHLPLAMVPDQWYDTNGVWTGSATTLPDGRLAMLYTGSTNASVQVQCLAVPADDADPLLTNWTKYEGNPVLYPPPGIGPKDFRDPTTAWIDPSDGAWRVVIGSKDDDGHAGIAVVYRTTDLVHFELLPGLLHRVDGTGMWECIDFYPVATRGRASANGVDMSDAIASNGAVAGDVLHVMKASMDDDRHDYYALGRYDAAANAWTPIDAGRDVGIGLRYDWGKFYASKTFYDPAKRRRVLWGWVGETDSERADVSKGWASLQGIPRTVLLDTKTGSNLLQWPVEEVETLRTNSTDLSGITIDYGSVFPLNLRRATQLDIEAEFQLDRRAVMSLNEADVGYNCSTSGGAAGRGALGPFGLLVLADRRLRREQTAVYFYVAKGLDGSLATHXCQDESRSSSATDIVKRVVGSAVPVLEDEATLSLRVLVDHSIVESFAQGGRSTATSRVYPTEAIYANAGVFLFNNATAARVTATKLVVHEMDSSYNHDYMAPVADI

SEQ ID NO: 5028 - protein, 332 aa, Zea mays
  Clone ID: PAT_MRT4577_167838C.1.pep
GRDPLLATPHSPLWLFEDRHLLPLDAPAVFEEVQRPRSGNSHTSSKPAEQIRHRWQFHLSLDEDGTDNSSLFKEKLTHALRYFKESTDQHLLVQVWAPVKNGDRYVLTTSGQPFVLDHQSIGLLQYRAVSMTYMFSVDAENVGDLGLPGRVYKQKVPEWTPNVQYYSSGEYQRLNHAISYNVHGTVALPVFDPSAHSCIAVVELIMTSKKINYACEVDKVCKALEAVNLKSTEIHDHPNVQICNEGRQAALVEILEILTVVCEEHKLPLAQTWVPCKYRSVLAHGGGLKKSCLSFDGSCMGEVCMSTSDVAFHVIDAHMWGFRDACVEHHLQ

SEQ ID NO: 5029 - protein, 69 aa, Zea mays
  Clone ID: PAT_MRT4577_167956C.1.pep
TCILHLYTYHRLRSHAYSCITRAHTYVRAHNTSGARYHSSHCTRSTRGGTDDAVASNQPKKWCFFSLPA

SEQ ID NO: 5030 - protein, 105 aa, Zea mays
  UNSURE (1)..(105): unsure at all Xaa locations
  Clone ID: PAT_MRT4577_168108C.1.pep
  unsure (1)..(105): unsure at all Xaa locations
MAAADVQHRCFHGGLAWASNYECVENAFAYYGEILDYKVITDRETGRISGFSFGTFCCENYMLDAIENMNGKELDGRNIXRNQAQSRGGGGGSGGYGRGRSGGGY

SEQ ID NO: 5031 - protein, 112 aa, Zea mays
  UNSURE (1)..(112): unsure at all Xaa locations
  Clone ID: PAT_MRT4577_168134C.1.pep
  unsure (1)..(112): unsure at all Xaa locations
INAVLKKVXEPNAHKIMEHRMKYYRLRKEMDENISHRDPLRQRSHAQAAYDKANTNEQSSSRSSGGASSISFPGRMPPGGFPXGFPXGFPWGCMPXGFPGGVPGNVHMSKML

SEQ ID NO: 5032 - protein, 112 aa, Zea mays
  Clone ID: PAT_MRT4577_168216C.1.pep
MSGVWVFEDGIVRRADSEPPSGAGAGGSRPNKVLVHVPSGEVVTSYEVLERRLRELGWERYLYDPCLLQFHQRSTVHLITVPRDFSRLKLVHMYDVVVKTRNVFEVRDAAPA

SEQ ID NO: 5033 - protein, 149 aa, Zea mays
  Clone ID: PAT_MRT4577_168274C.1.pep
MLRNFPQARRLLRRMGFEKEDAYFWKQMGKAMLCTYTLFGVVWLWNETSPLGWWTLKPRPKEEREMAHLYERRKFPYPGDDEAVEEFVKSGGALGTTIGPRGFADANMDSENMQKQLQSKKFEQEAQKLWIRMRNEVVQELQEKGFDIE

SEQ ID NO: 5034 - protein, 113 aa, Zea mays
  UNSURE (1)..(113): unsure at all Xaa locations
  Clone ID: PAT_MRT4577_168364C.1.pep
  unsure (1)..(113): unsure at all Xaa locations
MSGRGKGGKGLGKGGAKRHHKVLRDNIQGITKPAIRRLAMTGGVKXISGLIYKETRGVLKIFLENDIRDTVTYTEHARRKTVTVMDVCYTLKRQGRTLYSFSGYAPFPYDALM

SEQ ID NO: 5035 - protein, 103 aa, Zea mays; identical to SEQ ID NO: 3555
  Clone ID: PAT_MRT4577_168366C.1.pep

SEQ ID NO: 5036 - protein, 103 aa, Zea mays; identical to SEQ ID NO: 3555
  Clone ID: PAT_MRT4577_168368C.1.pep

SEQ ID NO: 5037 - protein, 103 aa, Zea mays
  Clone ID: PAT_MRT4577_168369C.1.pep
MSGRGKGGKGLGKGGAKRHRKVLRDNIQGITKPAIRRLARRGGVKRISGLVYEETRGVLKIFLENVIRDAVTYTEHARCKTVTAMDVVYALKRQGRTLYGFGG

SEQ ID NO: 5038 - protein, 103 aa, Zea mays; identical to SEQ ID NO: 3555
  Clone ID: PAT_MRT4577_168371C.1.pep

SEQ ID NO: 5039 - protein, 103 aa, Zea mays; identical to SEQ ID NO: 3555
  Clone ID: PAT_MRT4577_168372C.1.pep

SEQ ID NO: 5040 - protein, 103 aa, Zea mays; identical to SEQ ID NO: 3555
  Clone ID: PAT_MRT4577_168374C.1.pep

SEQ ID NO: 5041 - protein, 103 aa, Zea mays; identical to SEQ ID NO: 3555
  Clone ID: PAT_MRT4577_168375C.1.pep

SEQ ID NO: 5042 - protein, 103 aa, Zea mays; identical to SEQ ID NO: 3555
  Clone ID: PAT_MRT4577_168378C.1.pep

SEQ ID NO: 5043 - protein, 103 aa, Zea mays; identical to SEQ ID NO: 3555
  Clone ID: PAT_MRT4577_168396C.1.pep

SEQ ID NO: 5044 - protein, 103 aa, Zea mays; identical to SEQ ID NO: 3555
  Clone ID: PAT_MRT4577_168398C.1.pep

SEQ ID NO: 5045 - protein, 103 aa, Zea mays; identical to SEQ ID NO: 3555
  Clone ID: PAT_MRT4577_168399C.1.pep

SEQ ID NO: 5046 - protein, 103 aa, Zea mays
  Clone ID: PAT_MRT4577_168402C.1.pep
MSGRGKGGKGLGKGGAKRHRKVLRDNIQGITKPAIRRLARRGGVKRISGLIYEESRGVLKIFLENVIRDAVTYTEHARRKTVTAMDVVYALKRQGRTLYGFGG

SEQ ID NO: 5047 - protein, 103 aa, Zea mays; identical to SEQ ID NO: 3555
  Clone ID: PAT_MRT4577_168403C.1.pep

SEQ ID NO: 5048 - protein, 137 aa, Zea mays
  Clone ID: PAT_MRT4577_168407C.1.pep
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVASGGPDALSTRDKKVEACKAAKARLEERFKTGKNRWFFTKLRF

SEQ ID NO: 5049 - protein, 103 aa, Zea mays; identical to SEQ ID NO: 3555
  Clone ID: PAT_MRT4577_168408C.1.pep

SEQ ID NO: 5050 - protein, 103 aa, Zea mays; identical to SEQ ID NO: 3555
  Clone ID: PAT_MRT4577_168409C.1.pep

SEQ ID NO: 5051 - protein, 109 aa, Zea mays
  Clone ID: PAT_MRT4577_168430C.1.pep
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGRLGRLPF

SEQ ID NO: 5052 - protein, 103 aa, Zea mays; identical to SEQ ID NO: 3555
  Clone ID: PAT_MRT4577_168431C.1.pep

SEQ ID NO: 5053 - protein, 103 aa, Zea mays; identical to SEQ ID NO: 3555
  Clone ID: PAT_MRT4577_168432C.1.pep

SEQ ID NO: 5054 - protein, 103 aa, Zea mays; identical to SEQ ID NO: 3555
  Clone ID: PAT_MRT4577_168433C.1.pep

SEQ ID NO: 5055 - protein, 103 aa, Zea mays; identical to SEQ ID NO: 3555
  Clone ID: PAT_MRT4577_168436C.1.pep

SEQ ID NO: 5056 - protein, 103 aa, Zea mays; identical to SEQ ID NO: 3555
  Clone ID: PAT_MRT4577_168438C.1.pep

SEQ ID NO: 5057 - protein, 103 aa, Zea mays; identical to SEQ ID NO: 3555
  Clone ID: PAT_MRT4577_168439C.1.pep

SEQ ID NO: 5058 - protein, 103 aa, Zea mays; identical to SEQ ID NO: 3555
  Clone ID: PAT_MRT4577_168441C.1.pep

SEQ ID NO: 5059 - protein, 103 aa, Zea mays; identical to SEQ ID NO: 3555
  Clone ID: PAT_MRT4577_168442C.1.pep

SEQ ID NO: 5060 - protein, 103 aa, Zea mays; identical to SEQ ID NO: 3555
  Clone ID: PAT_MRT4577_168443C.1.pep

SEQ ID NO: 5061 - protein, 103 aa, Zea mays; identical to SEQ ID NO: 3555
  Clone ID: PAT_MRT4577_168464C.1.pep

SEQ ID NO: 5062 - protein, 103 aa, Zea mays; identical to SEQ ID NO: 3555
  Clone ID: PAT_MRT4577_168467C.1.pep

SEQ ID NO: 5063 - protein, 103 aa, Zea mays
  Clone ID: PAT_MRT4577_168470C.1.pep
MSGRGKGGKGLGKGGAKRHRKVLRDNIQGITKPAIRRLARRGGVKRISGLIYEETRGVLKIFLENVIRDAVTYTEHARRKTVTAMDVVYAPKRQGRTLYGFGG

SEQ ID NO: 5064 - protein, 103 aa, Zea mays; identical to SEQ ID NO: 3555
  Clone ID: PAT_MRT4577_168471C.1.pep

SEQ ID NO: 5065 - protein, 103 aa, Zea mays; identical to SEQ ID NO: 3555
  Clone ID: PAT_MRT4577_168474C.1.pep

SEQ ID NO: 5066 - protein, 103 aa, Zea mays; identical to SEQ ID NO: 3555
  Clone ID: PAT_MRT4577_168475C.1.pep

SEQ ID NO: 5067 - protein, 103 aa, Zea mays; identical to SEQ ID NO: 3555
  Clone ID: PAT_MRT4577_168476C.1.pep

SEQ ID NO: 5068 - protein, 103 aa, Zea mays; identical to SEQ ID NO: 3555
  Clone ID: PAT_MRT4577_168477C.1.pep

SEQ ID NO: 5069 - protein, 103 aa, Zea mays; identical to SEQ ID NO: 3555
  Clone ID: PAT_MRT4577_168479C.1.pep

SEQ ID NO: 5070 - protein, 103 aa, Zea mays; identical to SEQ ID NO: 3555
  Clone ID: PAT_MRT4577_168497C.1.pep

SEQ ID NO: 5071 - protein, 103 aa, Zea mays; identical to SEQ ID NO: 3555
  Clone ID: PAT_MRT4577_168498C.1.pep

SEQ ID NO: 5072 - protein, 121 aa, Zea mays
  Clone ID: PAT_MRT4577_168501C.1.pep
SRLPRKLTSPPQTRAEEAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 5073 - protein, 103 aa, Zea mays; identical to SEQ ID NO: 3555
  Clone ID: PAT_MRT4577_168502C.1.pep

SEQ ID NO: 5074 - protein, 156 aa, Zea mays
  Clone ID: PAT_MRT4577_168504C.1.pep
SKEEWLCKKKKKKGAYGKKKKNAKKTKKKKKKSTHHLFQIPPANPQFLRVRATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 5075 - protein, 161 aa, Zea mays
  UNSURE (1)..(161): unsure at all Xaa locations
  Clone ID: PAT_MRT4577_168609C.1.pep
  unsure (1)..(161): unsure at all Xaa locations
RTRGSSWKXAWKKXGACSGLSEKXYFETALSFRSRINPLVRLKAKGIEPDFGLYGLKAITKVFKSGINATPVIQCSKGPFDKYMLFQLYFCAAGNGTFIDCPAPQQYTCSKEILFHPFKKWMLKQQLNQDDDPFQLPGVAXWTTDTPYRRLCLRFCQVCME

SEQ ID NO: 5076 - protein, 149 aa, Zea mays
  UNSURE (1)..(149): unsure at all Xaa locations
  Clone ID: PAT_MRT4577_168644C.1.pep
  unsure (1)..(149): unsure at all Xaa locations
MAGKTLCLLMLLGLSASXAATATIVPQSSQAPIAYVVPPYLSPAESXIVENPIXLQPYRIQQAMAGXILPLSPLLLQQSXALLQQLPWVHLLAQNIMAQQLQQLVLANRADYSHQQQLLPFNQLGSLNSASYLQQQQLPCSQLPAAYPQ

SEQ ID NO: 5077 - protein, 41 aa, Zea mays
  Clone ID: PAT_MRT4577_168736C.1.pep
VCLCVLPLASQQRRLLEPRYLFPWWSSAANIVIMPVWVMLD

SEQ ID NO: 5078 - protein, 788 aa, Zea mays
  UNSURE (1)..(788): unsure at all Xaa locations
  Clone ID: PAT_MRT4577_168744C.1.pep
  unsure (1)..(788): unsure at all Xaa locations
MAPALSGTLGASSVAALRPCAGRRAPSAASSVAPRGSGVVRCSRGLRWDAHRSRGRLLRVRCDAAVAEKPAEEEAAGEKFEYQAEVSRLMDLIVHSLYSHKEVFLRELVSNASDALDKLRFLGVTDSSLLADGGELEIRIKPDLDAGTITITDTGVGMTKDELKDCLGTIAQSGTSKFLKALKENKDLGADNGLIGQFGVGFYSAFLVAEKVVVSTKSPKSDKQYVWEAVADSSSYVIKEETDPEKMLTRGTQITLFLRPDDKYEFADPSRIQGLVKNYSQFVSFPIYTWQEKSRTVEVEEDEEPKEVEEATKGEKKKKTITEKYWDWELANETKPIWMRNPKEIENTEYNEFYKKTFNEFLDPLAHTHFTTEGEVEFRSVLYVPGMAPLSNEEIMNPKTKNIRLYVKRVFISDDFDGELFXPRYLSFVKGVVDSNDLPLNVSREILQESRIVRIMRKRLVRKTFDMIEEIAEKEDKEDYKKFWESFGKFVKLGCIEXTGNHKRLAPLLRFHSSKNEGDLISLDQYVESMPESQKAIYYIATDSLQSAKTAPFLEKLVQKDIEVLYLIEPIDEVAIQNLQTYKEKKFVDISKEDLELGDEEEETKETKQEFTLLCDWVKQQLGDKVAKVQISKRLSSSPCVLVSGKFGWSANMERLMKAQTLGDTSSLEFMRGRRIFEINPDHPIIKDLSAACKNEPESTEARRAVELLYEAALISSGYTPESPAELGGKIYEMMAIALGGRWGRSDMEEAEASTGEASAEADSSEGTVAEVIEPSEVRPESDPWRDQ

SEQ ID NO: 5079 - protein, 112 aa, Zea mays
  UNSURE (1)..(112): unsure at all Xaa locations
  Clone ID: PAT_MRT4577_168951C.1.pep
  unsure (1)..(112): unsure at all Xaa locations
RIPERVVHARGVSDKGFFECTHDVTSLTCAYLLLAPGVRTPVIVRFSTVIHERRSXRHIRDPRGFVVKMYTREGNCDLLGNNFPGFLIRDGIKLRYVIHSNKPNPWSXVHEY

SEQ ID NO: 5080 - protein, 51 aa, Zea mays
  Clone ID: PAT_MRT4577_169249C.1.pep
KGTEINFSQHNPSYCRQDPDLYIYFTPKKEREINRTTRKGTLYWHIHCLHN

SEQ ID NO: 5081 - protein, 534 aa, Zea mays
  UNSURE (1)..(534): unsure at all Xaa locations
  Clone ID: PAT_MRT4577_169250C.1.pep
  unsure (1)..(534): unsure at all Xaa locations
MAGAGAAANGGRNKYAVLDRSEERQTDARTERRRRPLAPESERGRRERFVYACAVFASLNAVLLGYDVGVMSGAIIYMQKDLHITEFQQEILVGCLSVVSLLGSLSGGRTSDAIGRKWTMGLGAIVFQIGATIMTFAPSFTVLMIGRLLAGVGIGFGAMVSGVYIAEISPAGARGTLTSLPEICINXLGILLGYVSNYAFSGLSEHINWRIMPGVGILPSVFIGFALFVIPESPRWLMMEKRVSEARAVLLQISESEAEAEERLAEIEEAAGLMKSMKSEDKEVWRELLNPSPAVRRMLYAGCGIQLFQQITGIDATVYYSPTIFKDAGIKSDQELLAATVAVGFTKTVFILVAIFLIDRVGRKPLLYVSTIGMTICLFLLGVALTLQNHAVGLMSPRVGIDLAIFAVCGNVAFFSIGMGPICWVLSSEVFPLRLRAQGSALGQVGGRVSSGLVSMSFLSMARAISVAGMFFVFAAISTISVLFVYFCVPETKGKTLEQIEMMFESGDEWGGGEIELEDTQHLIPSIKKSVPLG

SEQ ID NO: 5082 - protein, 151 aa, Zea mays
  UNSURE (1)..(151): unsure at all Xaa locations
  Clone ID: PAT_MRT4577_169326C.1.pep
  unsure (1)..(151): unsure at all Xaa locations
ASSLVLVFSEPLMKRLRFWPQAYLGLTFNWGALLGWAAIKESIDPAIILPLYTAGICWTLVYDTIYAHQXFAIPTFILILDEVAISCCRGGLILAYLHASQDKEDDLKVGVKSTALRFGDLTKYWISGFGAACFGSLALSGYNADLGWCLV

SEQ ID NO: 5083 - protein, 52 aa, Zea mays
  Clone ID: PAT_MRT4577_16940C.1.pep
RVRSLDSKVITLRETGRSHGFYFITFSSENSKDDAIYNMNGKDLPGRNITVN

SEQ ID NO: 5084 - protein, 133 aa, Zea mays
  UNSURE (1)..(133): unsure at all Xaa locations
  Clone ID: PAT_MRT4577_169506C.1.pep
  unsure (1)..(133): unsure at all Xaa locations
GGGAGAATATIFPHCSQAPIASLLPPYLSPVVSSXCENPFIQPHRIQQALGGGVLPLSPLFLQXSSALLQQFPLVRXLAXIIGAHLLLQLVLAYLAAFSLRLRFLPFDQLAALVCGCCLRRRRLLFVLLGGGY

SEQ ID NO: 5085 - protein, 46 aa, Zea mays
  Clone ID: PAT_MRT4577_16960C.1.pep
MGGFIKTHKTNAYFKRFQVKFKIRRACITVYRVSIMLINQDEHKYL

SEQ ID NO: 5086 - protein, 622 aa, Zea mays
  UNSURE (1)..(622): unsure at all Xaa locations
  Clone ID: PAT_MRT4577_169639C.1.pep
  unsure (1)..(622): unsure at all Xaa locations
MKREYQNAGGSDGYMXSSKDKSMAAAAAGAGEQEEEVDELLAALGYKVRSSDMADVAQKLEQLEMAMGMGGACPTADDGFVSHLATDTVHYNPSDLSSWVESMLSELNAPPPPLPPATPAPRLASTSSTVTSGTAAGAGYFDLPPAVDSSSSTYALKPIPSPAVAASADPSPDSAREPKRMRTGGGSTSSSSSSSSSMDGGRTRSSVVEAAPPATQAANGPAVPVVVVDTQEAGIRLVHALLACAEAVQQENFSAADALVKQIPVLASSQGGAMRKVAAYFGEALARRVYRLRPAPDGSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLRPEGGGDTDDEPEVIAVNSVCELHRLLAQPGTLDKVLGTVRAVRPRIVTVVEQEANHNSGTFLDRFTESLHYYSTMFDSLEGAGSGSGSGQPTDASPPAGTDQVMSEVYLGRQICNIVACEGAERTERHETLVQWRGRLGGSGFEPVHLGSNAYKQASTLLALFAGGDGYRVEEKDGCLTLGWHTRPLIATSAWRVAAP

SEQ ID NO: 5087 - protein, 633 aa, Zea mays
  UNSURE (1)..(633): unsure at all Xaa locations
  Clone ID: PAT_MRT4577_169640C.1.pep
  unsure (1)..(633): unsure at all Xaa locations
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPXAVDSSSSTYALKPIPSXPVAAPSADPSTDSAREPKRMRTGGGSTSSSSSSSSSMDGGRTKEXSVVETAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNAYKQASTLLALFAGGDGYRVEEKDGCLTLGWHTRPLIATSAWRVAAAAAP

SEQ ID NO: 5088 - protein, 120 aa, Zea mays
  UNSURE (1)..(120): unsure at all Xaa locations
  Clone ID: PAT_MRT4577_169652C.1.pep
  unsure (1)..(120): unsure at all Xaa locations
MAAKIFGLLMLLGLSACADSATIFPQCSQATIAFIISPNLSPAASTVCENPILQHYKIQQAIAAGISPLSPLLLQQSSALLQQLPFEHLLAQNIMAHQLQQRVLANLAXYSEHQQVHSFN

SEQ ID NO: 5089 - protein, 173 aa, Zea mays
  Clone ID: PAT_MRT4577_169869C.1.pep
MQRGDPLVVGRIIGDVVDPFVRRVPLRVAYAAREVSNGCELRPSAIADQPRVEVGGPDMRTFYTLVMVDPDAPSPSDPNLREYLHWLVTDIPATTGVSFGTEVVCYESPRPVLGIHRVVFLLFQQLGRQTVYAPGWRQNFSTRDFAELYNLGLPVAAVYFNCQRESGTGGRRM

SEQ ID NO: 5090 - protein, 72 aa, Zea mays
  UNSURE (1)..(72): unsure at all Xaa locations
  Clone ID: PAT_MRT4577_169904C.1.pep
  unsure (1)..(72): unsure at all Xaa locations
MAAADVEYRCFVGGLAWATSNESLENAFASYGEILNSKEMTDRXTGRSRGFGLRTFYYENCMLDAVDNMNGK

SEQ ID NO: 5091 - protein, 128 aa, Zea mays
  Clone ID: PAT_MRT4577_169911C.1.pep
QHTKHNFVPTIAAKIFGLLILLAISASAATATIFPQYSQAPITYLLPPYLSPTVSSVCENPILQPYTIQHAITADILPLSPLFLQQSSALLHHLPFVHLLSQNIMSQQLQQLVLANLASYSYQHHFLP

SEQ ID NO: 5092 - protein, 50 aa, Zea mays
  Clone ID: PAT_MRT4577_170000C.1.pep
QGGEEEIAVTITWVKARQIFYRRGNPTVEVDVGLNDRRYPRGAVPSGAFT

SEQ ID NO: 5093 - protein, 522 aa, Zea mays
  Clone ID: PAT_MRT4577_17005C.1.pep
LQRSLTVVRVLCICHWWCCADQATAGGRRVCAGPPPSTATRPAAMEVSSVEFGHHAAAASKCFDDDGRLKRTGTMWTASAHIITAVIGSGVLSLAWAIAQLGWVAGPTVMLLFSFVTYYTSALLADCYRSGDACTGKRNYTYMDAVNANLSGVKVWFCGFLQYANIVGVAIGYTIAASISMLAIQRANCFHVEGHGDPCNISSTPYMIIFGVVQIFFSQIPDFDQISWLSILAAVMSFTYSTIGLGLGIAQVVSNKGVQGSLTGISVGAVTPVDKMWRSLQAFGDIAFAYSYSLILIEIQDTIRAPPPSESKVMRRATVVSVAVTTFFYMLCGCMGYAAFGDNAPGNLLTGFGFYEPFWLLDVANAAIAVHLVGAYQVYCQPLFAFVEKWARQRWPKSRYITGEVDVPLPLGTAGGRCYKLSLFRLTWRTAFVVATTVVSMLLPFFNDVVGLLGALGFWPLTVYFPVEMYIVQKKVPRWSTRWVCLQLLSVACLVITVASAAGSVAGIVSDLKVYKPFVTTS

SEQ ID NO: 5094 - protein, 143 aa, Zea mays
  UNSURE (1)..(143): unsure at all Xaa locations
  Clone ID: PAT_MRT4577_170168C.1.pep
  unsure (1)..(143): unsure at all Xaa locations
ADRPLPPQPPSALYGRGSSSXQDQWLESGDSRRVPRLSAFVNLLHVRRAMTEPPSRAXNGKRAWTGRNKSPSTEGPVSACGTWRAAAGRVPVVSRGGRRLRAVCGRRDGRWRLRAVCGGYRWTAGAYRGGGGCTCGGIPWRRA

SEQ ID NO: 5095 - protein, 122 aa, Zea mays
  Clone ID: PAT_MRT4577_1701C.1.pep
GKKGGSPDPPEQGGHALRGGRAPQGQGERGAPGPPQGRGREGVTPEPVILLVLLELGGGGRSKQNCLFVGFQPSTLPCLFCWPPVGGSLLVGDPPPPGFGVNETPPGQLLGFFRRGGGAMLL

SEQ ID NO: 5096 - protein, 653 aa, Zea mays
  Clone ID: PAT_MRT4577_170411C.1.pep
LLRSLLNADLIGFHTFDYARHFLSCCSRMLGLKYESQRGYIALEYYGRTVTIKILPVGVDLERVRSGLNDSVAGAKAAELVKPFCQQNRLLLLGVDDMDIFKGISLKLLAFEQLLMQHPEWRGRVVLVQIANPARGRGKDVREVQEESDAMVRRINDAFGQPGYQPVILIDQPLQFYERMAYYVVAECCLVTAVRDGMNLIPYEYVIARQGNERIDSILGLGPASRKKSMLVVSEFIGCSPSLSGAIRVNPWNIDSVADAMDYALEMPEGEKVLRHEKHHRYVSTHDVGYWANSFLQDLERICLDHNRRRCWGIGFGLKFRVVALDPNFKKLAVEHLVLAYRRTKKRVILLDYDGTLMPQTSLGKSPTSRTIDMLNSLCRDRNNMVFLVSAKSRMTLNEWFLPCESLGLAAEHGCFLRLRRDAEWETCVPVIDCSWKQIAEPVMKTYTETTDGSTIEDKETAIVWCYEDADPDFGSCQAKELHDHLESVLANEPVSVKAGPNLVEVKPQGVSKGLVAKRILSTTQERGDADDDLPDFVLCVGDDRSDEDMFEVIAAAAAARGVSSLQAEAEVFACTVGRKPSKAKYYLDDPADIVRLVQGLASVSDDDQTHAPPPPLPRWRRRRTPCRGEPCRRARGAVSSRWHETLWLWWKN

SEQ ID NO: 5097 - protein, 520 aa, Zea mays
  Clone ID: PAT_MRT4577_17042C.1.pep
MAFRNMVCTPQVINLTSDSERGQAQGGNGSEISEQGAQHAVRVVGNAMNIGLSGVRSYYDMSINHHHQSVHNPPPNLGVDSGFVFASNMYNPCMSSTSMNRHVSHAQSFGSGNQVLPQNQVPGTMDESSRNDSIGESAREHIKRKNAAVAGSYHFVNGFASSSSSSHAPQNPMLGPWDPSFESTVSSNVAPFNPSEYHGHNNSWPSLEGSSITGSNGFNSMVVHPDSVQRGNYTFPPTHISHSWMSHATNGIADGVPQWEYANATANIQGRFAHSGATEIANVGFHEYQNGPSTICRGPVPYFHQHAMHGMQALDPTQMQVPYQQCHSNGFLHGGINYPGNRLQLGPRNPVLFTSSERAFGPPQHPFLANPVNHRNIRILPPEHATIMDFSRLYEVSNTVDEHRDMRLDIDSMTYEELLALEEQIGDVNTGLTKSHIVDKLRTSLYVPGISSMSDQPSKSSLENDACIICQEEYQARDCVGTLDCGHRYHAECVKQWLMVKNLCPICKTTALSANRRQGQ

SEQ ID NO: 5098 - protein, 543 aa, Zea mays
  Clone ID: PAT_MRT4577_17046C.1.pep
MAFRNMVCTPQVINLTSDSERGQAQGGNGSEISEQGAQHAVRVVGNAMNIGLSGVRSYYDMSINHHHQSVHNPPPNLGVDSGFVFASNMYNPCMSSTSMNRHVSHAQSFGSGNQVLPQNQVPGTMDESSRNDSIGESAREHIKRKIAAVAGSYHFVNGFASSSSSSHAPQNPMLGPWDPSFESTVSSNVAPFNPSEYHGHNNSWPSLEGSSITGSNGFNSMVVHPDSVQRGNYTFPPTHISHSWMSHATNGIADGVPQWEYANATANIQGRFAHSGATEIANVGFHEYQNGPSTICRGPVPYFHQHAMHGMQALDPTQMQVPYQQCHSNGFLHGGINYPGNRLQLGPRNPVLFTSSERAFGPPQHPFLANPVNHRNIRILPPEQHATIMDFSRLYEVSNTVDEHRDMRLDIDSMTYEELLALEEQIGDVNTGLTKSHIVDKLRTSLYVPGISSMSDQPSKSSLENDACIICQEEYQARDCVGTLDCGHKVHAECVKQWLMVKNLCPICKTTAFVCQQKPRKMSRNEISLLLICFDKRSAQFCT

SEQ ID NO: 5099 - protein, 307 aa, Zea mays
  Clone ID: PAT_MRT4577_170642C.1.pep
MEGTAAARKRSRPETANGAAAAGKRSKDTESFQTGLSSKSKPCTKFFSTIGCPFGEGCHFLHFVPGGYPAVAKMLNLSSSAVSAPSRTHVDHAALTGASHPASTVKTRMCTKYNTTEGCKFGDKCHFAHSERELAKPAYMSQEGPPMGGRYGRAEPMQPAAMGPPAGNFGASATAKISVDASLAGGIIGKGGVNTKQISRITGVKLSIRDHESNPNLKNIELEGNFDQIKQASDLVRDLIATISASMPAKNPSAAAAPAGGGRGGGPGGKSSNYKTKLCENFLKGACTFGDRCHFAHGETEQRRGAA

SEQ ID NO: 5100 - protein, 185 aa, Zea mays
  Clone ID: PAT_MRT4577_170683C.1.pep
MEDGSAPRRSTPPTRRSRSAEFHNFSERRRRDKINEKLKALQELLPNCNKTDKVSMLDEAIDYLKSLQLQLQMLVMGKGMSPVVPLELQQYMHYITADPAQLPPLRPSGQQHRQFQITQANPQRQSNVESDFLSQMQNLHSSEPPQNFLRPPKLQLYTPEQRGGLPSTSHNTGWISGSSSYNFME

SEQ ID NO: 5101 - protein, 74 aa, Zea mays
  Clone ID: PAT_MRT4577_170759C.1.pep
TKRCGPFGQVIMFATVMFTLVQRVYFRSSRLLLPICVFDCKVALCQLLVLCSSSAPADPCINQHALWIDGCCYS

SEQ ID NO: 5102 - protein, 459 aa, Zea mays
  UNSURE (1)..(459): unsure at all Xaa locations
  Clone ID: PAT_MRT4577_170773C.1.pep
  unsure (1)..(459): unsure at all Xaa locations
PAGPGTAGSXLLLSPLGIVTKLPQPAAATNAERPPASLHLSEWGLSPPSNRSSGTSSTPSFRRRSLQLLLSFPSFNRCNLHFPWSSLINNVXLNLLFCGQFGTSVLVSDRIQGEMISFNNLFWSSLQPSFKFYRKCLTNCPYFALTMHSTTKPLGSSMPVKRAHLKPHAADIKRNPHVHELYKLVYRLPENLSWLLAPPEIPKRPASKKKKQKDEIVAGNSFGVILEWEGVVVDDDDPDLEPRVWYVLSLEEGKSFPPDALLKKIEGMRTDQAIAEVLCWSEDPAEIQRLATHKEVIYQKLQGGYYQLRPHVLDFLNTLVGFDIPIAIAAPRSRKSLEEGIKTVGLQGYFDAIVALEDFCLGKPDGEMFEVAAEQLGLEPDACVVFGNSNLTTESAHNAGMRCVAVAGRHPAYELQSANHVVRWLDQLSIVDLQRLANGEVIGRRGRESDMDMEIVIEE

SEQ ID NO: 5103 - protein, 192 aa, Zea mays
  Clone ID: PAT_MRT4577_170837C.1.pep
MSLCTIARRLCLSKPSSVNRLSVIWAHLYSTEAAKDTGAKKYKYPDVYDPYGPMSLPSEKVVDLADRIAALPPEEIKQIAPALLFRLNQEPPQAISGQGFSFGAQGGAGVGAGKAEEKKAEKTVFDVKLEKFDAAAKIKIIKEIRTFTDLGLKEAKELVEKAPVILKQSLTKDEAEAIIGKIKAAGGVAVME

SEQ ID NO: 5104 - protein, 194 aa, Zea mays
  UNSURE (1)..(194): unsure at all Xaa locations
  Clone ID: PAT_MRT4577_171218C.1.pep
  unsure (1)..(194): unsure at all Xaa locations
MVMVSGGGGNAWAKEMTLRRRIASIFNKTQEHFPTLKDYNDYLEEVEDMTFNLIEGIDVEEIEAKIARYQQENAEQIYLSRAKRAEDLAAALKASRMNPVKAEANDXRLLGVLRVLVAGQEFRASMHLPLFXGVAQPRPTGMAPQLIGSGSDPLQGDDEETRRLRAERAARAGGWTAELSKRRALEEAFSAIFI

SEQ ID NO: 5105 - protein, 521 aa, Zea mays
  UNSURE (1)..(521): unsure at all Xaa locations
  Clone ID: PAT_MRT4577_171286C.1.pep
  unsure (1)..(521): unsure at all Xaa locations
MSSEASSVVVADENGAAETVGVGRYVEMEKDQDSSAAKSRLSGLLWHGGSAYDAWFSCASNQVAQVLLTLPYSFSQLGMLSGILFQLLYGLMGSWTAYLISVLYVEYRARKEREKADFRNHVIQWFEVLDGLLGRHWRNVGLAFNCTFLLFGSVIQLIACASNIYYINDKLDKRTWTYIFGACCATTVFIPSFHNYRIWSFLGLVMTTYTAWYLAVASLIHGQVDGVKHSGPTKMVLYFTGATNILYTFGGHAVTVEIMHAMWRPQKFKAIYLMATLYVLTLTLPSAASVYWAFGDQLLTRSNALALLPRTAFRDAAVVLMLAHQFITFGFACTPLYFVWEKLVGLHDCRSLCRRAAARLPVVVPIWFLAIIFPFFGPINSAVGSLLVSFTVYIIPALAHMITFRSATARENAMEPPPRLLGRWTGAYMINAFVVAWVLVVGFGFGGWASMTNFVRQIDTFGLFTKCYQCPPPPPXCRSPAAASATSRCHSTAXGLPPTPAPSPAHYFFRHHRHHSHHRGL

SEQ ID NO: 5106 - protein, 262 aa, Zea mays
  Clone ID: PAT_MRT4577_171287C.1.pep
MSSEASSVVVADENGAAETVGVGRYVEMEKDQESSAAKSRLSGLLWHGGSAYDAWFSCASNQVAQVLLTLPYSFSQLGMLSGILFQLLYGLMGSWTAYLISVLYVEYRARKEREKADFRNHVIQWFEVLDGLLGRHWRNVGLAFNCTFLLFGSVIQLIACASNIYYINDKLDKRTWTYIFGACCATTVFIPSFHNYRIWSFLGLVMTTYTAWYLAVASLIHGQVDGVKHSGPTKMVLYFTGATNILYTFGGHAVTVEIMHAM

SEQ ID NO: 5107 - protein, 27 aa, Zea mays
  Clone ID: PAT_MRT4577_171300C.1.pep
KHTNNHELLLNWAPFYWMINNDIPNTS

SEQ ID NO: 5108 - protein, 197 aa, Zea mays
  UNSURE (1)..(197): unsure at all Xaa locations
  Clone ID: PAT_MRT4577_171309C.1.pep
  unsure (1)..(197): unsure at all Xaa locations
MGRGRSEIKRIDNPTQRQSTFYKRRDGLFKKARELAVLCDADLLLLLFSASGKLYQYLAPTVPSVKEFVERYEASTHTKVWSDIRQERRRELEKVAKMCDLLEKELRFMTVDDGERYTVPSLAALEHNLEAAVRKVRSEKDRKIGGEMSYLENMIRGRHEERYGLCNKLAHAQASNNEXEGGSTPPSSGLELKLGLN

SEQ ID NO: 5109 - protein, 488 aa, Zea mays
  Clone ID: PAT_MRT4577_171418C.1.pep
MLNCSRKMGRSASVLQVLLVSATIVVAQTQWASGVWGMYCEDLTASAERPHRASVTDFGAVGDGATLNTKAFQNALFHLDSFAKKGGAQLFVPAGRWLTGSFSLISHLTLSLDKDAVILGSPDSSDWPVIDALPSYGRGRELPGKRHQSLIFGSNLTDVIITGANGTVDGQGAVWWDWFHNHTLNYTRPPLVELMYSTRVVISNLTFINSPFWNIHPVYCSQVLVQHLTILAPISSPNTDGIDPDSSTNVCIEDCYVRNGDDIVVIKSGWDEYGISFAHPSSNISIRNITGQTRNSAGLAFGSEMSGGISDVRAEGVRIVNSVHGIRIKTAPGRGGYVKNVYVADVSFDNVSIAIRITGNYGEHPDDGYDRNALPTISNITIKDVVGVKIGVAGMLQGIPGDSFSGICLSNVSLSVRSTDPWNCSLVEGYSSSVSPEVCEQLRATPGPGQMCYGGNYPAAAAQPQPPQKSGASRLVSPFLSISWFLRR

SEQ ID NO: 5110 - protein, 354 aa, Zea mays
  UNSURE (1)..(354): unsure at all Xaa locations
  Clone ID: PAT_MRT4577_171422C.1.pep
  unsure (1)..(354): unsure at all Xaa locations
MGKKKKRVDKVFCYYCDREFDDEKILVQHQKAKHFKCHVCHKKLSTASGMAIHVLQVHKESVTKVPNAKPDRESTEIEIFGMQGIPAHVLAAHYGEEEDPSTKVPKVEVPQVRPVIMPNSLGMAFPPRPAYGVAPPIYNPALNPLMARPPIWPAAPAQAWYPQQAAYPQQSAVSVPPIVAGLPPQQPLFPIQNVPTPMTSAAANVLQTSFPMAPPGVPSPVAPHVSQPLFPVNTSAVNGAVNSPFLASVAPGTIPASSSAAVGVAGIGYGTNNQGTXNPAVGSSPAVSNNKASGAQPATNEVYLVWDDEAMSMEERRLSLPKYQVHDETSQMNSVDAAIDRRISESRLAGRMAL

SEQ ID NO: 5111 - protein, 379 aa, Zea mays
  Clone ID: PAT_MRT4577_171541C.1.pep
MGAELGEAGVPARDMVDALEGVRSILLKPSERLDDKRFTRIAGADFDDAGLGLAGLLGSLASTGFQASNLGDAIDVVNQMLDWRLSHEKPSDDCAEAELDPAYRESVKCKIFLGFTSNLVSSGVREIIRFLVQHRMVDVIVTTAGGIEEDLIKCLAPTYRGDFTLPGALLRSRGLNRIGNLLVPNDNYCKFEHWIMPILDKMLLEQSTQNVWTPSKVIARLGKEINDESSYLYWAYKNNIPVFCPALTDGSIGDMLFCHSVHSPGLVVDIVQDVRLMNAETIHASPRKTGIILLGGGLPKHHICNANMLRDGADYAVYVNTAQEFDGSDSGARPDEAVSWGKIKSSARTVKVHCDATIAFPLLVAATFARKVHGTKSTN

SEQ ID NO: 5112 - protein, 104 aa, Zea mays
  Clone ID: PAT_MRT4577_171547C.1.pep
GFVRFSGVQVSRVTRIEMAASGVEYRCFVCGLPWATDDHSLHNACSTYGEVLESKIILDRETHRFRGFGLRTFSTAEAMPNAIQGMNRTELDRRSITVHQGHSH

SEQ ID NO: 5113 - protein, 91 aa, Zea mays
  UNSURE (1)..(91): unsure at all Xaa locations
  Clone ID: PAT_MRT4577_171659C.1.pep
  unsure (1)..(91): unsure at all Xaa locations
MSGKQARASKQYEKAAQYIDYHTSFSEDEKKHPRHLQFSGNLYTAACNLKLTDYKETANLCTNVLELHSXHVNAHYRKVQAYIQLTDLDLA

SEQ ID NO: 5114 - protein, 191 aa, Zea mays
  Clone ID: PAT_MRT4577_171718C.1.pep
MSLCTIARRLCLSKPSSGSRLSAIWAHLYSTEAAKDMGAKKYKYPDVYDPYGPMPPPSEKVVELADRIAALPPEEIKQIAPALLLRLNQEPPQAVSGQGFGFGAQVGSGAGSGKAEKKAEKTVFDVRLEKFDAAAKIKIIKEIRTFTDLGLKEAKELVEKAPVVLKQSLTKEEAEAIIAKIKAAGGVAVME

SEQ ID NO: 5115 - protein, 112 aa, Zea mays
  UNSURE (1)..(112): unsure at all Xaa locations
  Clone ID: PAT_MRT4577_171748C.1.pep
  unsure (1)..(112): unsure at all Xaa locations
MFLTRQSEEHLELMDACGAGSKGKKGAAGRTADGPSKKSVTRSDKVGLQFPVGRIGRYLKNGRYAQRVGTGAPGYLXPVLEYLATKVMKLAGNAWHDNXKTLMILRHVLLGI

SEQ ID NO: 5116 - protein, 357 aa, Zea mays
  UNSURE (1)..(357): unsure at all Xaa locations
  Clone ID: PAT_MRT4577_171760C.1.pep
  unsure (1)..(357): unsure at all Xaa locations
MDKPVAPGIIKEELMEQQPPMQDGVGGGGDAPRPMEGLHEVGPPPFLTKTFDLVEDPATDAVLSWNSARNSFIVWDPHVFADGLLPRLFKHSNFSSFVRQLNTYGFRKVDPDRWEFANEGFLRGQRHLLKMIKRRKPPSAVAPLRQQRAPASCLEVGEFGFEEEIDRLKRDKNILITEVVKLRQEQQSTKDHVRAMEERLRVAEQKQVQMMGFLARAMRNPEFFQQLAQQQDKRKELEDTISKKRRRPIDNTPFYSDGESEQLDSQLKMFESGVLNGLNEPELENLAVNIQELGKGSIDDGNLTQVSDQSELNDDFXGQSFWSKILETRQDXELEGRTEDVNDLAQQLGYLSSSSPK

SEQ ID NO: 5117 - protein, 262 aa, Zea mays
  UNSURE (1)..(262): unsure at all Xaa locations
  Clone ID: PAT_MRT4577_171761C.1.pep
  unsure (1)..(262): unsure at all Xaa locations
PFLVYCNLQGFRKVDPDRWEFANEGFLRGQRHLLKMIKRRKPPSAVAPLRQQRAPASCLEVGEFGFEEEIDRLKRDKNILITEVVKLRQEQQSTKDHVRAMEERLRVAEQKQVQMMGFLARAMRNPEFFQQLAQQQDKRKELEDTISKKRRRPIDNTPFYSDGESEQLDSQLKMFESGVLNGLNEPELENLAVNIQELGKGSIDDGNLTQVSDQSELNDDFXGQSFWSKILETRQDXELEGRTEDVNDLAQQLGYLSSSSPK

SEQ ID NO: 5118 - protein, 96 aa, Zea mays
  Clone ID: PAT_MRT4577_171806C.1.pep
CHMVDPRMVKLSQKFDTLHILRAILDSSTGTFIIAGRDGTEDGNRAISTGYTDLVPFGRVFMANPDLPRTFQLDAHLNTYYRDTFYIPDPVIGSLT

SEQ ID NO: 5119 - protein, 105 aa, Zea mays
  UNSURE (1)..(105): unsure at all Xaa locations
  Clone ID: PAT_MRT4577_17197C.1.pep
  unsure (1)..(105): unsure at all Xaa locations
MAAKIFXCLLMLLGLSGSAATATILPKCSQAPITVLVSPYLSKAGCFVYENPILXPYQIQQAITGGMLHLSPFVPPQXSALIHQVPLEHLLGKKIRGQXLQQLWV

SEQ ID NO: 5120 - protein, 176 aa, Zea mays
  UNSURE (1)..(176): unsure at all Xaa locations
  Clone ID: PAT_MRT4577_172100C.1.pep
  unsure (1)..(176): unsure at all Xaa locations
AHIILYHILGSTVTTAKEARMLALIALLALWASATRATQIPGHXTADMPLGTMNPCMQLCMMQQGLASXMAKPHLTLQQLWDLPIQTMPEMTPQMMTPNMKTPXMMPTMTTPTTMTNTTTXMKMPQCHCNTVSQIMLQQQXPFMLNPKAMTNPPMFXQQPFSRGWIQHATNLHELQ

SEQ ID NO: 5121 - protein, 72 aa, Zea mays
  Clone ID: PAT_MRT4577_172115C.1.pep
GWHARRFPLVVLPGNVYISKILNDPGLMAAFSDPEVMWALQNVMNHPGVIGKPRTNHKGAPIIGKMMAKFSG

SEQ ID NO: 5122 - protein, 138 aa, Zea mays
  UNSURE (1)..(138): unsure at all Xaa locations
  Clone ID: PAT_MRT4577_172179C.1.pep
  unsure (1)..(138): unsure at all Xaa locations
FVFIFRAMDGLRVTMRLRDAPLHEFLPEWNIQVMVSESRAETGANQEDALARIEKLXEVNAKLGYLESMLGISHPELSEMQDRAILEAAIAMTNQRDQVFAEIMRPMAGTPQELGHXVTIIRQVAQKVVAKVGKTIRY

SEQ ID NO: 5123 - protein, 115 aa, Zea mays
  Clone ID: PAT_MRT4577_172255C.1.pep
MRGQANGVEDRRQRGDDHEADNDGEEAEEEEGDDEGRHRGQGPPQQRRHQAQRPNSGPQQQQQPRPPPPLARNVGYVGKHRLSAAIARLDQELQSLQEELDELETMESASAACQE

SEQ ID NO: 5124 - protein, 162 aa, Zea mays
  Clone ID: PAT_MRT4577_172258C.1.pep
MRGQANGVEDRRQRGDDHEADNDGEEAEEEEGDDEGRHRGQGPPQQRRHQAQRPNSGPQQQQQPRPPPPLARNVGYVGKHRLSAAIARLDQELQSLQEELDELETMESASAACQEVVTSTEGKPDPLLPVTSGPENSSWDRWFQRVRSRSNKWWASKGPDFS

SEQ ID NO: 5125 - protein, 251 aa, Zea mays
  Clone ID: PAT_MRT4577_172365C.1.pep
MMEPGAPYFGAMGSSASGAGGGFYQPFNSNLAGAGSSTGIQSFPCVRLRGLPFDCNDIDVCKFFVGLDIVDCLLVNKNGRFTGEAFVVFPTSMQAEFALHRDRQNMGRRYVEVFRCKKHEYYCAIANEVNQGGYFEPEYRRSPPPPRPRKPSEDKGSMEYTEVLKLRGLPYSATTEDIIKFFLEYELAEENVHIAYRTDGKATGEAFVEFPTAEVAKTAMCKDKMTIGTRYVELFPSTPEEASRAKSRGRH

SEQ ID NO: 5126 - protein, 303 aa, Zea mays
  Clone ID: PAT_MRT4577_172366C.1.pep
MNTSPSRYRAMMGGWGGSDGYEGSKRTRMMMESNPYFAVNAGSPLDVSKRARMMEPGAPYFGAMGSSASGAGGGFYQPFNSNLAGAGSSTGIQSFPCVRLRGLPFDCNDIDVCKFFVGLDIVDCLLVNKNGRFTGEAFVVFPTAMQAEFALHRDRQNMGRRYVEVFRCKKHEYYCAIANEVNQGGYFEPEYRRSPPPPRPRKPSEDKGSMEYTEVLKLRGLPYSATTEDIIKFFLEYELTEENVHIAIRSDGKATGEAFVEFPTAEVAKTAMCKDKMTIGTRYVELFPSTPEEASRARTRGRH

SEQ ID NO: 5127 - protein, 295 aa, Zea mays
  Clone ID: PAT_MRT4577_172368C.1.pep
MMGGWGVSDGYEGSKRTRMMMESNPYFAVNAGSPLDVSKRSRIVEPGPPYFGAMGSNTGGASGGFYQPFNSSNLAGAGASTGIQNFPGVRLRGLPFDCNDIDICKFFVGLDIVDCLLVNKNGRFTGEAFVVFPTAMQTEFALHRNRQNMGRRYVEVFRCKKQEYYSAIANEVSQGGYFESEYRRSSPPPRPPKKTAEDKGSMEYTEVLKLRGLPYSATTEDIIKFFLEYELTEENVHIAIRSDGKATGEAFVEFPTAEVAKTAMCKDKMTIGTRYVELFPSTPEEASRARTRGRH

SEQ ID NO: 5128 - protein, 168 aa, Zea mays
  UNSURE (1)..(168): unsure at all Xaa locations
  Clone ID: PAT_MRT4577_172423C.1.pep
  unsure (1)..(168): unsure at all Xaa locations
MTREEHHXESNAYAAXSKTYPHDAXAARNNGFFGIKNRPCKAAKAPTSNSAXHGHAKCXLLSIDIFHVKKLEHIVPSSLNCDIPPENRTEHQLIVYIXDGVVXLLTSDDNTKDDLMTPPCMYTLVTLIXEGVESGQDLAATVQPAMTDQQICALKDVFPSNFPALEYC

SEQ ID NO: 5129 - protein, 553 aa, Zea mays
  UNSURE (1)..(553): unsure at all Xaa locations
  Clone ID: PAT_MRT4577_172472C.1.pep
  unsure (1)..(553): unsure at all Xaa locations
DSALFNRSLLHRPWYPLSTHCHWLLSWRSLPSPCPCTSQRFQIFGQTKIFSLFHRHPGLDFGGGPSEQAFLLSRTKRPFTPSQWMELEHQALIYKYLNAKAPIPSSLLVSISKSFRSSXEVCMHVLNHKTKKEVLYFKAVMLAPAINKPNEKREKVHILFCTNXKNNQTIIYAIKIDHCIAFLSINVIRXDRLSNAVSWRPLYQGYANADSDPEPGRCRRTDGKKWRCSKEAMPDHKYCERHINRNRHRSRKPVENQPRKATKEVTTAAAGSLPCAGPQGSLKKAKVNDSKPGTGSYWTDSLNRXYHQSHLLVLASYLNNKIPTXLVNPIIRASTMLHFQVLIWNSISMLWFXNVSCHLAFIIIILISTRPYIFXTMLSREKANKPTDDESLLLSSTKNSQPTLSLLTQLKQQNKPDKLGPTPENEPNSDTMLKAWGGSHHKSISSTQRHDAESLQSVLQNFSLAQNDRLESEKNRYSDSVLVSSAFYSADGPQTTCLTPNMTQVQQDCISSSWEMPQGGPLGEILTNSKISEDLSKCGSRSYGWLLNLDHAP

SEQ ID NO: 5130 - protein, 93 aa, Zea mays
  UNSURE (1)..(93): unsure at all Xaa locations
  Clone ID: PAT_MRT4577_172520C.1.pep
  unsure (1)..(93): unsure at all Xaa locations
IEKFKIFISYILWVNLKAIDRLEEAEALKMEIIPNPKEVDGVKVLXLXTASGASIRFFDKAIGINVFCSRFFPLNATFDXLLRWQSDLYTIDY

SEQ ID NO: 5131 - protein, 82 aa, Zea mays
  UNSURE (1)..(82): unsure at all Xaa locations
  Clone ID: PAT_MRT4577_172773C.1.pep
  unsure (1)..(82): unsure at all Xaa locations
GSPGFGFVGGRIEMAASDVEDRCVVGGLAWATDDHSLHDAFSTYGEVLEARIILDRWTHRSRSXSFGSFSTEEALLYVIDGM

SEQ ID NO: 5132 - protein, 461 aa, Zea mays
  Clone ID: PAT_MRT4577_173322C.1.pep
MDVERKVVEADDDGRVRTGTVWTATTHAITAVIGSGVLALPWSVAQMGWVLGPVALVGCAYITYYTAVLLSDCYRTPDPVHGKRNRTYMDVVRSCLGPRDVVVCGLAQYAILWGTMVGYTITTATSIMAVARTDCRHHRGHDAACASSGTVYMVAFGVVEVVLSQFPSLEKLTIISVVAAVMSCTYSFVGLFLSAAKLASNHGARGSLLGVKIAAGVSASTKTWHSLQALGNVAFAYTYSMLLIEIQDTVKAPPSENVTMKRASFYGISVTTIFYVSLGCIGYAAFGNAAPGNVLTGFDEPFWLVDVANIAVVVHLVGAYQVYAQPIFACYEKWLGSRWPDSAFFHHEYAVRLPGCAVRFTMCKLVLRTAFVAATTVVSLMLPFFNAVLGLLGAIAFWPLTVYFPVTMYIAQAKVAPGSRKWVALQALNVGALLVSLLAAVGSVADMVQRLGHVTIFQTQL

SEQ ID NO: 5133 - protein, 765 aa, Zea mays
  Clone ID: PAT_MRT4577_17336C.1.pep
MAVLGTAAVEVLIPVAALVGIAFALLQWYVVARVPVPSHAGEDGGGGGNKNVREEEEHVEEDGMDYLLVEARCAEIQRAISVGATSFLLTEYKYLAVFTAAFAVVIFVFLGSAQRFSARPGPCAYDPSRECRPALANAAFSAVAFLLGAATSVLSGYLGMRVATFANARTALEARHGVGRAFAAAFRSGAAMGFLLASSALLVLYAAVNLFGLYYGDDWGGLYESITGYGLGGSSVALFGRVGGGIYTKAADVGADLVGKVERNIPEDDPRNPAVIADNVGDNVGDIAGMGSDLFGSYAESSCAALFVASISSFGAEHNLTAMMYPLLISAVGLLVCAITTVVATDVTEVKGSDEVGPALKRQILISTVLMTAGIAAVTFLGLPPSFTLFDFGNDKHVKNWHLFICVSAGLWAGLVIGYVTEYFTSNAYGPVRAVARSCRTGAATNVIFGLALGYKSVIVPILAIAAAIYASFPLAAIYGIALAALGMLSTIATGLAIDAYGPISDNAGGIAEMAGMPHRVRERTDALDAAGNTTAAIGKGFAIGSAALVSLALFGAYVSRAGITAVDVLSPRVFVGLLLGAMLPYWFSAMTMRSVGSAALRMVEEVRRQFDTIPGLAEGLAVPDYATCVRISTDASLKKMMAPGALVMFSPLVAGTLFGVETLAGLLAGALVSGVQVAISASNSGGAWDNAKKYIEAGLSEEARSLGPKGSEAHKAAVIGDTIGDPLKDTSGPSLNILIKLMAVESLVFAPFFAAHGGIIFDHL

SEQ ID NO: 5134 - protein, 77 aa, Zea mays
  Clone ID: PAT_MRT4577_173437C.1.pep
GWTNWALSNGKREHFNRREQPRSPFWGPCCPWAPTGGPFPWQAFVTPGGGSLGTFFCPHPPKKWSKAPSPKWRQGCP

SEQ ID NO: 5135 - protein, 66 aa, Zea mays
  Clone ID: PAT_MRT4577_17351C.1.pep
LMERGFNLPDPKEFASSIYKSVPKSLDFSPHPAVEERDEAEEQPEVEKKEPAAKEGLEPSFDKDEL

SEQ ID NO: 5136 - protein, 120 aa, Zea mays
  UNSURE (1)..(120): unsure at all Xaa locations
  Clone ID: PAT_MRT4577_173645C.1.pep
  unsure (1)..(120): unsure at all Xaa locations
MAAKILRLVMLLGLTASXAATATIFPQXXQAPIAFHLHPDLSPAASSEXQNPILXPYMIQQAIAACILPLSPVVLLQSXALLQQLPKEHLLAQNIRAQQLRQPVLAYHADYSQQQQFLPF

SEQ ID NO: 5137 - protein, 519 aa, Zea mays
  Clone ID: PAT_MRT4577_173809C.1.pep
MLGVGMAAAVLLGAVALLLADAAARRAHWWYREAAEAVLVGAVALVVVDAAARRAHGWYREAALGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFLAFGLGARLCPGNDLAKLEISVFLHHFLLGYKLARTNPRCRVRYLPHPRPVDNCLAKITRVGS

SEQ ID NO: 5138 - protein, 92 aa, Zea mays
  Clone ID: PAT_MRT4577_173816C.1.pep
MATPDNTGHRHPLHIFGEWYVYNPATSEGFIVIFNNASYYKKTTTGPEAGNARTGIPPVFRNSGRDGGYRPDFGDGNQYTQPTLKKLAFCGC

SEQ ID NO: 5139 - protein, 49 aa, Zea mays
  UNSURE (1)..(49): unsure at all Xaa locations
  Clone ID: PAT_MRT4577_174037C.1.pep
  unsure (1)..(49): unsure at all Xaa locations
MADYCGGLTVPVVRTCLMAGSGGLIFGYDIGISXGVSEMEDFLNKIFPG

SEQ ID NO: 5140 - protein, 570 aa, Zea mays
  Clone ID: PAT_MRT4577_174085C.1.pep
MDLHQLLKYRLTGANVYYEFPTENNLANTPWPASPLKSEFSSSSYTPLSSQLECDNLSALSNTPDNQSSTETISAQPISPLEVDSSYKQAAILRENTQVRPDPLYTTSRHNMQHALREIETVLMAPDADDAATSTKHEFEEHKPAQLMRQRSRTWSHESRQPSPGVVRTQLASGYPTASYEFRPEKRLRELREDPQSMVKQLLTKCAEALSEERIEEFLNLVQQARGVVSITGEPIQRLGAYLLEGLVARHANSGTNIYRALKCREPESNELLSYMKILYNICPYLKFGYMAANGAIAEALRNEDRIHIIDFQIAQGTQWITLIQALAARPGGPPHVRITGIDDPVSEYARGEGLDLVGKMLKSMSEEFRIPLEFTPLPGIYATQVTKEMLDIRSGEALAVNFTLQLHHTPDESVDVNNPRDGLLRMVKGLSPKVTTLVEQESHTNTTPFLMRFTETLDYYSAMFESIDTNLPRDNKERINVEQHCLAKDIVNIIACEGKDRVERHELLGKWRSRLTMAGFRPYPLSSYVNSVIRKLLACYSDKYTLEEKDGAMLLGWKNRKLISASAWH

SEQ ID NO: 5141 - protein, 539 aa, Zea mays
  Clone ID: PAT_MRT4577_174111C.1.pep
MACLAPQFKWAPSAAAHMPSSSSSSSYSRCSALRVHCAVTSAAVVEDRTNGSAAQLRLAYAAPAIQRNFEATLASEALLNEEAVVAAAAAEAVALARAAAEAAQEVVQIVQRNNHQPVIRPKKCVDNYLANEILRTEMRSSSPDMYANNPLMEYLDSYGIMDAEDELDAYAQYTENIAVKSARQSERKARRTRAAIKASTTLHASQKVALSSKKKRSKGSSSSMNPLGSLWKMTGRRLLTAKEEVEFSEGIQDLLKLEAIQAELIEYNGGQPTFSQWATAAGVDEKTLRKRLNYGIYCKNRMVTSNVRLVISIAREFEGPGMDFYDLIQEGMQGLIRGAEKFDSSKGFRFSTYSHWWIKQAMRKSVSEQSQIFRLPAHMVEASYRVKECTKRLRRKLRRRPTNEEIAVDTGIPIKRVEAAVNLPKYSVSLDSKIGSTDMTYQEVTADPSAETAEEMLNRMSMKKDVHMALDTLTTREKQVVVLRFGLEDGRIRTLQEIGNIMGVSRERIRQIESGAFRKLRSKKKVKALKDYLVPVGNW

SEQ ID NO: 5142 - protein, 345 aa, Zea mays
  UNSURE (1)..(345): unsure at all Xaa locations
  Clone ID: PAT_MRT4577_174278C.1.pep
  unsure (1)..(345): unsure at all Xaa locations
MSAGFQLGVIGSLALSVASSVAIVICNKALISTLGFPFATTLTSWHLMVTFCTLHVAHRLHFFEPKAIDGQTVILFGLLNGTSIGLLNLSLGFNSIGFYQMTKLAIIPFTVLLETIFLNKRFSESIKLSLLVLLLGVGIASITDLKLNMLGSILSGLAIATTCVGQILTNTIQKRLKVSSTQLLYQSAPYQAGILFATGPFVDQLLTDRSVFAHKYSAPVLGFIVLSCLIAVSVNFSTFLVIGTTSPVTYQVLGHLKTCLVLSFGYTLLHDPFTLRNILGILIAIFGMALYSYFSVREGKKKSANDALPVSQMADKEAEPLLATKDNNXHQESKWFISRLLRLFL

SEQ ID NO: 5143 - protein, 75 aa, Zea mays
  Clone ID: PAT_MRT4577_174307C.1.pep
VARVKNGTLKAVRGLRYERGPSLAADAVAAVGPPWLMHKHAIRSRPADVRSVKLGLSLARSLARTTDDAQLANRR

SEQ ID NO: 5144 - protein, 193 aa, Zea mays
  UNSURE (1)..(193): unsure at all Xaa locations
  Clone ID: PAT_MRT4577_17436C.1.pep
  unsure (1)..(193): unsure at all Xaa locations
AHRKHSTVPTLAAKKFCLLMLLGLSARAATATIXPQCSQAPIASIVPPYLSPAASSGCENPHLQPYRIQQAIAVGILPLSPSILQQSSXALLQQLPLLHLLAQNIRAQHLPQLVLANLADYSQHQQQLPFNQLRSLNSDAYVHQQQLPFSQLPAAYPQQFMAFNXQLAAQNSPAYLQQEQLLPFSQLAGVSPA

SEQ ID NO: 5145 - protein, 83 aa, Zea mays
  UNSURE (1)..(83): unsure at all Xaa locations
  Clone ID: PAT_MRT4577_174586C.1.pep
  unsure (1)..(83): unsure at all Xaa locations
LYFRXVIIMDNCEELIPEWLGFVKGLVDSDDLPLNIFRETLQQNKILKVIRKNLVKXKCIEMYFKIPENMDDYAKVYDGFFKN

SEQ ID NO: 5146 - protein, 70 aa, Zea mays
  Clone ID: PAT_MRT4577_174660C.1.pep
SGVARSLAQPNLRTTVATQHDTWCVELPPERVPPTTYASLHCGLIRDECRRCRPPLSGCGSGIIRLTLGC

SEQ ID NO: 5147 - protein, 81 aa, Zea mays
  UNSURE (1)..(81): unsure at all Xaa locations
  Clone ID: PAT_MRT4577_174833C.1.pep
  unsure (1)..(81): unsure at all Xaa locations
MAATVSSFPVVNMERAETEERTTAMEVIRNGCENWGFFELLKHGISHELIDEVERLTEGALADXREAKYQEFAARTLETGG

SEQ ID NO: 5148 - protein, 78 aa, Zea mays
  Clone ID: PAT_MRT4577_174881C.1.pep
ENPSRHRRRKRKDTVPWHKGGLSGNNPTPLILARIHIGTGGTNAHQLAMRERYKVRTHIPADILPCPYFYHWPGQTSR

SEQ ID NO: 5149 - protein, 370 aa, Zea mays
  Clone ID: PAT_MRT4577_174940C.1.pep
MSVLTCVIESMGSSCSRSHSFDEAEAAENAKSADIDRRILQETKAEQHIHKLLLLGAGESGKSTIFKQIKLLFQTGFDEAELRSYTSVIHANVYQTIKILYEGAKELAQVEPDSSKYVLSPDNQEIGEKLSEIGARLEYPSLNKERVQDVRKLWQDPAIQETYSRGSILQVPDCAQYFMENLDKLSEEDYVPTKEDVLHARVRTNGVVETQFSPLGESKRGGEVYRLYDVGGQRNERRKWIHLFEGVNAVIFCAAISEYDQMLFEDETKNRMMETKELFDWVLKQRCFEVPLSVCEWFKDYQPTAPGKQEVEHAYEFVKKKFEELYFQSSKPDRVDRVFKIYRTTALDQKLVKKTFKLIDESMRRSREGT

SEQ ID NO: 5150 - protein, 390 aa, Zea mays
  Clone ID: PAT_MRT4577_174943C.1.pep
MSVLTCVIESMGSSCSRSHSFDEAEAAENAKSADIDRRILQETKAEQHIHKLLLLGAGESGKSTIFKQIKLLFQTGFDEAELRSYTSVIHANVYQTIKILYEGAKELAQVEPDSSKYVLSPDNQEIGEKLSEIGARLEYPSLNKERVQDVRKLWQDPAIQETYSRGSILQVPDCAQYFMENLDKLSEEDYVPTKEDVLHARVRTNGVVETQFSPLGESKRGGEVYRLYDVGGQRNERRKWIHLFEGVNAVIFCAAISEYDQMLFEDETKNRMMETKELFDWVLKQRCFEKTSFMLFLNKFDIFERKIQKVPLSVCEWFKDYQPTAPGKQEVEHAYEFVKKKFEELYFQSSKPDRVDRVFKIYRTTALDQKLVKKTFKLIDESMRRSREGT

SEQ ID NO: 5151 - protein, 88 aa, Zea mays
  UNSURE (1)..(88): unsure at all Xaa locations
  Clone ID: PAT_MRT4577_174972C.1.pep
  unsure (1)..(88): unsure at all Xaa locations
MHNSVPTVAAKIFCFLMLLGLSASAATATIVPQCSQAPIASLLPPYLXSGVLSMXENPFLEXYRIQQGVGAGILPLSSLFLQRPGSLL

SEQ ID NO: 5152 - protein, 94 aa, Zea mays
  Clone ID: PAT_MRT4577_175212C.1.pep
PRVRPRVRPRVWFVGDRIEMGASDVEYRCFVRRLFWATDYHFLHNGFSTYRVVLESNIILDQETHKSRGFRFLTFFTEDAMRNAIVGMNGTELD

SEQ ID NO: 5153 - protein, 103 aa, Zea mays; identical to SEQ ID NO: 3995
  Clone ID: PAT_MRT4577_175238C.1.pep

SEQ ID NO: 5154 - protein, 599 aa, Zea mays
  Clone ID: PAT_MRT4577_175240C.1.pep
MGGEAPEPRRLTRALSIGGGDGGWVPEEMLQLVMGFVEDPRDREAASLVCHRWHRVDALSRKHVTVPFCYAVSPARLLARFPRLESLAVKGKPRAAMYGLIPDDWGAYARPWITELAAPLECLKALHLRRMVVTDDDLAELVRARGHMLQELKLDKCTGFSTHGLRLVARSCRSLRTLFLEECQIDDKGSEWIHDLAVCCPVLTTLNFHMTELEVMPADLKLLAKSCKSLISLKISDCDLSDLIEFFQFATALEEFAGGTFNEQGELSKYVNVKFPSRLCSLGLTYMGTNEMPIMFPFSAILKKLDLQYTFLTTEDHCQLIAKCPNLLVLAVRNVIGDRGLGVVADTCKKLQRLRIERGDDEGGVQEEQGGVSQVGLTAIAVGCRELEYIAAYVSDITNGALESIGTFCKKLYDFRLVLLDREERITDLPLDNGVRALLRGCTKLRRFALYLRPGGLSDAGLGYIGQCSGNIQYMLLGNVGETDDGLISFALGCVNLRKLELRSCCFSERALALAILHMPSLRYVWVQGYKASQTGRDLMLMARPFWNIEFTPPNPKNGGWLMEDGEPCVDSHAQILAYHSLAGKRLDCPQSVVPLYPA

SEQ ID NO: 5155 - protein, 599 aa, Zea mays
  Clone ID: PAT_MRT4577_175243C.1.pep
MGGEAPEPRRLTRALSIGGGGGGWVPDEMLQLVLGFVEDPRDREALSLVCRRWHRVDALSRKHVTVPFCYAVSPARLLARFPRLESLAVKGKPRAAMYGLIPDDWGAYARPWVTELAAPFECLKALHLRRMVVTDDDLAELIRARGHMLQELKLDKCTGFSTDGLRLVARSCSSLRTLFLEECQINDKGSEWIRDLAVNCPVLATLNFHMTELEVMPVDLELLAKSCKSLISLKIGDCDLSDLIGFFQSATSLEEFAGGTFNGQGELTKYGDVKFPSRICSLGLTFMGASEMPIIFPFAAILKKLDLQYTFLTTEDHCQLIAKCPNLLVLAVRNVIGDRGLGVVADTCKKLQRLRIERGDDEGGVQEEQGGVSQVGLTAIAVGCRELEYIAAYVSDITNGALESIGTFCKKLYDFRLVLLDREERITDLPLDNGVRALLRGCTMLRRFALYLRPGGLSDAGLGYIGQCSGNIQYMLLGNVGETDDGLISFALGCVNLRKLELRSCCFSERALALAILSMPSLRYVWVQGYKASQTGRDLMLMARPFWNIEFTPPSSQNAGRLIEDGEPCVDSHAQILAYGSLAGKRLDCPQSVVTLYPA

SEQ ID NO: 5156 - protein, 87 aa, Zea mays
  UNSURE (1)..(87): unsure at all Xaa locations
  Clone ID: PAT_MRT4577_175247C.1.pep
  unsure (1)..(87): unsure at all Xaa locations
GSRIHLQLFLDDGPGALXSSAXDGDDGGSVAGMTDLVIGYVLLRRRLGLLGTSTSTFWPPPQPCCCLVERLSCSVSGGVVVCRPTSR

SEQ ID NO: 5157 - protein, 107 aa, Zea mays
  UNSURE (1)..(107): unsure at all Xaa locations
  Clone ID: PAT_MRT4577_17540C.1.pep
  unsure (1)..(107): unsure at all Xaa locations
RVRIHLTQMTFWFSRHDVGKVIGGYLAQGILQHDPFEVLDQRGVGELLKLATYWGPIARPNLKVGTCGXHCGEPYSEALFAKAGLDYVSRSPFTVPIAMLAATQVLV

SEQ ID NO: 5158 - protein, 129 aa, Zea mays
  UNSURE (1)..(129): unsure at all Xaa locations
  Clone ID: PAT_MRT4577_175419C.1.pep
  unsure (1)..(129): unsure at all Xaa locations
MAAKTSCFLMLLGLSACVATATILQQCSQPPIAYIVHTYLXPAVYSMCETPRVQPYRIQQAIATGILPLSPLLLQQPSDLLQHIPLVHXVAQNIRAQQLRQLVLANLGAYSQQHQFLPFDQLSALNSAA

SEQ ID NO: 5159 - protein, 89 aa, Zea mays
  Clone ID: PAT_MRT4577_175436C.1.pep
KVWLPGPLKTPARFGGAGVLAGVGGGGAVLVLAGHAEGVNYRVLGSHGGADNRVLGPQGRADNRVLGPQGRANHLFPCLLKKSAVFVLA

SEQ ID NO: 5160 - protein, 202 aa, Zea mays
  UNSURE (1)..(202): unsure at all Xaa locations
  Clone ID: PAT_MRT4577_175464C.1.pep
  unsure (1)..(202): unsure at all Xaa locations
MADVDEYRCFIGNLSWSTTDESLKDAFSKFGNLTEAKVVLDKFSGRSRGFGFVTFDEKQAMEDAIEGMNGLDLDGRNITVDKAQPQGPGRDRNGDRDYDRERGSRYERGRDYGGGRAPRGGGGGGGDCFKCGKPGHFARECPSGDGGRGDRYGGRDDRYGGGGGRXGRYGSDRGGDRYSGRSRDGGSYGGGDRYSRDRSGPY

SEQ ID NO: 5161 - protein, 75 aa, Zea mays
  UNSURE (1)..(75): unsure at all Xaa locations
  Clone ID: PAT_MRT4577_175476C.1.pep
  unsure (1)..(75): unsure at all Xaa locations
MAAADVEYXCFAXGLALXTSNEVLENAYVCYCXILDSNVIXTDRETVRSYGFGFVTFYYENYMLDAIENMNGNDL

SEQ ID NO: 5162 - protein, 98 aa, Zea mays
  Clone ID: PAT_MRT4577_175574C.1.pep
ASAVATVAAAAATPTETGVAHRWGPCGQVILFAAVMFTLVQRVHLRWSSLLMPICVFDGKVALCTVVSAVFILGSIKACINQHGLWINGCCYSCKDLF

SEQ ID NO: 5163 - protein, 559 aa, Zea mays
  UNSURE (1)..(559): unsure at all Xaa locations
  Clone ID: PAT_MRT4577_17557C.1.pep
  unsure (1)..(559): unsure at all Xaa locations
MEGITSSSSRSRTKGPADEMWDVQSTTSEVTFKTADKEEATSADGATNSASQTPKNEIRHERKVHKSLWAYVADIIRLGFIQHGDSHDSSHKSVKKSSSNNSQSTEGWLSSQERDNDGTKKKNGSTNTLGGGEQESGVASMSNEEYLHTDTHGLQISETVVEPQVGRSEGDLLPTSSTDDLHISGGRTKQSDAGELRKGNSIDDSTPTYLDITIGHLPERKTASRITTEGSGEFITGKGMLAGTSSVTISAMEAGRSEDGADSIYDPSGAITPYHDSQTQTVMPHENTSTGILGPPALPVGVSTRFEEKNIMQEAPEIIKTGGKDTELKRRNFQRNKQVLKDTFDEWEEAYQRDAEQRKADELFMREALLEAQRAADIWEVPVGAVLVQNGEIIARGCNLVEDHRDSTAHAEIVCIREASNKLKTWRLADTTLYVTLEPCAMCAGAILQARIDTVVWGAPNKLLGADGSWVRLFPGDGQTSTLXNKPEPXAGPVHPFHPKIAIRRGVLSAECSEIMQQFFQLRRKKKPQSPPQAHRHGHHHPVKFFSKMHHMFGTIFCL

SEQ ID NO: 5164 - protein, 217 aa, Zea mays
  UNSURE (1)..(217): unsure at all Xaa locations
  Clone ID: PAT_MRT4577_175664C.1.pep
  unsure (1)..(217): unsure at all Xaa locations
MSSAAPLLGGEAGGGEXRRGRRRRXSSWVGRVVDAAEARAQLGFAVPMVLTSMAYYGIPLVSVMFSGQLGDVHLAGATLGNSWATVTGYAFVTGLSGALETLCGQAYGAGLHRMLGLYLQSSLIMSAAASALVSALWWFTEPVLLLLRQEPEASRAAAAFVRAQAPGLFAFSFVQCLLRYLQTQSVVLPLVACSVAPFALHVALAHLMVNVLGLGLT

SEQ ID NO: 5165 - protein, 377 aa, Zea mays
  Clone ID: PAT_MRT4577_176181C.1.pep
MAQDEAVATQKTGNTTSPSKDYPTPSPYPDWSTMQAYYGPGVLPPTYFTPAIAPGHPPPYMWGPQPIMPPPFGTPYAAVYPHGGAYPHPLVPMMSTPMSVEPAKSANSKEKNSNKKLKEIDRTAVSAGSGNSKRTVSSIEDYSAEGSSDVNDQNVNETSRKRSSDGGPGAETTTGGNTECVLAPNHTLGNATILPQHCFSAPVIKPSATNVANSRAIGTALSPPPGVMVPVHNAVPSDLSVKDERELKREKRKQSNRESARRSRLRKQAETEELATQVESLAAENTSLRSEIGRLTESSEKLRLENSALMVKLKDTAEPSPSKAAASPSSPRASAENFLSMIDSANAPSVSRHTEHGGPRLRQLLDSSPATDVAAVS

SEQ ID NO: 5166 - protein, 388 aa, Zea mays
  UNSURE (1)..(388): unsure at all Xaa locations
  Clone ID: PAT_MRT4577_176183C.1.pep
  unsure (1)..(388): unsure at all Xaa locations
SELLLRWWTWRRNHHRETATQKTGNTTSPSKDYPTPSPYPDWSTMQAYYGPGVLPPTYFTPAIAPGHPPPYMWGPQPIMPXXFGTPYAAVYPHGGAYPXXXVPMMSTSMSVEPAKSANSKEXXSNKKLKEIDRTAVSAGSGNSKRTVSSIEDYSAEASSDVNDQNVNETSRKRSSDGGPGAETTTGGNTECVLAPNHTLGNATILPQHCFSAPVIKPSATNVANSRAIGTALSPPPGVMVPVHNAVPSDLSVKDERELKREKRKQSNRESARRSRLRKQAETEELATQVESLAAENTSLRSEIGRLTESSEKLRLENSALMVKLKDTAEPSPSKAXXXXXXXXASAENFLSMIDSANAPSVSRHTEHGGPRLRQLLDSSSATDVAAVS

SEQ ID NO: 5167 - protein, 377 aa, Zea mays
  Clone ID: PAT_MRT4577_176184C.1.pep
MAQDEAVATQKTGNTTSPSKDYPTPSPYPDWSTMQAYYGPGVLPPTYFTPAIAPGHPPPYMWGPQPIMPPPFGTPYAAVYPHGGAYPHPLVPMMSTPMSVEPAKSTNSKEKNSNKKLKEIDRTAVSAGSGNSKRTVSSIEDYSAEASSDVNDQNVNETSRKRSSDGGPGAETTTGGNTECVLAPNHTLGNATILPQHCFSAPVIKPSATNVANSRAIGTALSPPPGVMVPVHNAVPSDLSVKDERELKREKRKQSNRESARRSRLRKQAETEELATQVESLAAENTSLRSEIGRLTESSEKLRLENSALMVKLKDTAEPSPSKAAASPSSPRASAENFLSMIDSANAPSVSRHTEHGGPRLRQLLDSSPATDVAAVS

SEQ ID NO: 5168 - protein, 162 aa, Zea mays
  UNSURE (1)..(162): unsure at all Xaa locations
  Clone ID: PAT_MRT4577_176191C.1.pep
  unsure (1)..(162): unsure at all Xaa locations
MAMQDSEEHHFKSKAAAGYSKTYPXQVGSXRKNGFIDYKNRPCTVGEVLTXKTANNAHAKCHFVAIDIFNGQKARRYVTLRKQXDIPYGNRTENQVIVIXEDGFVTLFTXDGDTKDDLRLPTDETLVAQIKEGSETRKDLAGTDQHAMGEEQIXALKDVDPQ

SEQ ID NO: 5169 - protein, 109 aa, Zea mays
  Clone ID: PAT_MRT4577_1762C.1.pep
MSGSGGGVWVFNKKKGVMQLEQPAPASRKALVYVPTDEVVRSVEALERRLGALGWERYYENRSVVQLHRRGGGADLITIPRDFAGLRSTHMYDVVVKNRHHFKVVDRDA

SEQ ID NO: 5170 - protein, 80 aa, Zea mays
  Clone ID: PAT_MRT4577_176389C.1.pep
PWSLNSSAYLQLQQLLLFKQLAGASPTAFFTQPQLLSFYQHAAPNAGTLLQLQQLLTFNQLALSNPAAFYQQPIIGGALF

SEQ ID NO: 5171 - protein, 63 aa, Zea mays
  UNSURE (1)..(63): unsure at all Xaa locations
  Clone ID: PAT_MRT4577_176479C.1.pep
  unsure (1)..(63): unsure at all Xaa locations
MASIVASRRAFPLVRALDKLIAASSAPGTVSALIPFADARGLQVYNTCPSLQLYXGAESEDDS

SEQ ID NO: 5172 - protein, 78 aa, Zea mays
  Clone ID: PAT_MRT4577_176683C.1.pep
KGKLIAQKWRFEKWPHGLYSSVRLMLDKPQFGVPVIKLKQIGVPKKNKYGNSTVVENPEKGWRDFIFHGKRGMFGFGI

SEQ ID NO: 5173 - protein, 108 aa, Zea mays
  UNSURE (1)..(108): unsure at all Xaa locations
  Clone ID: PAT_MRT4577_176748C.1.pep
  unsure (1)..(108): unsure at all Xaa locations
PARPTRTGWLLLPLRVGFGFVRLSGLGCVHDRIEMAASDVEYRXFVGGLTWATDDHXLHNAFSNYGEVLESKIILDPETHKSADYXYVTFSTEEAMRNAIDGMNCKEL

SEQ ID NO: 5174 - protein, 84 aa, Zea mays
  Clone ID: PAT_MRT4577_176784C.1.pep
VAAEQRAWRKQAFKYWPYRVLFAPAVPSVKIVEHKQQTLLIFFSLSFLFFSFLWLPLSVVKTHAPVSPICKASKGSVTFSCPTE

SEQ ID NO: 5175 - protein, 95 aa, Zea mays
  Clone ID: PAT_MRT4577_176815C.1.pep
MRRRVRRVIGVEDRRVADYIPSPWHAVQLLVLSGAGSVNIYDANAGVLRTLAGTRWAVSIMVPDQITPDLAAYSAAADRWVADNLVPYYPGTRVK

SEQ ID NO: 5176 - protein, 234 aa, Zea mays
  UNSURE (1)..(234): unsure at all Xaa locations
  Clone ID: PAT_MRT4577_176859C.1.pep
  unsure (1)..(234): unsure at all Xaa locations
MTAPAELSREENVYMAKLAEQAERYEEMVEFMEKVAKTVDSEELTVEERNLLSVAYKNVIGARRAPWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLAXNFSVFYYEILNSPDRACNLAKQAFDEXIXSELDTLSEKIYQDSTLIMQLLHD

SEQ ID NO: 5177 - protein, 446 aa, Zea mays
  Clone ID: PAT_MRT4577_177068C.1.pep
MAGSSMDTEAAGKELKQGSGGGGGYTMPATAHAVDTDSWQQVGLLLVIGFNCAYVLSFSNLMMVPLGWAWGVACLLLVGAAAWYANWLLAGLHFVDGQRFIRYRDLMGFIFGRNMYYITWFLQFATLLLCNMGFILLGARALKAINTEFTHTPARLQWFITATGIVYFAFAYFVPTISAMRNWLATSAALTLAYDVALLAILIRDGKSNKQKDYDVHAGSQAEKVFNALGAVAAILVCNTSGLLPEIQSTVREPAVRGMRRALLLQYTAGAAGYYGISVAGYWAYGSAVSEYLPNELGGPRWAAVLINATAFLQSIVSQHLFTVPIHEAMDTRLQRLDEGMFSRYNLTRRVCARGLVFGFNVFVTALFPFMGDFVNLVGSLALVPLTFTFPSMAVLKIKGKSGGRCNRLWHWGIIVLSSALCVATTAAAVRLIFNNARIYHFFADM

SEQ ID NO: 5178 - protein, 78 aa, Zea mays
  Clone ID: PAT_MRT4577_17713C.1.pep
MAASDVEYRCFVVGLTWATDDHSLHNAFSTYREVLESKIILDRETQKSRGFCFVTFSTEEAMRNAIDGMNGKELDGRN

SEQ ID NO: 5179 - protein, 64 aa, Zea mays
  UNSURE (1)..(64): unsure at all Xaa locations
  Clone ID: PAT_MRT4577_177407C.1.pep
  unsure (1)..(64): unsure at all Xaa locations
MAAKSXSYXMLIGLSSSAATATIFPQCSQAPITSLLPPNLSPAMSSVCXNPILQPYRIQLAITT

SEQ ID NO: 5180 - protein, 181 aa, Zea mays
  UNSURE (1)..(181): unsure at all Xaa locations
  Clone ID: PAT_MRT4577_17745C.1.pep
  unsure (1)..(181): unsure at all Xaa locations
MVRGKTQMKRIENPTSRQVTFSKRRNGLLKKAFELSVLCDAEVALVVFSPRGKLYEFASGSAQKTIERYRTYTKDNVSNKTVQQDIERVKADADGLSKRLEALEAYKRKLLGERLEDCSIEELHSLEVKLEKSLHCIRGRKTELLEEQVRKLKQKCKKQPPXVPMASAPPRAPAVDKRRTV

SEQ ID NO: 5181 - protein, 232 aa, Zea mays
  Clone ID: PAT_MRT4577_17749C.1.pep
MVRGKTQMKRIENPTSRQVTFSKRRNGLLKKAFELSVLCDAEVALVVFSPRGKLYEFASGSAQKTIERYRTYTKDNVSNKTVQQDIERVKADADGLSKRLEALEAYKRKLLGERLEDCSIEELHSLEVKLEKSLHCIRGRKTELLEEQVRKLKQKEMSLRKSNEDLREKCKKQPPVPMASAPPRAPAVDNVEDGHREPKDDGMDVETELYIGLPGRDYRSSKDKAAVAVRSG

SEQ ID NO: 5182 - protein, 376 aa, Zea mays
  Clone ID: PAT_MRT4577_17753C.1.pep
MKIQCDACEGAAATVVCCADEAALCARCDVEIHAANKLASKHQRLPLEALSASLPRCDVCVRVPMLIFLGGCWPACLHWKPRPTLGRSRPKGPCHWLSPPGRRAAAGRLEAPFPTGGMRIQCDACEAAAATVVCCADEAALCARCDVEIHAANKLASKHQRLPLGDAAALPASLPRCDVCQERPAFIFCVEDRALLCRDCDEPIHVPGTLSGNHQRYLATGIRVGFSSVCGASAEGLPPAPPKGSSKPAAVVSAPAAGTTTKTRTVKDALPQEVPSSPFLPPSGWAVEDLLELSDYESSDKKDSSLGLKELEWFEDIDLFHAHSPAKTAMAEFFASPQPVSNAGFYKANGARLFKKSRMEVPDDDDEDYFIVPDLG

SEQ ID NO: 5183 - protein, 267 aa, Zea mays
  Clone ID: PAT_MRT4577_17758C.1.pep
MRIQCDACEAAAATVVCCADEAALCARCDVEIHAANKLASKHQRLPLALGDATAASASSLPRCDVCQEKPAFIFCVEDRALFCRDCDEPIHVPGTLSGNHQRYLATGIRVGFSSVCGAGAGAEGLPPPAPPKGSSKPAAVVSAPAAGATKTTTTVKDTLPQEVPSSPFLPPSGWAVEDLLQLSDYESSDKKDSPLGFKELEWFADIDLFHAHSPAKTTTAEVPELFASPQPASNAGFYKTNGARQSKKPRMEVPEDDEDYFIVPDLG

SEQ ID NO: 5184 - protein, 301 aa, Zea mays
  Clone ID: PAT_MRT4577_177639C.1.pep
MGGFVKTQKTNAYFKRFQVKFKRRRAGKTDYRARIRLINQDKNKYNTPKYRFVVRFTNKDIIAQIVSASITGDIILAAAYSRELPRYGLEVGLTNYAAAYCTGLLLARRVLKIRDLDQEYEGNVEATGEDFSVEPAEERRPFRALLDVGLIRTTTGNRVFGALKGALDGGLDIPHSDKRFAGFKKDDKQLDADIHRKYIYGLHVAEYMKNLADEEPEKYQAHFSEYIKKGIEADDMEALYKKVHAAIRADPSMAKSTKAQPKEHKRHNPKKLTYEQRKARLVERLNALNSSGGVDDDEDDE

SEQ ID NO: 5185 - protein, 223 aa, Zea mays
  Clone ID: PAT_MRT4577_177749C.1.pep
LEKPSFSLLGIMLVVSFGVLLTVAKETEFNLWGFIFIMLAAVMSGFRWSMTQILLQKEEYGLKNPFTLMSHVTPVMAIVTAIISIVMDPWHDFRASHFFDSSAHIIRSSLLLLLGGALAFFMVLTEYVLVSVTSAVTVTVAGIVKEAVTILVAVLFFNDPFTWLKALGLAIIIFGVSLFNIYKYKRFKKGHYNENAGTNTQSSNWTSKYVILDEDTEAQDDTG

SEQ ID NO: 5186 - protein, 470 aa, Zea mays
  UNSURE (1)..(470): unsure at all Xaa locations
  Clone ID: PAT_MRT4577_177750C.1.pep
  unsure (1)..(470): unsure at all Xaa locations
MGDCVVEDGHGHHYSEAVEGAVSLTVAVGLDERAEESREEEEGGGQRKKMGGIPREPSFSRWCRDPSAASASNTAAAAATSDSDASEEFELPLLPSSSGGGGSPMDIEVGATARSDDLPISPRLLAKVIGLIACWYTLSTCLTLYNKEMLGKHMWKFPAPFLMNTVHFTMQAVASRAIVWFQQRGLEGGPSKMSWKDYCLRVVPTALATALDINLSNISLVFITVTFATMXQICFSNFHSSVCFHVQAXKPSFSLLGIMLVVSFGVLLTVAKETEFNLWGFMFIMLAAVMAGFRWSMTQILLQKEEYALKNPFTLMSHVAPVMAIVTAIISIVMDPWHDFRASHFFDSSTHIIRSSVLLLLGGALAFFMVLTEYVLVSVTSAVTVTVAGIVKEAVTILVAVLFFNDPFTWLKALGLAIIIFGVSLFNIYKYKRFKKGHHSEDAGTNIQSYNGTSKYVILDDDTEDQDDSG

SEQ ID NO: 5187 - protein, 141 aa, Zea mays
  Clone ID: PAT_MRT4577_177789C.1.pep
GVPSSPVVRHALLLSLLCAGALGFLLCCHGAAVAPAYVTVSAASFAPSSTCSASDPVAPQQNDTFTVLRLTHRHGPCAPLRASSLAAPSVADTLRADQRRAEHILRRVSVFFSPQLWDYKAAAVTVPANCGYDIGTSNYVE

SEQ ID NO: 5188 - protein, 249 aa, Zea mays
  Clone ID: PAT_MRT4577_177993C.1.pep
MGALLLFAVCLLAPIVLACAVRGRKRRAAAPAPAPACGKKALPLPPGSMGWPYVGETLQLYSSKNPNVFFARKQNRYGPIFRTHILGCPCVMVSSPEAARFVLVTQAHLFKPTFPASKERMLGPQAIFFQQGDYHARLRRLVSRAFSPQAIRASVPAVEAVALRSLRSWDGRLVNTFQEMKLYALNVALLSIFGEEEMRYIEELKQCYLTLEKGYNSMPVNLPGTLFHKAMKARKRLSAIVAHIIEARR

SEQ ID NO: 5189 - protein, 470 aa, Zea mays
  Clone ID: PAT_MRT4577_177997C.1.pep
MGAFLLFVCLLAPVVVLACAVRGRKRRASSAAAGGKALPLPPGSMGWPYVGETFQLYSSKNPNVFFARKQNRYGPIFKTHILGCPCVMVSSPEAARFVLVTQAHLFKPTFPASKERMLGPQAIFFQQGDYHAHLRRLVSRAFSPEAIRGSVPAIEAIALRSLESWDGRLVNTFQEMKLYALNVALLSIFGEEEMRYIEELKQCYLTLEKGYNSMPVNLPGTLFHKAMKARKRLGAVVAHIIEARREGERQRGSDLLASFLDDREALTDAQIADNVIGVIFAARDTTASVLTWMVKFLGDHPAVLKAVIEEQQEIARSKGSSGEPLTWADTRRMRTTSRVIQETMRVASILSFTFREAVEDVEYQGYLIPKGWKVMPLFRNIHHSPDHFPCPEKFDPSRFEVAPKPNTFLPFGNGTHSCPGNELAKLEMLVLFHHLATKYRWSTSKSESGVQFGPFALPLNGLPMTFVRKD

SEQ ID NO: 5190 - protein, 759 aa, Zea mays
  UNSURE (1)..(759): unsure at all Xaa locations
  Clone ID: PAT_MRT4577_178070C.1.pep
  unsure (1)..(759): unsure at all Xaa locations
MMPVPSFNQCLLNYEMALQYVNRALYLLQFSCGLSHPNSAATYINVAMMEEGMGNVHVALRYLHEALKCNKRLLGADHIQTAASYHAIAIALSMMDAYSLSVQHEQTTMQILQEKLGEDDLRTQDAAAWLEYFESKALEQQEAARRGTPKPDSSIGSKGHLRYETXSSEHFQXNIFKFRLKHLPXKVSDLLDFISSVQECRERREKSKGQQGTEGYRGIHGQLKTAKETPAVDXPYLAYFLSCLIATLSVEVXVFEDLQYFERWTFAIXLPLLRGLVAEIFPIQVNCEQRAXVKLYKRFPEXTLFVIKETDVFRSSCSAGYNVPLYVXSQDQKEDSVTAPSQISFGSFLKTDKLNGDSSIAEDKTCNGSANQEQRTKPTGINRPTSIASKFISYKDVAVSPPGTVLKPILEKKEAKEKGSGHDIYLTLSSEEEDPQFTENEKEKPSEDSSKEVLSSQQDLESHVETPDSNSDENPSAPKKASGSKLSASAPPFNPGSLLSMSHPYSTVAIYDASAVIQAVPNQAMEILPHAIDTRVPRGPRSTLYYRTGHSFQRKQGYTHSQSTIVRGSYSPTTMNPHAAEFVPGKTSQQSDVADREPSPANHVANSDLDVVSQTTDEVKAETPATEKAGQVEKVVSGKGKENRGKDIVRNSYKTELARQILLSFIVKSVHDSLGPSRAEPERKPSGSDEASNEQTSVLGKNASGRKDSDKQEKATEVPKGLKDTEGFTVVSKRRRRPQPFMNPINGLYSQPSICTSVS

SEQ ID NO: 5191 - protein, 51 aa, Zea mays
  Clone ID: PAT_MRT4577_178107C.1.pep
SWTKGCADALFYPEGQRKLNLFFLFKFNAGLTGKGKVLLAGRRVKPGAHSG

SEQ ID NO: 5192 - protein, 305 aa, Zea mays
  UNSURE (1)..(305): unsure at all Xaa locations
  Clone ID: PAT_MRT4577_178188C.1.pep
  unsure (1)..(305): unsure at all Xaa locations
MKRQSKRPTASRESPETGEKQKLAFAEEEAPPARKVEPDDEAEMDEDEDELGPGLGGGRAARSPCGLGEKKRRLALEQVRALERCFETDNKLDPDRKARIARDLALQPRQVAVWFQNRRARWKTKTLERDKDALAAEIRELRQKLLPKPEATVKLEATTGNXHGGGAPPGDGRRAARGGLXDGSSDSDSSVVFSDVEASPYSGGAAFEPPALAGLGAPFLDTSVAPTGCSSPPVFVETKWQQHGPTQYPFPFDSYKACAGYGFTEEWLASSDLIGSDGGAAGFFSEDHASSLNFNWCPSGIQGWE

SEQ ID NO: 5193 - protein, 326 aa, Zea mays
  UNSURE (1)..(326): unsure at all Xaa locations
  Clone ID: PAT_MRT4577_178190C.1.pep
  unsure (1)..(326): unsure at all Xaa locations
MKRQSKRPTASRESPETGEKQKLAFAEEEAPPARKVEPDDEAEMDEDEDELGPGLGGGRAARSPCGLGEKKRRLALEQVRALERCFETDNKLDPDRKARIARDLALQPRQVAVWFQNRRARWKTKTLERDFAALRARHDALRADCDALRRDKDALAAEIRELRQKLLPKPEATVKLEATTGNXHGGGAPPGDGRRAARGGLXDGSSDSDSSVVFSDVEASPYSGGAAFEPPALAGLGAPFLDTSVAPTGCSSPPVFVETKWQQHGPTQYPFPFDSYKACAGYGFTEEWLASSDLIGSDGGAAGFFSEDHASSLNFNWCPSGIQGWE

SEQ ID NO: 5194 - protein, 202 aa, Zea mays
  Clone ID: PAT_MRT4577_178214C.1.pep
QASSVIHLKAPVKIFGDLHGQFGDLMRLFDEYGAPSTAGDIAYIDYLFLGDYVDRGQHSLETITLLLALKVERPRGVNLIRGNHEAADINALFGFRIECIERMGERDGIWTWHRMNRLFNWLPLAALIEKKIICMHGGIGRSINHVEQIENLQRPITMEAGSVVLMDLLWSDPTENDSVEGLRPNARGPGLVTFGPDRVMEF

SEQ ID NO: 5195 - protein, 298 aa, Zea mays
  Clone ID: PAT_MRT4577_178226C.1.pep
MVEEGATAAASRSGPAPFLSKTHQMVEEPGTDEVISWAEQGRSFVVWKPVELARDLLPLHFKHCNFSSFVRQLNTYGFRKVVPDRWEFANENFRRGEQGLLSGIRRRKSTTPQPSKYGGGSVVNTAFPPPLPFPPPASVTTSGGGGGAGAGNERSSSSASSPPRTDDLTSENEQLKKDNRTLSTELAQARRHCEELLGFLSRFLDVRQLDLGLLMQEDVRAGAGDDAAPRRAMVSQLERGGEEGKSVKLFGVLLKDAARKRARCEEAAASERPIKMIRIGEPWIGVPSSGPGRCGGGN

SEQ ID NO: 5196 - protein, 82 aa, Zea mays
  Clone ID: PAT_MRT4577_178395C.1.pep
MELHVVLFLCPVPTFIRIWKKGSKEQYSPIQYVGTLLNCMMWVLYGLTAVHPHRMLVITINGAGMPMQMTYVAHILLYSEVA

SEQ ID NO: 5197 - protein, 37 aa, Zea mays
  Clone ID: PAT_MRT4577_17855C.1.pep
AGMITEFVISFDDRYLYFVNWLHGDIKQYNIEDPAKP

SEQ ID NO: 5198 - protein, 232 aa, Zea mays
  UNSURE (1)..(232): unsure at all Xaa locations
  Clone ID: PAT_MRT4577_178582C.1.pep
  unsure (1)..(232): unsure at all Xaa locations
QADFGRLEIELAEVEMPGLMACRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKNGTIPDPNSTDNAEFQLVLTIIKESLKTDPLKYTKMKERLVGVSEETTTGVKRLYQMQANGTLLFLLLMVMIWYPRASSTTCXDAALTGRWLM

SEQ ID NO: 5199 - protein, 90 aa, Zea mays
  UNSURE (1)..(90): unsure at all Xaa locations
  Clone ID: PAT_MRT4577_178635C.1.pep
  unsure (1)..(90): unsure at all Xaa locations
LFLKHNVPTLPVKIFCLLMLLGISASAATATIFPQCSQAPIASLLSPYLLPAVFSLCXNPILXPYMIXCHIVIGILPLSPLFLQQSLSLL

SEQ ID NO: 5200 - protein, 470 aa, Zea mays
  UNSURE (1)..(470): unsure at all Xaa locations
  Clone ID: PAT_MRT4577_178810C.1.pep
  unsure (1)..(470): unsure at all Xaa locations
MASRNHNAAAPQLHHHNRAGVPALGKTKAVPARADALNRRPPLGDIGNLVSVRPATGNXRSRSIXPITRSFGAQLVKKAQAKAAIKNAAILPARHAPRQERKAPVKQQPPPEDIIVLSSDSEQSRAQSESSASSVRSRRKAINTLSSVLSARSKAACGIAGKPRQVVDDIDKLDVNNELAVVEYIEDIYTFYKIAQHERRPCDYIDAQLEINSKMRAILADWIIEVHHKFELMPETLYLTMYIIDQYLSLQPVLRKELQLVGVSSMLIACKYEEIWAPEVNDFILISDSAYSREQILSMEKGILNRLEWNLTVPTVYMFLVRFLKAXATLGGKVEKEMENMVFFFAELALMQYXLVTRLPSLVAASAVYAARLTLKRXAPLWTDTLKHHTGFRXQRPELIECTXRCWXAHSTAPESKLRVVYKKYSSEQFGGVALRPPAEXLQVNEGYFIRVCLLLALGEVAMEGESDIR

SEQ ID NO: 5201 - protein, 84 aa, Zea mays
  Clone ID: PAT_MRT4577_178846C.1.pep
MGAGSSCSQAQIVTAVAVLAAVLLLLAAGVETAFAAVSSGEVTSSVAPCLGYAMDIAETPSAACCTEERSLNSRASSTADRQAT

SEQ ID NO: 5202 - protein, 119 aa, Zea mays
  UNSURE (1)..(119): unsure at all Xaa locations
  Clone ID: PAT_MRT4577_179029C.1.pep
  unsure (1)..(119): unsure at all Xaa locations
KHNSVSFLAAKIFCLLMLLGISASAATVTIFPQCLQASIDSFLAAYLSPAESLVCENXIFNRYRMQQAXIAACMLPLSPLFLXQQPSALXQELPLRHLLAHIIRAQQLQQLVLGDLAGY

SEQ ID NO: 5203 - protein, 50 aa, Zea mays
  Clone ID: PAT_MRT4577_179182C.1.pep
RWHALTTATIADIQATCFGIPNNVLRNNPSLAVPSYRLLMRYSSIMKFIG

SEQ ID NO: 5204 - protein, 112 aa, Zea mays
  Clone ID: PAT_MRT4577_179244C.1.pep
HASVGFSSHSVSGSGSRGSAVYHFKGERIEMATSDVEYRCFISGLSWATDDHSLHNSFSTYGEVLESKIILNRETHRYHSLCYVTFSTEEAMLNAIKGMNCKELDGRNITVN

SEQ ID NO: 5205 - protein, 80 aa, Zea mays
  Clone ID: PAT_MRT4577_179465C.1.pep
PHVSPIAFLAHLQLFPFYLRAMPSAGTLFQLHQLLPFIQLALSNPAVFYQQPIIGGASFRLLMSYSSIMKFFGCVCGFPE

SEQ ID NO: 5206 - protein, 319 aa, Zea mays
  Clone ID: PAT_MRT4577_179630C.1.pep
MAIKRTKAEKKIAYDKKLCSLLDEYTKVLIALADNVGSKQLQDIRRGLRGDSVVLMGKNTLIRRCIKVYAEKTGNHTFDPLMDLLVGNVGLIFTKGDLKEVREEVAKYKVGAPARVGLVAPVDVVVPPGNTGLDPSQTSFFQVLNIPTKINKGTVEIITPVELIKKGEKVGSSESALLAKLGIRPFSYGLQVTSVYEDGSVFSPEVLDLSEEDLIEKFATGVSMVASLSLALSYPTLAAVPHMFINGYKNVLAVAVETDYSYPHADKIKEYLKDPSKFAVAAPVAAADSSAAAAPKEEEKAPEPAEESDEEMGFSLFDD

SEQ ID NO: 5207 - protein, 319 aa, Zea mays
  Clone ID: PAT_MRT4577_179632C.1.pep
MAIKRTKAEKKIAYDKKLCSLLDEYTKVLIALADNVGSKQLQDIRRGLRGDSVVLMGKNTLIRRCIKVYAEKTGNHTFDPLMDLLVGNVGLIFTKGDLKEVREEVAKYKVGAPARVGLVAPVDVVVPPGNTGLDPSQTSFFQVLNIPTKINKGTVEIITPVELIKKGEKVGSSESALLAKLGIRPFSYGLQVTSVYEDGSVFSPEVLDLSEEDLIEKFATGVSMVASLSLAISYPTLAAVPHMFINGYKNVLAVAVETDYSYPHADKIKEYLKDPSKFAVAAPVAAGDSGAAAAPKEEEKAAEPEEESDEEMGFSLFDD

SEQ ID NO: 5208 - protein, 274 aa, Zea mays
  UNSURE (1)..(274): unsure at all Xaa locations
  Clone ID: PAT_MRT4577_180097C.1.pep
  unsure (1)..(274): unsure at all Xaa locations
LTEMWGFASNAWAAGLEKRSSPNRTSSSAAYSDDEASSCTSREEGLECPICWESFNIVENVPYALWCGHTMCKNCILGLQWAVIKVPTVPIQLPFFICCPWCNLLSPRVLYXRGNLTFPRKNYFLLWMVEGMNGERARSRPAIRSEQHTPWLSSSSSVGNGNAGCSNPTRXATSRHHRXTSPTNANHANHGGSPLLNAGRVQASLRKSLSFLVHLTAKFPLVFVFLLIVLYAIPASAAVLLLYILITVLFALPSFLILYFAYPSLDWLVREIFA

SEQ ID NO: 5209 - protein, 86 aa, Zea mays
  UNSURE (1)..(86): unsure at all Xaa locations
  Clone ID: PAT_MRT4577_180119C.1.pep
  unsure (1)..(86): unsure at all Xaa locations
KCENDGAMQXRSIRCGLAPHRNFIRHQAPDCKVRVQGGGTPFCLVNFCEAAYAHQRIHSFSVAKKTDFAFWYTLVLQGCGNLSFRY

SEQ ID NO: 5210 - protein, 509 aa, Zea mays
  Clone ID: PAT_MRT4577_180122C.1.pep
MAAGGELAWGEEPVARRRPKTKIVCTLGPASRSVEMISRLLRAGMCVARFNFSHGSHEYHQETLDNLHAAMELTGILCAVMLDTKGPEIRTGFLKDGKPIQLIKGQEITISTDYSIQGDEKMISMSYKKLAVDLKPGSVILCADGTITLTVLHCDKEQGLVRCRCENTFKLGERKNVNLPGVIVDLPTLTDKDKEDILKWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGTDCVMLSGETAAGAYPELAVQTMAKICLQAESCVDHAAIFKSIMASAPIPMSPLESLASSAVRTANSARAALILVLTRGGTTARLVAKYRPSMPILSVVVPELKTDSFDWACSDEGPARHSLIVRGVIPMLSAATAKAFDNEATDEAIGFAIENAKTMGLCNTGQSVVALHRIGISSVIKLLTVK

SEQ ID NO: 5211 - protein, 127 aa, Zea mays
  UNSURE (1)..(127): unsure at all Xaa locations
  Clone ID: PAT_MRT4577_180243C.1.pep
  unsure (1)..(127): unsure at all Xaa locations
CSTKYWSRLMLLGLSAGAATATIXRECSQASMASILPPYLXPAVSSVCENPILQPYRIQQAIXTGILPLSPLYLQQSSALLHQLPLEHXIXQNIMAQQLQQLVLENLAAYSQQQQFLPFNQLAALNS

SEQ ID NO: 5212 - protein, 161 aa, Zea mays
  Clone ID: PAT_MRT4577_180294C.1.pep
MKGAKSKGAAKADAKLAVKSKGAEKPAAKGKKGKAGKDPNKPKRAPSAFFVFMGEFREEFKQKNPKNKSVAAVGKAAGERWKSLSESEKAPYVAKANKLKGEYNKAIAAYNKGESAAAAAPKKAAAKEVEEEDEEESDKSKSEINDDDDDEGSDEDEDDDE

SEQ ID NO: 5213 - protein, 51 aa, Zea mays
  UNSURE (1)..(51): unsure at all Xaa locations
  Clone ID: PAT_MRT4577_180318C.1.pep
  unsure (1)..(51): unsure at all Xaa locations
MESKGGXKMXTITRRIMYEASLGYSIEDVRPAGGVKNFQSVGYSNCARKPS

SEQ ID NO: 5214 - protein, 461 aa, Zea mays
  UNSURE (1)..(461): unsure at all Xaa locations
  Clone ID: PAT_MRT4577_180468C.1.pep
  unsure (1)..(461): unsure at all Xaa locations
MPTRNHNAAAAAAPQHHHHNRGGAPALGKSKAVPGRADPMNRRAPLGDIGNLVSVRPAEXGSLSCRSRSIXPITRSFGAQLVKNVQANAAIKNAAILPARHAPRQERKAPAKQPPPEDVIVLSSDSEQSRTQLESSASSVRSRKKVINTLSSVLSARSKAACGITDKRRQVVVIEDIDKLDVNNELAVVEYIEDIYTFYKIAQHDRRPCDYIDTQVEINPKMRAILAGWIIEVHHKFELMPETLYLTMYIIDQYLSLQPVLRRELQLVGVSAMLIACKYEEIWAPEVNDFILISDSAYSREQILSMEKGILNSLEWNLTVPTVYMFLVRFLKAAALGNKVEKEMENMVFFFAELALMQYGLVTRLPSLVAASVVYAARLTLKRAPLWTDTLKHHTGFRESETELIECTKXCWSAHTRRPXADSKLRSVYKKYSSEQFGGVALRPPAAAVEMKXTKITSCYK

SEQ ID NO: 5215 - protein, 122 aa, Zea mays
  UNSURE (1)..(122): unsure at all Xaa locations
  Clone ID: PAT_MRT4577_18052C.1.pep
  unsure (1)..(122): unsure at all Xaa locations
QQQFLPFNQVGSLTSASCSHHQHLPFSQLRAAYPQLFLPFSHLAALTSPAYXQQHRLLPFSQLAGVSPATLLTXPQLLPFXQRVAPTADTKLHLHXLLPFNQLALTNPAVFYHQPIIGGVLF

SEQ ID NO: 5216 - protein, 247 aa, Zea mays
  UNSURE (1)..(247): unsure at all Xaa locations
  Clone ID: PAT_MRT4577_180546C.1.pep
  unsure (1)..(247): unsure at all Xaa locations
MSSAVEAISCPKVDVPAGPEPGEPAKEAAPPAEHCDTAPNGKCAPRCHGEEEEEEEDEEDEEKAPKAIDLGPMVSIKEQLEKDKDDESLRRWKEQLLGGVDLNSVGETLEPDVKIMSLSILSPGRPDIVLPLPVEPNGXGVWLTXKEGSPYRLKFTFSVSNNIVSGLRYXNTVWKTGLKVDRAKEMLGTFSPQLEPYTYVTPEDTTPSGMFARGSYSARTKFLDDDRKCYLEINYTFDIRREWPSTS

SEQ ID NO: 5217 - protein, 247 aa, Zea mays
  Clone ID: PAT_MRT4577_180549C.1.pep
MSSAVEAISCPKVDVPAGPEPGEPAKEAAPPAEHCDTAPNGKCAPRCHGEEEEEEEDEEEEEKAPKAIDLGPMVSIKEQLEKDKDDESLRRWKEQLLGGVDLNSVGETLEPDVKIMSLSILSPGRPDIVLPLPVEPNGKGVWFTLKEGSPYRLKFTFSVSNNIVSGLRYTNTVWKTGLKVDRAKEMLGTFSPQLEPYTYVTPEDTTPSGMFARGSYSARTKFLDDDRKCYLEINYTFDIRREWPSTS

SEQ ID NO: 5218 - protein, 61 aa, Zea mays
  UNSURE (1)..(61): unsure at all Xaa locations
  Clone ID: PAT_MRT4577_180789C.1.pep
  unsure (1)..(61): unsure at all Xaa locations
MAPLPMGPTPMAPAPMXNPGLATPASFCAYATDKISVDAYLASGIIGKGGANINQISYVTG

SEQ ID NO: 5219 - protein, 72 aa, Zea mays
  Clone ID: PAT_MRT4577_18087C.1.pep
EGGSLQACPLPVIDSQHTACSSLGPLCDIKFAPRAWQLSLAGICIIKNPVAYQVSLWLSLHLRGREGSFSFC

SEQ ID NO: 5220 - protein, 90 aa, Zea mays
  Clone ID: PAT_MRT4577_180924C.1.pep
AATATPTGTGGTERWGPRVQVILCGCRDVYPSPEGLSSFVSCLVLPIWGFDWKGALCHLVVLGSSSVSSDPCVKQHGLRIDGCSYPRLAL

SEQ ID NO: 5221 - protein, 50 aa, Zea mays
  Clone ID: PAT_MRT4577_181067C.1.pep
SGSRGRVMYRGVTRHHQHGRWQARIGRVSGNKDLYLGTFSTQEEAAEAYD

SEQ ID NO: 5222 - protein, 152 aa, Zea mays
  UNSURE (1)..(152): unsure at all Xaa locations
  Clone ID: PAT_MRT4577_181072C.1.pep
  unsure (1)..(152): unsure at all Xaa locations
MASATVLKSSFLPNKCEWIATRQADRSRPPTGSMVRRVSAYADELVKTAKTIASLXCGILTMDESNARCGKRLATIGLENTEANREAYRTLLVTTSALXQYISGAILFEETMYQSAVDGRKIVDILAKHGIVPGIKVDKGLCPIAGSXNESW

SEQ ID NO: 5223 - protein, 60 aa, Zea mays
  UNSURE (1)..(60): unsure at all Xaa locations
  Clone ID: PAT_MRT4577_18114C.1.pep
  unsure (1)..(60): unsure at all Xaa locations
PAPHQYTGSKEFFFPPFPKWMFKQQLNREGAPFQLPGVAXWTINTRNRGLCLGFCQVGME

SEQ ID NO: 5224 - protein, 228 aa, Zea mays
  Clone ID: PAT_MRT4577_181169C.1.pep
MARERREIKRIESAAARQVTFSKRRRGLFKKAQELSVLCDADVALIVFSSTGKLSQFASSSMNEIIDKYNTHSKNLGKTEQPSLDLNLEHSKYANLNEQLAEASLRLRQMRGEELEGLNVEELQQLEKNLESGLHRVLQTKDQQFLEQINDLERKSTQLAEENMQLRNQVSQIPPAGKQAVADTENVIAEEGQSSESVMTALHSGSSQDNDDGSDVSLKLGLPCVAWK

SEQ ID NO: 5225 - protein, 228 aa, Zea mays
  Clone ID: PAT_MRT4577_181171C.1.pep
MARERREIKRIESAAARQVTFSKRRRGLFKKAEELSVLCDADVALIVFSSTGKLSQFASSSMNEIIDKYSTHSKNLGKAEQPSLDLNLEHSKYANLNEQLVEASLRLRQMRGEELEGLSVEELQQLEKNLESGLHRVLQTKDQQFLEQISDLEQKSTQLAEENRQLRNQVSHIPPVGKQSVADTENVIAEDGQSSESVMTALHSGSSQDNDDGSDVSLKLGLPCVAWK

SEQ ID NO: 5226 - protein, 93 aa, Zea mays
  UNSURE (1)..(93): unsure at all Xaa locations
  Clone ID: PAT_MRT4577_181187C.1.pep
  unsure (1)..(93): unsure at all Xaa locations
GGGGGGPPDPIKGRFSGVNNNNDNNLLTPPSFWXXNHRGGCCTPTRRSRGNRTRRRSRPRRSRRDRQSPTARLAPPPRAFATGFEKSRRTPVA

SEQ ID NO: 5227 - protein, 99 aa, Zea mays
  UNSURE (1)..(99): unsure at all Xaa locations
  Clone ID: PAT_MRT4577_181204C.1.pep
  unsure (1)..(99): unsure at all Xaa locations
MGRARSGAAAAPLLLLLAAAAXGLGSAAXPAARGGVRKACRTTXYPSGCEQSLGXYGGAPPPRSPRERGRAXXXGSADRARAAXAYVGRLCGASNGKGA

SEQ ID NO: 5228 - protein, 45 aa, Zea mays
  Clone ID: PAT_MRT4577_181426C.1.pep
LLPICVFDCKVDLCHMLVLRSFYGSSDSCINQHGLYDRWKLLLLS

SEQ ID NO: 5229 - protein, 59 aa, Zea mays
  Clone ID: PAT_MRT4577_181481C.1.pep
KSARGAKKGDCHGRLKEKVAKNEGREAGVFGLCGLQVVFAGESVRRGSAVVGHLAACPF

SEQ ID NO: 5230 - protein, 621 aa, Zea mays
  Clone ID: PAT_MRT4577_18149C.1.pep
MSPNLDSAIKSQVPALLLRRLFGASRRDEAKQLQRTPAPVGRRRVFVQTETGCVLGMDLDRGDNAHTVKRRLQLAFNMPTGGTSLTFGDRVLENDLSFLRPDSPLLLTRNSINRSCSTPCLCPVSKDFEHKDCSGLVEMLGCSSSCARVKRLVDDVVTAIRSGVDPVPISSGLGGSYYFRNVLGDRVAIVKPTDEEPFAPNNPKGFVGRALGQPGLKRSVRVGETGFREVAAFLLDHDNFANVPATALVKITHSIFNINCPVNGGNLAPAHDQQQQVNSKIASFQQFIAHDFDASDHGTSSFPVAAVHRIGILDIRIFNTDRHAGNVLVRKLNGGTGRFGCQTELFPIDHGMCLPENLEDPYFEWIHWAQASIPFSEEELEYIRNLDPRKDVQMLRRELPMIREACLHVLALCTIFLKEAAAFGLCLAEIGEMMTREFRGMEEEPSQLELMCMEARKRVAEWEPFSATAEHGEDTDFQFSVDMLGEYSDVVRSPRFNGSGSKVSSFRSPLSKLVESVDEGSDGHEDQNESDRVLYAGWNTSSVPSKAMGHSGNASKSAMNRSADEQLPSSMCFVRLSDMSADEWDVFLEKFQELLKEALHESARAAAGQRMKQRLGTSCKF

SEQ ID NO: 5231 - protein, 137 aa, Zea mays
  UNSURE (1)..(137): unsure at all Xaa locations
  Clone ID: PAT_MRT4577_181507C.1.pep
  unsure (1)..(137): unsure at all Xaa locations
GNRTGILPLLPLFLQQXMGGITQLPLVHLLXQNIGTQLQQLELSNLAATSXQHILPFNQYCMNSAXYLQXQQLPLXQLSAAYPSNYXPLSTDTLNYLLITAAQLLPFXQLTGVSTCYLMTQPQLTTFYQHAVLNAGT

SEQ ID NO: 5232 - protein, 87 aa, Zea mays
  Clone ID: PAT_MRT4577_181515C.1.pep
VHSNQHVRGFITHAEQLRAKGVDEIQHISGNDPFVMMAWAKTYPENKHVKFLADGSVAYTKVLELELDLTVKGLDVRSKRFALLVDD

SEQ ID NO: 5233 - protein, 193 aa, Zea mays
  UNSURE (1)..(193): unsure at all Xaa locations
  Clone ID: PAT_MRT4577_181634C.1.pep
  unsure (1)..(193): unsure at all Xaa locations
MAKLHFFLLLLLAAAEAIHGEDGAYIGVNIGTAMSSVPAATQITTLLRSQNIRHIRLYDADPGMLSALANTGIRVIISVPNEQLLAIGNSNATAAKWVARNVAAHYPSVNITAIAVGSEVLSTLPNAAPLIMPAMRYLQNALVAAALDKYIKISTPHSSSIILDSFPPSQGFFNRSLDPVLVPMXQFLQSTGA

SEQ ID NO: 5234 - protein, 132 aa, Zea mays
  Clone ID: PAT_MRT4577_181639C.1.pep
MASRMGMVAILSLFVCALVASTSVNANVWQTDEDAFYSTNKLGVNGNMEMAQQQGGFIGHRPRLALFNRASKQLDREKRPVPSGPDPIHHSIPSHAPQHPPSYGKAPYEDDKSIASPGLSNPIGPPPFLDRY

SEQ ID NO: 5235 - protein, 158 aa, Zea mays
  UNSURE (1)..(158): unsure at all Xaa locations
  Clone ID: PAT_MRT4577_18164C.1.pep
  unsure (1)..(158): unsure at all Xaa locations
MGERGAEEDGSGGSSLSLMCLEDGADLDAGGSAESADDGEPAVVAHSDAGEDQEEEYMDYLVSKESSFCCSPSSSPVSSDAGAETRPSSTASSSDEWFRCARHATVAWVLETRAYFGFSHRAAYLAVSYMDRFCLXRCMDVSVMPWAAXLLAVACLSL

SEQ ID NO: 5236 - protein, 42 aa, Zea mays
  Clone ID: PAT_MRT4577_181736C.1.pep
SSALPLTKAWSFFLDLHSSIHRSVPSARGSVHLQRWLSSGAR

SEQ ID NO: 5237 - protein, 96 aa, Zea mays
  UNSURE (1)..(96): unsure at all Xaa locations
  Clone ID: PAT_MRT4577_181800C.1.pep
  unsure (1)..(96): unsure at all Xaa locations
AEPGSASTPLLRRRGSYTRTVSHARDELSSFRSGLRWMCVDHSDASSPAVSWLVFAALGVAVPAAAHAAAAPRRAYDTQVQVSLTLSXALAYTTLY

SEQ ID NO: 5238 - protein, 68 aa, Zea mays
  Clone ID: PAT_MRT4577_181814C.1.pep
FCRFYLCKKKKKKKKKKEKKKKKKKKKKKKKKKKKKKKKKKKKKKKKGGAVLKDQSLLPRACKKIVFL

SEQ ID NO: 5239 - protein, 524 aa, Zea mays
  UNSURE (1)..(524): unsure at all Xaa locations
  Clone ID: PAT_MRT4577_181875C.1.pep
  unsure (1)..(524): unsure at all Xaa locations
MAGGGIVNTGGGKDYPGKLTLFVLLTCIVAATGGLIFGYDIGISGGVTSMNPFLEKFFPEVYRKKQEAKTNQYCKYDNQLLQTFTSSLYLAALVASFFAATVTRAVGRKWSMLVGGLTFLVGAALNGAAQNIAMLIVGRILLGVGVGFANQSVPVYLSEMAPARLRGMLNIGFQLMITIGILAAELINYGTNKIKAGYGWRVSLALAAVPAAIITLGSLFLPDTPNSLLERGHPEEARRMLRRIRGTDDIGEEYADLVAASEEADKVRHPWRNILRRRYRAQLTMGVAIPVFQQLTGINVIMFYAPVLFDTLVFKNDASLMSSVITGLVNVFATVVSIVTVDRVGRRKLFLQGGAQMIVCQLIVGTLIAAKFGTSGTGDIAKGYAAVVVVFICAYVAGFAWSWGPLGWLVPSEIFPLXEIRPAGQSINVSVNMFFTFCIAQAFLTMLCHFKFGLFYFFAGWVVIMTVFIAFFLPETKNVPIEEMVLVWKSHWFWKRFIADEDVHVGIGNNHPAKNGSDTKGADA

SEQ ID NO: 5240 - protein, 52 aa, Zea mays
  UNSURE (1)..(52): unsure at all Xaa locations
  Clone ID: PAT_MRT4577_181965C.1.pep
  unsure (1)..(52): unsure at all Xaa locations
MGLVKEGVDMEEGTLEIRMEXRTVTGVAGPLVNLGKVIGPQYQXSVNIRPGD

SEQ ID NO: 5241 - protein, 99 aa, Zea mays
  UNSURE (1)..(99): unsure at all Xaa locations
  Clone ID: PAT_MRT4577_181993C.1.pep
  unsure (1)..(99): unsure at all Xaa locations
PLSQIPAACPKQFLPFSQLAALSSPAYLQQQQLLPFSQLAGVSQCYLLVATTVSPFFQHVAPNAGTLLHLQQXLLPLNRLALSNPSVFYQQPIIGGALF

SEQ ID NO: 5242 - protein, 129 aa, Zea mays
  UNSURE (1)..(129): unsure at all Xaa locations
  Clone ID: PAT_MRT4577_182189C.1.pep
  unsure (1)..(129): unsure at all Xaa locations
RSVRSSSSQPQLVAAAAVLTSGLLLLAAAAETASAAVICDKATSSVAPCLGYAMGISASHSAECCTTVRSLNIRAXSAADRQATCNXLKSMTGRLGSLVNMANASNIPGKCCFSVDLPISPTVYCTKIN

SEQ ID NO: 5243 - protein, 134 aa, Zea mays
  Clone ID: PAT_MRT4577_182206C.1.pep
TRNQTLWPNTMMAQACKKRRGVYISTELGGSDTDSDVEGSKPSKKSGVTSISTCEHQSSYNLKAASMKSSRMIRLCGNIVRKLIDHKGGWLFKDPVDPDLYKIPDYFDVIRNPMDLGTVKNKLTKKKYVSIEEF

SEQ ID NO: 5244 - protein, 83 aa, Zea mays
  UNSURE (1)..(83): unsure at all Xaa locations
  Clone ID: PAT_MRT4577_18220C.1.pep
  unsure (1)..(83): unsure at all Xaa locations
NTYSESYYQRRPELCEGVQXTARVTTVAVADLKGSMGDAVVCVQRDPDQRLARRPVLGSTPDQVIAPKGVKPTLSADLNTLAL

SEQ ID NO: 5245 - protein, 161 aa, Zea mays
  UNSURE (1)..(161): unsure at all Xaa locations
  Clone ID: PAT_MRT4577_18233C.1.pep
  unsure (1)..(161): unsure at all Xaa locations
ADQRWRDADVEYRXFIGGLDWATDDHFVHNAFSTYSEVLESKIILDRXRSMSRRYCSFTFSTEEAMRNXIEGMNGKELDGRNITRNXAQSRGGRGGXXGGGYGGGLGGSSYSGGRRRDGSGSYGSGSGXXGGRGRYGGGGGTYGSRNRGGRYGYSDGNWRN

SEQ ID NO: 5246 - protein, 85 aa, Zea mays
  Clone ID: PAT_MRT4577_182340C.1.pep
LLMLRPPAHDLLIPEVGAGRVVTLGREVPSRRAMRPVRHPSLRVNDAAAVRVRRRHRREQLVPSAVALSSSRVGHDVLRCLWCFR

SEQ ID NO: 5247 - protein, 81 aa, Zea mays
  Clone ID: PAT_MRT4577_182430C.1.pep
YRCFIGGLAWATDDHYLHNAFSTYGEALKSKIILNRDTQTSPGFGLLTFSTEEAMRNPTQGMNGTELDGPNITRNEDQSRL

SEQ ID NO: 5248 - protein, 69 aa, Zea mays
  Clone ID: PAT_MRT4577_182672C.1.pep
GRPSREKEAKGHKWHRVEGNNGQFVGGFPLPENPKTQKVRPPLEKGVLTVPVPKAEVKKPEVKSIQISG

SEQ ID NO: 5249 - protein, 58 aa, Zea mays
  Clone ID: PAT_MRT4577_182740C.1.pep
CAAENAVAPSPKFVFPCFDGENVESAPPPMKKDSKLANFLCWEEEADPMEEKAGVLNE

SEQ ID NO: 5250 - protein, 425 aa, Zea mays
  UNSURE (1)..(425): unsure at all Xaa locations
  Clone ID: PAT_MRT4577_182743C.1.pep
  unsure (1)..(425): unsure at all Xaa locations
STGSPVLLLALLPPSPALGSDSPAPRAVLFVAEASPAXVIGFEGYEKRLEITFFEAPVFGDPHGRGLRALSRAQMDFVLDLARGTIVSELSNKDFDSYVLSESSLFIYPVKIVIKTCGTTKLLLTIPRILELAEELSMPLAAVKYSRGTFIFPGAQPAPHRSFSEEVAALNRYFGGLKSGGNAYVIGDPARPGQKWHVFYATEYPEQPMVNLEMCMTGLDKKKASVFFKTNADGNTTCAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKAGVLDE

SEQ ID NO: 5251 - protein, 345 aa, Zea mays
  Clone ID: PAT_MRT4577_182747C.1.pep
RGHYQAPAHHSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHVFYATEYPEQPMVNLEMCMTGLDKKKACVFFKTNADGNTTCAKEMTKLSGISEIIPDMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKAGVLDE

SEQ ID NO: 5252 - protein, 403 aa, Zea mays
  UNSURE (1)..(403): unsure at all Xaa locations
  Clone ID: PAT_MRT4577_182762C.1.pep
  unsure (1)..(403): unsure at all Xaa locations
MASTDRSTPAEDEQQQKRPSLFSPYQMPRFRLTHRXPPXVVLAPMTRCRAPDAIPGPALAEYYAQRSTEGGLLISEGTIISPSGPGFPRVPGIYNQEQTDAWRKVVDAVHAKGAIFFCQLWHVGRASHQVYQPGAAAPISSTDKPISSRWRILMPDGSYGKYPTPRRLATSEIPEIVEQYRQAAVNAIKAGFDGIEIHGAHGYLIDQFLKGGINDRTDEYGGSLSNRCRFLLEVTRAVVSAIGADRVAVRAPPAIDHLDAYDSNPLQLGLAVVDRLNALQEETGRLAYLHVTQPRYTAYGQTESGQHGSAEEESRLMRALRGAYRGTFMCSGGYTRELGVEAVESWDADLVSYGRLFIANPDLVERFRRDAPLNRYVRKTFYTPDPVVGYTDYPFLGQPKARM

SEQ ID NO: 5253 - protein, 631 aa, Zea mays
  Clone ID: PAT_MRT4577_18278C.1.pep
MTVDELKLQARASGGHGAKDQFPVGMRVLAVDDDPTCLKILENLLLRCQYHVTTTGQAATALKLLREKKDQFDLVISDVHMPDMDGFKLLELVGLEMDLPVIMLSANGETQTVMKGITHGACDYLLKPVRIEQLRTIWQHVVRRRSCDAKNSGNDNDDSGKKLQVVSAEGDNGGVNRNKRISRKGRDDNGDDGDDSDDNSNENGDSSSQKKPRVVWSVELHRKFVAAVNQLGIDKAVPKKILDLMNVENITRENVASHLQKYRLYLKRLSADASRQANLTAAFGGRNPAYVNMGLDAFRQYNAYGRYRPVPTTNHSQPNNLLARMNSPAFGMHGLLPSQPLQIGHNQNNLSTSLGNVGGMNNGNLIRGAHMPLQDTSKCFPTGPSGNSFANISNSTQLVTTNNLPLQSLEPSNQQHLGRLHSSADPFNSFVGEPPQFADLGRCNTTWPTAVSSSNVQEIGQKDRIVNRPKLEPLSSFTEASSQIPLLGSEMQSHQVASLASNGLPMPFTQEAVPFAYGSSTNSREMLNNNLALSNSGVNSTLPNLRIDGSVVPGQTLGGSNSGGCVVPPLQDGRIDHQAVSSHLNYNNELMGTGRLQRGLSGGLDDIVVDMFRPDRADDGVSFIDGDWELV

SEQ ID NO: 5254 - protein, 157 aa, Zea mays
  UNSURE (1)..(157): unsure at all Xaa locations
  Clone ID: PAT_MRT4577_182851C.1.pep
  unsure (1)..(157): unsure at all Xaa locations
AHVRQRSTSAGTVTMFQKCSGASIASXLMPSTSXPTVSLECENPLLQPYKIQHAIAAVIXPQSPLILQQSLAVLQQLPLVHVLAHNIQAQQLLQHVLSNLAAYSQQQQYLAFDYLAVLNSAXYLQHHQLPFNQLPVDYPQQXLPFKQLAALNSTAYL

SEQ ID NO: 5255 - protein, 139 aa, Zea mays
  UNSURE (1)..(139): unsure at all Xaa locations
  Clone ID: PAT_MRT4577_18325C.1.pep
  unsure (1)..(139): unsure at all Xaa locations
IAHKSNLMLCVRXRVFISDEFDDLLPKYLSFLXMGMVDSYTLPLNVSRQTLEQHSSVKTIKKKLIRKALDMIRKLAEEDPDEYSNRQKTDDETSAMEEKKGQCTKFWNEFGXSLKLGMIEDATNRNLVVKLFEFESCNL

SEQ ID NO: 5256 - protein, 464 aa, Zea mays
  Clone ID: PAT_MRT4577_183348C.1.pep
MGGAEALGQPDGHANGAVVEEKLDLLRRQLGKADGDPLRIVGVGAGAWGSVFCALLQDAYGHLRDKAQVRIWRRPGRAVDRATAEHLFDVINAREDVLRRLIRRCAYLKYVEARLGDRTLYADEILRDGFCLNMIDTPLCPLKVVTNLQEAVWDADIVVNGLPSTDTREVFGEIRRYWKERITAPIIISLAKGIEASLDPLPRIITPTQMISNATGVPSENILYLGGPNIASEIYNKEYANARICGADKWRKPLAKFLRQPHFIVWDNSDLITHEVMGGLKNVYAIGAGMVAALTNESATSKSVYFALCTSEMIYITHLLEEEPEKLAGPLLADTYVTLLKGRNAWYGQKLAKGELTLEMGDSIKGKGTIQGVSAVDAFYELLSQDSLSVMHPEANRSVAPVEMCPILKALHRILITRDRPADSILQAIRDETMYDPRERIEMAQGHSLYRPSLLGQPKGDVKT

SEQ ID NO: 5257 - protein, 91 aa, Zea mays
  UNSURE (1)..(91): unsure at all Xaa locations
  Clone ID: PAT_MRT4577_183709C.1.pep
  unsure (1)..(91): unsure at all Xaa locations
MEQTFIMIKPDGVQRGLIGDMISXFEKKGFYLKGMKLMNSERAFAQQHYADLYDKPLFTRLNRYIMSGPVVAMVXEANDIMLTGRRIIGAT

SEQ ID NO: 5258 - protein, 138 aa, Zea mays
  UNSURE (1)..(138): unsure at all Xaa locations
  Clone ID: PAT_MRT4577_183795C.1.pep
  unsure (1)..(138): unsure at all Xaa locations
MAAKIFCLLILLGLSARAATATIFPQCSHAPITYILPPYLSPSVSXSILXNPILQPYRIQHAISSGILPLSPSVLQQSSTLLQHLPLEHLLAQNIRAQQLQQLVLTNLDAYYHQQQLLPFNQLSSLNSACYLQHQRLP

SEQ ID NO: 5259 - protein, 71 aa, Zea mays
  Clone ID: PAT_MRT4577_1837C.1.pep
ANALTAGNPIRRVNKTKLYLASHINSPLFATPLFLTRSKQLLQSPLISGDKHEKTCYATAYMIMHMRAKDN

SEQ ID NO: 5260 - protein, 428 aa, Zea mays
  Clone ID: PAT_MRT4577_183825C.1.pep
MASAGNSGSGDDDAGGKLLADRYQKGEVLGEGTYGVVFKAIDTKTGNTVAVKRIRIGKDKKEGVNFTALREIKLLKELKDPNIIELIDCFPYKENLHLVFEFMETDLEALIKDKNIILSPADTKSYVQMMLKGLAFCHKKWVLHRDMKPNNLLIGADGQLKLADFGLARVFGSPGRNFTHQVFARWYRAPELLFGSKQYGSGVDIWAAGCIFAELLTRRAFLQGSSDIDQLGKIFAALGTPKSSQWPDMVYLPDYVEYQYVAAPPLRTLFPMASDDALDLLSKMLTYDPKARISAQQALEHRYFSSLPAPTRPSQLPRPRRKGDQGNNKIPDLNLQDGPMVLSPPRKLRRVTAHEGMEGMHRTDKVDEHPSGMRHTDDMPSQSSRIPMSVDVGAVFGTRPAPRPTLNSADKSRLKRKLDMDPEFGYAE

SEQ ID NO: 5261 - protein, 79 aa, Zea mays
  Clone ID: PAT_MRT4577_183858C.1.pep
TYRLGPAAQVILVAAVMFTLVQRVYVRLSRLLSPICVFDCKVAVCQLLVLCSCTAPADPCINQHGLWIDECCYSWQDLL

SEQ ID NO: 5262 - protein, 301 aa, Zea mays
  Clone ID: PAT_MRT4577_183903C.1.pep
METSKSPQSSKNSHIVVPSDSNGPRFDNDGFSSEAASNQMVVFNSEAGDKEQDELGENRLQKSIITRGISPSIGAFTVQCAKCFKWRLIPTKEKYEEIRERIIEEPFVCKRAREWRPDVTCNDPEDISQDGSRLWAIDKPNIAQPPRGWERQIRIRGEGGTKFADVYYTSPTGRKLRSLVEVDRFLQENPEYGAQGVTLAQFSFQIPRPLRQDYVKKKPKLINPSDEASMIASKSFQPEEVKPIAWAVATKHEGDASEEASLTDEAPTSEVMLARKRKAGSSLSIEPNHLSDELEPKLEDA

SEQ ID NO: 5263 - protein, 57 aa, Zea mays
  UNSURE (1)..(57): unsure at all Xaa locations
  Clone ID: PAT_MRT4577_184060C.1.pep
  unsure (1)..(57): unsure at all Xaa locations
PTDRPIRFYXDGIYDLFHFVHAKSLXRPRRGLXNTYIIVGCCNDXSTHKFKGRTVMT

SEQ ID NO: 5264 - protein, 356 aa, Zea mays
  Clone ID: PAT_MRT4577_184395C.1.pep
MGRSPCCEKIGLKKGPWTPEEDQKLLAYIQEHGHGSWRALPVKAGLQRCGKSCRLRWTNYLRPDIKRGKFSLQEEQTIIQLHALLGNRWSAIATHLPNRTDNEIKNYWNTHLKKRLAKMGIDPVTHKSISGTRIGTTNDKSTKAAASLSHMAQWESARLEAEARLARESKIRTATPTPTALHAQPTILPASAASPCLDVLHAWQGAKIDLESPTSTLTFTGSNGGTLPTPRTNGLDVSESNCAMSHQRSDELEDEENDWQIFSKHQLLELDSKEREEDFIGCEEPWFSEMAGVGAGFTGMLLGVSNEHDASECWGESNNGQTERSNQASDEEDKNYWNGVLDMVNSELTPKSPPFV

SEQ ID NO: 5265 - protein, 73 aa, Zea mays
  Clone ID: PAT_MRT4577_184607C.1.pep
MLPSFLSPTASAAASVTPPSRPIPSNYGPPVLGPLRDRLDYFWFQNQDQFFLKRAAAHRRTVFLNNIPPTFPF

SEQ ID NO: 5266 - protein, 149 aa, Zea mays
  Clone ID: PAT_MRT4577_184761C.1.pep
MEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEGVAQWKSNLHPWIYEA

SEQ ID NO: 5267 - protein, 187 aa, Zea mays
  Clone ID: PAT_MRT4577_185079C.1.pep
MDKSGGEAFGSNAPGNILAAGGLGPLWLVDIANMCLILHLIGAYQVYAQPVFASVERWAASRWPEAKFMSSAYTVSIPLVQRGSVTVAPHKLVLRTVIVGATTAVALAIPFFNAVLGLLGAFSFWPLTVYFPISMHIAQGKIARGTKWWCLLQALSMVCLVISVAVGVGSVTDIVDSLKASSSPFKL

SEQ ID NO: 5268 - protein, 468 aa, Zea mays
  Clone ID: PAT_MRT4577_185080C.1.pep
MDKSAVAAYDVERGDYEEEHERRGTVWTATAHIVTAVIGSGVLALAWSVAQLGWVAGTLALAGFACVTYYTSTLLANAYRAPHPVTGDRNRTYMDAVRSYLSPREVFMCGIAQYVNLWGTMVGYTITATISMAAIRQSNCFRRSGAGAQCDAPGTVLMLAFGVVQVVLSQFPGLEHITWLSVVAAVMSFAYSFIGLGLSVGQWVSHGGGLGGRIAGAAAASPTRKLWNVLLALGNIAFAYTFAEVLIEIQDTLKSPPPENRTMKKAAMYGIGATTIFYISVGCAGYAAFGSDAPGNILTAGGLGPFWLVDIANMCLILHLIGAYQVYAQPIFASVERWAASRWPEAKFISSAYTVSIPLMQRGSVTVAPYKLVLRTVLVAATTVVALMIPFFNAVLGLLGAFSFWPLTVYFPISMHIAQDKITRGTKWYLLQALSMVCLMISVAVGIGSVTDIVDSLKVSSNPLKTVS

SEQ ID NO: 5269 - protein, 484 aa, Zea mays
  Clone ID: PAT_MRT4577_185084C.1.pep
MDKSGGEAAAAAAAADDVERRGGDYEQDEHERRGTVWTATAHIVTAVIGSGVLALAWSVAQLGWVAGPLALAGFACVTYYTSTLLAGAYRAPHPVTGHRNRTYMDAVRSYLSPREVFMCGVAQYVNLWGTMVGYTITATISMAAIRQADCLRRDGAGAGARCDAPGTVLMLAFSVVQVVLSQFPGLEHITWLSVVAAAMSFAYSFAGLGLSVGHWVSRGGGGLGGRVAGAAAASSTRKLWNVLLALGNIAFAYTFAEVLIEIQDTLKSPPPENRTMKKAAMYGIGATTIFYISVGCAGYAAFGSNAPGNILAAGGLGPLWLVDIANMCLILHLIGAYQVYAQPVFASVERWAASRWPEAKFMSSAYTVSVSIPLLQRGSVTVAPHKLVLRTAIVGATTAVALAIPFFNAVLGLLGAFSFWPLTVYFPISMHIAQGKIARGTKWWCLLQALSMVCLVISVAVGVGSVTDIVDSLKASSSPFKIVG

SEQ ID NO: 5270 - protein, 45 aa, Zea mays
  Clone ID: PAT_MRT4577_185199C.1.pep
CRGLRREQFHGTIGALLTKEEDDGVLVWSYTNSVLRFCYMVGPPE

SEQ ID NO: 5271 - protein, 46 aa, Zea mays
  UNSURE (1)..(46): unsure at all Xaa locations
  Clone ID: PAT_MRT4577_185297C.1.pep
  unsure (1)..(46): unsure at all Xaa locations
MAPPQTIPRRGLFIGGAWREPCLGRXLXPVVNPATRATXGDIPAGT

SEQ ID NO: 5272 - protein, 50 aa, Zea mays
  Clone ID: PAT_MRT4577_185349C.1.pep
PMKYVIKGAKSKGAEEADAKLAANSKVADKPTKGKKEKAGKDPNKPNTAP

SEQ ID NO: 5273 - protein, 538 aa, Zea mays
  Clone ID: PAT_MRT4577_185399C.1.pep
DVKNSARKAAETVLLVIDEEGVETLIPELLRGITDSQASMRRGSAYLIGFLFKNTKLYLADEASDMMSTLIILLSDTDKATVSAALEAFSRVVASVPKEQLPTHIKLVRDAVSTARDKERRRRKGVPILLPGLCLSKALQPFLPIFQQGLISGSAETKEQAAEGLGELIDVTSEKTLKEVVVPITGPLIRILGDRFPWQVKSAILSTLTIIIMKGGIALKPFLPQLQTTFVKCLQDNNKSVRTRAAAALGKLSALSTRVDPLVSDLLSMLQSGDESVKESVLSALKGVIKHAGKSVSAPIRSRGCALLEDLLQAEADDIRSCAAKVIGTLSQYMDDREIPDLVQILLEVGTSSDWCTRHGALLALSSISMHSPSKLCDLASFPSLVDLLKDSLKDDKFPVREVATRTLGRILVFELQSEADTLQLVQLLVLALRDDSSEVRRRSLSCIKAAAKMNHSALATHHSILGPAIADALKDSSMPVRLAAERCALHVFQLTKGPDNVTTAQKYLGMTGLEVKKIAKLNEESDGSESSDDDRRT

SEQ ID NO: 5274 - protein, 903 aa, Zea mays
  UNSURE (1)..(903): unsure at all Xaa locations
  Clone ID: PAT_MRT4577_185400C.1.pep
  unsure (1)..(903): unsure at all Xaa locations
NSARGLLPAIEDGIFSDNWRIRQSSVELLGDLLFKVAGTSGKAILEGGSDDEGASTEAQGRAIIILPDLFFRSLRSGSIARNLDXLQPFRSSSLRVELHLCPPILKVKPLLEILGREKRNEVLAAIYMLRSDVSLTVRQAALHVWKTIVANTPRTLKEIMPVLMDTLISSLASSSSERRQVAGRSLGELVRKLGERVLPSIIPILSQGLKDPSASRRQGVCIGLSEVMGSAGKHQLLSFMDELIPTIRTALCDSTQEVRESAGLAFSTLYKSAGLQAIDEIVPTLLRALEDDDTSATALDGLKQILSVRTAAVLPHILPKLVQPPLSSFNAHALGALAEVAGPGLNSHIGTVLPALILAMDDEDADVQNSARKAAETVLLVIDEEGVETLIPELLRGINDSQASMRRGSAYLIGFLFKNTKLYLADEASDMMSTLIILLSDTDKATVSAALEAFSRVVASVPKEQLPTHIKLVRDAVSTARDKERRRRKGVPILVPGLCLPKALQPFLPIYQQGLISGSAETKEQAAEGLGELIDVTSEKTLKEVVVPITGPLIRILGDRFPWQVKSAILSTLTIIIMKGGIALKPFLPQLQTTFVKCLQDNNSESSDEDRSALGKLSALSTRVDPLVSDLLSMLQSGDESVKESVLSALKGVIKHAGKSVSSAIRSRGCALLEDLLQAEADDVRSCAAKVIGTLSQYMEETEISDLVQILLNMSTSSDWCTRHGALLSFSYISMHSPSKLCHLASFPSLVDLLKGSLKDDKFPVREVATRTLGKILCFELQPEAGTLQLVQLLILALRDDSSEVRRRSLSCIKAAAKTNHSALATHHSILGPAIAEALKDSSMPVRLAAERCALHVFQLTKGPDNVTAAQKYLGMTGLEVKKIAKLDVDSDGSESSDDDKRT

SEQ ID NO: 5275 - protein, 347 aa, Zea mays
  Clone ID: PAT_MRT4577_185453C.1.pep
MEFKRDVWSLLLVLLLGQLVAFSMAASSFASSLIANLGVDAPLTQSFLAYLLLTLVYVPIVLRRRQKLQIAWYWYLALAFFDVQGNYLVVKAYQYSYITSVTLLDCWTVVWVVMLTWYALGTRYSLWQFVGAGTCVAGLALVLLSDAKSQDEQDPKKIPLLGDALVIAGTVGFAFSNVGEEYCVKKKDRVEVVAMLGLFGLLISTVQILVFERKGLEAVTWSPTMISLFAGFAVAIFVFYTVAPFVLKMSGATLFNLSLLTSDMWAVAIRVLFYQQEINRLYYLAFAVVAIGLIIYSLNDRSSDDETAGSTEAPAQYQQLPIEDNSTRIGSSSGSQERTHKEEVHIC

SEQ ID NO: 5276 - protein, 67 aa, Zea mays
  Clone ID: PAT_MRT4577_185609C.1.pep
SSHIHPLKIGIKTCGTTKLLLTIPRILELAEEPSMPLAAVKNSRGTFIFSGAQASPHRRLFEEDAAL

SEQ ID NO: 5277 - protein, 78 aa, Zea mays
  Clone ID: PAT_MRT4577_185727C.1.pep
KPGGAPRSPKRTPALRAFCPAPLKPARGPPSGARSLRSGRSPARGWRLSIRSGLGPNPGRGPKIRAQAQAQPKYPPRF

SEQ ID NO: 5278 - protein, 82 aa, Zea mays
  UNSURE (1)..(82): unsure at all Xaa locations
  Clone ID: PAT_MRT4577_185754C.1.pep
  unsure (1)..(82): unsure at all Xaa locations
ENPIVQXYFNQQAIATGMXPLSPLFLQQPSPLLQQLPLFHXMAHNIMAQQLQQLVLTYLAEYSYQHQLFPFNLLSALNSTSY

SEQ ID NO: 5279 - protein, 100 aa, Zea mays
  UNSURE (1)..(100): unsure at all Xaa locations
  Clone ID: PAT_MRT4577_185782C.1.pep
  unsure (1)..(100): unsure at all Xaa locations
TTACNGVLRVEMNSGAYGCXVTAGSTATAHRPTSTKFKDGITISTGQRLYQYIHSAVXQVLIRQGVLGTKVKIMLDXDPKRHVAPINPHPDLVTIHNPRR

SEQ ID NO: 5280 - protein, 103 aa, Zea mays
  UNSURE (1)..(103): unsure at all Xaa locations
  Clone ID: PAT_MRT4577_185827C.1.pep
  unsure (1)..(103): unsure at all Xaa locations
TVVEANTSYTGNHFHAKCHFGAVDIFNRKKLXYIVPSSHNCDIPHVNRTDYQLIDISPNGFASLLTXDGTTKDDLTLPTDETFVAHIKEGFESGNDLLVTVHP

SEQ ID NO: 5281 - protein, 85 aa, Zea mays
  Clone ID: PAT_MRT4577_185835C.1.pep
YVKFKSQELCVKLLIPELARLIRNRSHEFLPFTTTRRSGPRVDTSKSDSLHRTRPVHRSRHLTGTRSPAAARGGNSLPTRPTTRQ

SEQ ID NO: 5282 - protein, 80 aa, Zea mays
  Clone ID: PAT_MRT4577_185846C.1.pep
KPKQPLGEAGAIPAGAFALYEKPEAKKDPEHAPRPKIKKEVSAAAAVGSGGFAFPEPPEKKKAPKVPEEAGGEKNPHFFG

SEQ ID NO: 5283 - protein, 335 aa, Zea mays
  Clone ID: PAT_MRT4577_185876C.1.pep
MADLIKAVDIRGGKGERDALFINPQTPKPSPTEGQALVRVKAFGINRMDIVQRRGFYPLPPQAPATLGVEFSGTIESLGPGDHGAFKQGDEVFGLAYGGAYAEYLAVSTRMLLHKPSSMDFVTCAGIPETWITATQALHLVLGFTKGKSILWHAGASGVSIAGIQLSKIAGASQVFATAGSQEKCDFITSKLGATAAFNYKTQDWAEEIKKHTDGNGVDYIVDFVGASYFQQNQTAAARDGRIVLLGTLGGVKIPEADISQILYKRLRIEGSTLRSRDEEYQGKLRDRLEEYLPDFESGKLKILVDKVLPWEEIQEAHKHMEEAKNLGKIICTIS

SEQ ID NO: 5284 - protein, 73 aa, Zea mays
  Clone ID: PAT_MRT4577_18590C.1.pep
MDPTKFRPCSRHDTTGTTTNAGAPVWNDNEGLTVGPCGPILVGGYHLSEKVAHFALEGIPERVVHARGATGRG

SEQ ID NO: 5285 - protein, 288 aa, Zea mays
  Clone ID: PAT_MRT4577_18595C.1.pep
MGFVKLIKTKAYFKRYQVKFRRRREGKTDYRQRTRLITQDKNKYNTPKYRLVVRKTNKNIIAQIIYATVQGDRVVNAAYSSELPKFGIKLGLTNYASAYATGLLVARRHLTKIGLASKYQGKVEADGNDYTVEPAEGPRPFKALLDIGLARTSTGARIFAVAKGALDGGINIPHSVKRFAGYNAETKKHNPEVLKKYIYGQHVAEYMKKLQKEEPQAYEKQFSRFVKAGVKAGDIEGIYKNAHKAIRADPTKKANEKKAVEHKRYNPKRLTHAQRAERVAKKKAILGL

SEQ ID NO: 5286 - protein, 249 aa, Zea mays
  Clone ID: PAT_MRT4577_186005C.1.pep
MGKHGHGKCHDVEACYPPGAAGGGKYPYMTENPQLRWAFIRKVYVIVCLQLLLTVAVAATVNLVRAIGDFFLSRTMGAMFAIIGVIVAPILVMIPMIIYRKRHPVNLALLALFTVCISFAVGLSCLTANGPVILEAVVITMVVVLGLTFYTFWAAKRGYEFEFLGPFLVSACLILMLFSLLRIIFPLGRTGTMVYGCIAALVFSGFIIYDTDNLIRVYSYDEYVAAAIELYLDIINLFQAILAVLEGVD

SEQ ID NO: 5287 - protein, 98 aa, Zea mays
  Clone ID: PAT_MRT4577_186057C.1.pep
GGIRAVVLRATLPATGGSDRLGPRVPVILFASVMFSLVQRVYLRSSCLLLPICVFYCKVVLCQLLVLCSFLGLSCPMYHPAWSVDRCILLLLSGFVLC

SEQ ID NO: 5288 - protein, 380 aa, Zea mays
  UNSURE (1)..(380): unsure at all Xaa locations
  Clone ID: PAT_MRT4577_186155C.1.pep
  unsure (1)..(380): unsure at all Xaa locations
MATAGKVIKCRAAVAWEAGKPLSIEEVEVAPPQAMEVRIKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVXDINPAKYEQAKKFGCTEFVNPQDHDKPVPEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 5289 - protein, 379 aa, Zea mays
  Clone ID: PAT_MRT4577_186156C.1.pep
MATAGKVIKCRAAVAWEAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISIGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKAESLRCIMRMED

SEQ ID NO: 5290 - protein, 381 aa, Zea mays
  UNSURE (1)..(381): unsure at all Xaa locations
  Clone ID: PAT_MRT4577_186157C.1.pep
  unsure (1)..(381): unsure at all Xaa locations
MATAGKVIKCRAAVAWEAGKPLSIEEVEVAPPQAMEVRIKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGXAVGLAAMXEGARLAGASRIIGVDINPAKYEQAKKFGCTEFVNPKDHDKPVQEVLIELTNGGVDRSVECTGNINAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 5291 - protein, 416 aa, Zea mays
  UNSURE (1)..(416): unsure at all Xaa locations
  Clone ID: PAT_MRT4577_186160C.1.pep
  unsure (1)..(416): unsure at all Xaa locations
MATAGKVIKCRAAVAWEAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKXPPPEEPWSTYLTCLRFNRIPDXDQHAMCVFVLCTYXELELEKFITHSVPFSEINTAFDLMLKGESLRCIMRMED

SEQ ID NO: 5292 - protein, 76 aa, Zea mays
  UNSURE (1)..(76): unsure at all Xaa locations
  Clone ID: PAT_MRT4577_186318C.1.pep
  unsure (1)..(76): unsure at all Xaa locations
MCCNCGSSCGXSSSCKCGKKYPDLYETSTDAHATVHLSVAPEKNAEPKVVQAVAESGEAAHECSCGCNCKCDPCNC

SEQ ID NO: 5293 - protein, 203 aa, Zea mays
  Clone ID: PAT_MRT4577_1863C.1.pep
IKTGSLRSRRVPSRCSPSCATPATQPLEKHPKLKAAEKLKHFIIWNGVFDFREQMFSFLRDAGDAPLEKHPKLKAHAVTVFVMACESATQLRSTGDVKVREATLKRLGATHARAGVADAHFEVVKTALLDTIRDAVPDMWTPEMKAAWEEAYDQLAAVIKEEMKNAAAAEEQTKNAATAEEEIKNAAPAEEQTKIAAAAVDGS

SEQ ID NO: 5294 - protein, 191 aa, Zea mays
  Clone ID: PAT_MRT4577_1864C.1.pep
MGFSEAQEELVLRSWKAMKSDSESTALKFFLRIFEIAPGAKQMFSFLRDAGDAPLEKHPKLKAHAVTVFVMACESATQLRSTGDVKVREATLKRLGATHARAGVADAHFEVVKTALLDTIRDAVPDMWTPEMKAAWEEAYDQLAAVIKEEMKNAAAAEEQTKNAATAEEEIKNAAAAEEETTNAAAAVDGS

SEQ ID NO: 5295 - protein, 51 aa, Zea mays
  Clone ID: PAT_MRT4577_186537C.1.pep
DLAPSWLIRAATRSAAYQIRAWRSESRSRADESESNRGRNCLWRPSGRWSE

SEQ ID NO: 5296 - protein, 85 aa, Zea mays
  Clone ID: PAT_MRT4577_186561C.1.pep
SVCMARQPRLQVLAASRNKISTLKGFPHFPSLEHLRVEENPLLEMPHLEAASILLIGPTLKKFNDRDLNPNEAEVAKQYPAHTAI

SEQ ID NO: 5297 - protein, 61 aa, Zea mays
  Clone ID: PAT_MRT4577_186651C.1.pep
CISYTTTRKASRALNGRKTPNAMGVGAPSSILEGGVVPGLCLGLDFGPPPGVSAQSRPYWP

SEQ ID NO: 5298 - protein, 257 aa, Zea mays
  UNSURE (1)..(257): unsure at all Xaa locations
  Clone ID: PAT_MRT4577_18668C.1.pep
  unsure (1)..(257): unsure at all Xaa locations
IRLLDPPLHEFLPXGNVEEIVRELCAETGANEEEALERVEKLAEVNPMLGFRGCRLGISYPELTEMQARAIFEAAIAMSNQGVEVFPEIMVPLVGTPQELGHQVNVIKQTAEKVFANAGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKVGLDYVSCSPFRVPIARLAAAQVLV

SEQ ID NO: 5299 - protein, 235 aa, Zea mays
  UNSURE (1)..(235): unsure at all Xaa locations
  Clone ID: PAT_MRT4577_186916C.1.pep
  unsure (1)..(235): unsure at all Xaa locations
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTISGKPIFHFVGTSTFSEYTVIHVGCLAKINPSAPLDKVCVLSCGISTGLGATLNVAKPKKGXTVAIFGLGAVGLAAMQRAKMAGASRIIRVDLNPXKYQQA

SEQ ID NO: 5300 - protein, 246 aa, Zea mays
  Clone ID: PAT_MRT4577_186918C.1.pep
METAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGAKMAGASRIIGVDLNPAKYEQAKKFGCTDFVNP

SEQ ID NO: 5301 - protein, 95 aa, Zea mays
  Clone ID: PAT_MRT4577_187123C.1.pep
MYGRGKGGKDLSNGGAKRHRKVLRDNIQSITNPAIQRLVRKGSVISISRLIYHETYGVLKIYIENVIRDAVNYTEHARRKTVTAMDVDYALKHYG

SEQ ID NO: 5302 - protein, 542 aa, Zea mays
  Clone ID: PAT_MRT4577_187144C.1.pep
MARGGDGLQVLSALDAAKTQWYHFTAIIVAGMGFFTDAYDLFCISLVTKLLGRIYYTDTSKDSPGSLPPNVAAAVNGVAFCGTLAGQLFFGWLGDKLGRKSVYGMTLMVMVICSVASGLSFGHTPTGVMATLCFFRFWLGFGIGGDYPLSATIMSEYANKRTRGAFIAAVFAMQGFGILAGGIVTLVISAAFRAAYPSPAYRDDHFTSTVPQADFVWRVILMLGAAPALLTYYWRMKMPETARYTALVAKNAKQAAADMSKVLHTEILDEQEKLDGMVAAEGANSFGLFSREFARRHGLHLVGTATTWFLLDIAFYSQNLFQKDIFTSINWIPKANTMSALEEVYRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDKSKTDAGYPAGIGVRNSLFVLAASNMLGFVLTFLVPESKGKSLEEMSGEAEDSEEEPVGARAVRPSETQMV

SEQ ID NO: 5303 - protein, 539 aa, Zea mays
  Clone ID: PAT_MRT4577_187145C.1.pep
MARGGDGLQVLSALDAAKTQWYHFTAIIVAGMGFFTDAYDLFCISLVTKLLGRIYYTDTSKDSPGSLPPNVAAAVNGVAFCGTLAGQLFFGWLGDKLGRKSVYGMTLMVMVICSVASGLSFGHTPTGVMATLCFFRFWLGFGIGGDYPLSATIMSEYANKRTRGAFIAAVFAMQGFGILAGGFVTLVISAAFRAAYPSPAYRDDHFTSTVPQADFVWRVILMLGAAPALLTYYWRMKMPETARYTAVVAKNAKQAAADMSKVVQTEIVDEQEKLDAAEGANSFGLFSREFARRHGLHLVGTATTWFLLDIAFYSQNLFQKDIFTSINWIPKANTMSALEEVYRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDKSKTDAGYPAGIGVRNSLFVLAASNMLGFVLTFLVPESKGKSLEEMSGEAEDSEEEPVGARAVRPSETQMV

SEQ ID NO: 5304 - protein, 575 aa, Zea mays
  UNSURE (1)..(575): unsure at all Xaa locations
  Clone ID: PAT_MRT4577_187147C.1.pep
  unsure (1)..(575): unsure at all Xaa locations
MARGGDGLQVLSALDAAKTQWYHFTAIIVAGMGFFTDAYDLFCISLVTKLLGRIYYTDTSKDNPGSLPPNVAAAVNGVAFCGTLAGQLFFGWLGDKLGRKSVYGMTLMLMVICSVASGLSFGHTXRGVMATLCFFRFWLGFGIGGDYPLSATIMSEYANKKTRGAFIAAVFAMQGFGILAGGIVTLVISAAFRAGYPAPAYRDDHFNSTVPQADYVWRIILILGAAPAMLTYYWRMKMPETARYTALVAKNAKQAAADMSRVLQTEIVDEQEKLDEMXRREQXFGLFSREFARRHGLHLVGTSTTWFLLDIAFYSQNLFQKDIFTSINWIPKANTMSALEEVFRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDKSKADAGYPAGIGVRNSLFVLAASNLLGFILTFLVPESKGKSLEEMSGEADDAEDXPSAPARCGRRGPRWCRIEHGDACTRVLHPGARLGRQGAPVQACRCFAVQK

SEQ ID NO: 5305 - protein, 547 aa, Zea mays
  Clone ID: PAT_MRT4577_187148C.1.pep
MARGGDGLQVLSALDAAKTQWYHFTAIIVAGMGFFTDAYDLFCISLVTKLLGRIYYTDTSKDSPGSLPPNVAAAVNGVAFCGTLAGQLFFGWLGDKLGRKSVYGMTLMVMVICSVASGLSFGHTPTGVMATLCFFRFWLGFGIGGDYPLSATIMSEYANKRTRGAFIAAVFAMQGFGILAGGIVTLVISAAFRAAYPSPAYRDDHFTSTVPQADFVWRVILMLGAAPALLTYYWRMKMPETARYTALVAKNAKQAAADMSKVLHTEILDEQEKLDAAEGANSFGLFSREFARRHGLHLVGTATTWFLLDIAFYSQNLFQKDIFTSINWIPKANTMSALEEVYRISRAQTLIALCGTVPIGFVVMYAGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDRSKTDAGYPAGIGVRNSLFVLAASNMLGFVLTFLVPESKGKSLEEMSGEAEDSEEEPVGARAVRPSETQMV

SEQ ID NO: 5306 - protein, 120 aa, Zea mays
  UNSURE (1)..(120): unsure at all Xaa locations
  Clone ID: PAT_MRT4577_187161C.1.pep
  unsure (1)..(120): unsure at all Xaa locations
WQAKIFRLMMLLGLAASXATASHFTQCSQAXITFLLTPYLSPSMSSVCENPILLPYRIQQAIAAGILPLSPLFLQQSSSLLQELPLRHLLAQNIRAQQLQQLVLANLAAYSQQQAVTFGA

SEQ ID NO: 5307 - protein, 227 aa, Zea mays
  UNSURE (1)..(227): unsure at all Xaa locations
  Clone ID: PAT_MRT4577_18853C.1.pep
  unsure (1)..(227): unsure at all Xaa locations
MPLLADSGHGLVNTFAPTSAAAAAMDSHAGARGGSRSLLFRHRQPDEDLEGGEGAMTLDERVTLXRRIEEESMQQDXLRRLVENKPGPICYYGLEPSXRMHSRQGIAKTINKTRWYNTERKGKIRIADWFEQLNNKMRGDLKKIHTVMQLXDNICKAVEMNXKTGVEVLWLPEEIKRSAYKHWTIAMDIDQKNSEKRTTRCWQNMSRSDQDYMTAGQIFYPCMQCAD

SEQ ID NO: 5308 - protein, 119 aa, Zea mays
  UNSURE (1)..(119): unsure at all Xaa locations
  Clone ID: PAT_MRT4577_18938C.1.pep
  unsure (1)..(119): unsure at all Xaa locations
FLPFNKQDAFNLLLYLRQQQLPFSQLRGANRQQYLPFSQLAALNSPAYLQQLHPLPFSQLAGVSPATFLKQPQLSPLDQHAAPNAGTLXQQQQPLPLNQLAFPTPAAFNQQPMIGGALF

SEQ ID NO: 5309 - protein, 64 aa, Zea mays
  Clone ID: PAT_MRT4577_19019C.1.pep
ESCKKTNSDDLSDRGQLVRPGVEQLPHRVHDDADLRQLVRVDRCSGRRRCRLAQALIRLTIECC

SEQ ID NO: 5310 - protein, 161 aa, Zea mays
  UNSURE (1)..(161): unsure at all Xaa locations
  Clone ID: PAT_MRT4577_1903C.1.pep
  unsure (1)..(161): unsure at all Xaa locations
MAAKIFCLLXMLLGLSASAAXVTIYPQCSQVPIASLFPPXLSPALSMDCENPILQPYRIQQAIRTGILPLSPLFLQQSSXLLQQIXPLVHLLQQNMRTQQLQQLALANLAAYSQQQQFLXYNQLAVLYSAFYFXQQQLPFNQLFAAYPQAXLAYNQLHRFE

SEQ ID NO: 5311 - protein, 79 aa, Zea mays
  Clone ID: PAT_MRT4577_19079C.1.pep
EGSRRALEEPREQKKNGGLFMRRGSETGRFSHGSFVYLSRACLCLFRALGCVGPVPRFLTRCCFQFANVQGPGTPNNGC

SEQ ID NO: 5312 - protein, 36 aa, Zea mays
  Clone ID: PAT_MRT4577_19105C.1.pep
KQLAVDMLANKLLFEASEYSHVCKHACSKEVPQHQH

SEQ ID NO: 5313 - protein, 105 aa, Zea mays
  UNSURE (1)..(105): unsure at all Xaa locations
  Clone ID: PAT_MRT4577_19228C.1.pep
  unsure (1)..(105): unsure at all Xaa locations
MSALDVEYRCFAPGLGWATSNESLENVFVSYGEILDSKVIAXSXTGRSHGFGFDTFSSENCMLHAIENMNGKEVDGRNITGSQADSRGDGVDGGGYGGVLDADGR

SEQ ID NO: 5314 - protein, 899 aa, Zea mays
  UNSURE (1)..(899): unsure at all Xaa locations
  Clone ID: PAT_MRT4577_19439C.1.pep
  unsure (1)..(899): unsure at all Xaa locations
MEAEAAAAVVASSASASASAGRSRPSSSAAQVTSNSAVRAGEENAASLYVLSVIDSLKKRITADRLTYIKNRIGENKTNISSYTQRTYNLSKNRQISTSKGTDSASNLLTKRQDDALCTLHSLDIIPVDKDGGTFQDESPFSSSNVMFGGNLGPKNAIIRPIKLPEVPKLPPYTTWIFLDRNQRMTEDQSVLGRRRIYYDTSCGEALICSDSEDEAIEDEEEKKEFKHSEDHIIRMTVQECGMSDAVLQTLARHMERAADDIKARTCVLMDISAXIGDADXVFDCKLHGCSQDLVFPTEKQPAWSGVDDSVPCGIHCHKLASEPDAAAGADHMLFDVEEPTHSSDNVMNQPGSNRKKNGSSGRKTKSQQSESSSTARVISESSDSEVHPISNKSPQHSPSPSKVKIGPKGGIRKITNRRIAERILMSVKKGQREMASSDSNFVSGYLLARDMKLRSDTRNGNKELIVSSQQSSPSTRSSKKKSTPQIGNSSAFAEAHNDSTEEANNRHSATDGYDSSRKEEFVNENLCKQEVYLRSWKAIEQGLLVKGLEIFGRNSCLIARNLLGGMKTCKDVFQYMNYIENNSASGALSGVDSLVKGYIKGTELRTRSRYFRRRGKVRRLKYTWKSAGYNFKRITERKDQPCRQYNPCGCQSTCGKQCPCLSNGTCCEKYCGCPKICKNRFRGCHCAKSQCRSRQCPCFAADRECDPDVCRNCWVGCGDGTLGVPNQRGDNYECRNMKLLLKQQQRVLLGRSDVSGWGAFLKNSVSKHEYLGEYTGELISHKEADKRGKIYDRENSSFLFNLNNEYVLDAYRMGDKLKFANHAPDPNCYAKVIMVTGDHRVGIFAKERILAGEELFYDYRYEPDRAPAWARKPEASGAKDDGQPFNGRAKKLAQNNRG

SEQ ID NO: 5315 - protein, 982 aa, Zea mays
  UNSURE (1)..(982): unsure at all Xaa locations
  Clone ID: PAT_MRT4577_19440C.1.pep
  unsure (1)..(982): unsure at all Xaa locations
MEAEAAAAVVASSASASASAGRSRPSSSAAQVTSNSAVRAGEENAASLYVLSVIDSLKKRITADRLTYIKNRIGENKTNISSYTQRTYNLSKNRQISTSKGTDSASNLLTKRQDDALCTLHSLDIIPVDKDGGTFQDESPFSSSNVMFGGNLGPKNAIIRPIKLPEVPKLPPYTTWIFLDRNQRMTEDQSVLGRRRIYYDTSCGEALICSDSEDEAIEDEEEKKEFKHSEDHIIRMTVQECGMSDAVLQTLARHMERAADDIKARYEILHGEKTKDSCKKGTEHNVKVEDLYCDKDLDAALDSFDNLFCRRCLVRLTVTFRYSFLGPVCXGHFCSLVMLIXFDCKLHGCSQDLVFPVSFHKLKELFIKLCVYLICVFFVQTEKQPAWSGVDDSVPCGIHCLLLASEPDSAAGADHMLFDVEEPTHSSDNVMNQPGSNRKKNGSSGRKTKSQQSESSSTARVISESSDSEVHPISNKSPQHSPSPSKVKIGPKGGIRKITNRRIAERILMSVKKGQREMASSDSNFVSGYLLARDMKLRSDTRNGNKELIVSSQQSSPSTRSSKKKSTPQIGNSSAFAEAHNDSTEEANNRHSATDGYDSSRKEEFVNENLCKQEVYLRSWKAIEQGLLVKGLEIFGRNSCLIARNLLGGMKTCKDVFQYMNYIENNSASGALSGVDSLVKGYIKGTELRTRSRYFRRRGKVRRLKYTWKSAGYNFKRITERKDQPCRQYNPCGCQSTCGKQCPCLSNGTCCEKYCGCPKICKNRFRGCHCAKSQCRSRQCPCFAADRECDPDVCRNCWVGCGDGTLGVPNQRGDNYECRNMKLLLKQQQRVLLGRSDVSGWGAFLKNSVSKHEYLGEYTGELISHKEADKRGKIYDRENSSFLFNLNNEYVLDAYRMGDKLKFANHAPDPNCYAKVIMVTGDHRVGIFAKERILAGEELFYDYRYEPDRAPAWARKPEASGAKDDGQPFNGRAKKLAQNNRG

SEQ ID NO: 5316 - protein, 105 aa, Zea mays
  UNSURE (1)..(105): unsure at all Xaa locations
  Clone ID: PAT_MRT4577_19480C.1.pep
  unsure (1)..(105): unsure at all Xaa locations
RTHFPLETLPQQCQYCTNNGSQIFCLLMLLDLSASAATATIFPQCSQPPIASLLPPHLSPPASSPCENPILQPYRIQXAMGPAILPLSPSYLHQPSILLLQISFG

SEQ ID NO: 5317 - protein, 312 aa, Zea mays
  Clone ID: PAT_MRT4577_19502C.1.pep
MAESFVLNTGSRIPSVGLGVWQIQPDAANDAIYAAVKAGYRHIDCAAAYNNEEEVGLALKKLFEDGVVKRDDLFITSKLWAANHAPEDVEEGIDTTLQDLQLDYLDLYLIHGPIRIKKGTSTMTPENFLPTDIPATWAAMEKLYDSGKARAIGVSNFSCKKLHDLLAVARVPPAVNQVECHPVWQQDKLRKLCQSNGVHLSAFSPLGSPGSPWINGPSVLKNPIVVSVADKLQKTPAQVALRWGIQMGHSVLPKSANESRIKENIDIFGWSIPEDLMAKFSEIKQVRLLTAEFVVHPQAGYNTLEDFWDGEI

SEQ ID NO: 5318 - protein, 204 aa, Zea mays
  UNSURE (1)..(204): unsure at all Xaa locations
  Clone ID: PAT_MRT4577_19600C.1.pep
  unsure (1)..(204): unsure at all Xaa locations
MASATGLKACFLRKKSXEWGATRQDAAPKTPTGSMVVRAYDYDDELXMTAKMIVLSGRCILEMDESNATCGKRLETIGMDNTEDNREAYRKLLVTGPGLGQYISSVILFEETMDQAAVDGRKSVDILAEQGIETGIKEDKGLVPIAGSNNEXWCQGLDGLVYREDVYYQQGARIDKWHTDDSIPNGPSELDVNEAARGLARYDG

SEQ ID NO: 5319 - protein, 95 aa, Zea mays
  UNSURE (1)..(95): unsure at all Xaa locations
  Clone ID: PAT_MRT4577_19611C.1.pep
  unsure (1)..(95): unsure at all Xaa locations
AANPAASSPRTHYHPSRSTRRAGPPDMAPAGPYGIAESQRLADLLLLEGNAFVRTERLSAVMVAFTGALTLCPNGADSGPTKHSAIXQRDEWTTV

SEQ ID NO: 5320 - protein, 344 aa, Zea mays
  UNSURE (1)..(344): unsure at all Xaa locations
  Clone ID: PAT_MRT4577_19712C.1.pep
  unsure (1)..(344): unsure at all Xaa locations
TRPIGYLEAVRGSASLSPPHFFLRTRSFVREGAPSCPHIRSSLPDTDRPLVRSPPSPIPTAMAAAAAAASSSSSSEXFRSPPAPASPXEVAVGAVATGSGDRVAADCGVCAICLDRIALQETALVKGCDHAYCVTCILRWASYKENPLCPQCKHPFEFLSVHRSLDGCLHDYLFEESVCLLLRAAWFEPLIVEAHEEALEEEEFLHQQYQYDDDEDDLDEESYYMNRSPSIRIGNRRWGDNGYIRGGRKEARPVNTDVAAGPSRTPKKKEKAASSSASVSVSGSGSGSGSVSKDVAGRRAKRAQKREAADKAAAEKHLKHLQRLGLRKSPEPVVPEEVGPQVNE

SEQ ID NO: 5321 - protein, 295 aa, Zea mays
  UNSURE (1)..(295): unsure at all Xaa locations
  Clone ID: PAT_MRT4577_19785C.1.pep
  unsure (1)..(295): unsure at all Xaa locations
LINADGIIEESFWPGKYAVELSSVAYGATWQFDTEALPNDLVKRGLAVRRDGDGELELTIKDYPYAHDGLMIWNSIKQWVTDYVGVYYKSDEAVAGDAELKAFWDEVRNVGHGDKKDEPWWPVLNTRDSLVETLTTIMWVTSGHHSAVNFGQYHYGGYFPNRPTTIRKNMPVEXPXDEEMRKFLSQPETTLLDMMPTQMQAIRIMTTLDILSSHSPDEEYMGEFAEPSWLVEPMVKAAFEKFSGRMKEIEGFIDECNNNPENKNRFGAGIVPYELLKPFSKPGVTGRGIPYSISI

SEQ ID NO: 5322 - protein, 914 aa, Zea mays
  UNSURE (1)..(914): unsure at all Xaa locations
  Clone ID: PAT_MRT4577_19793C.1.pep
  unsure (1)..(914): unsure at all Xaa locations
MIQMNMKQPLVLPAHRGNVIGSRLASSPSPVAAAAAAASRRRGVVSSPRSRLQRHMRLPRISCSATEEASGAVSAVTVEKMLTVTASVQAAPAIGQMYFQRALDDAGDFFGKTLLMELVSSEVDXVSSKTGLEKPRVTAFAHKTLREGHYEAEFKVPASFGPVGAVLLENEHHKEIFIREIKLVTGSDSSTAVTFGCNSWVHSKFDNPEKRIFFTLKSYLPSDTPKGLEDLRKKDLQALRGDGHGERKASERVYDYDVYNDLGDPDKNPAHQRPVLGGSKRYPYPRRCRTGRPRTRKDPEAEVRHGHNYVPRDEQFSEVKQLTFGATTLRSGLHALLPAIRPMLIKRELRFPHFPAIDDLYSDGIPLPAQTGLGAIRSIVPRVVKLVEDTTEHVLRFELPDMIERDRFSWFKDEEFARQTIAGLNPLCIQLLTEFPIRSKLDPEVYGPAESAITKEILEKHMSGGAAMTVEQALAAKRLFILDYHDVFLPYVHRVRELPDTTLYGSRTVFFLTDLGTLMPLAIELVRPKSPTQPQWKRVFTHGPDATDAWLWKLAKAHVVTHDTGYHQLVSHWLRTHCCVEPYIIAANRQLSRLHPVYRLLHPHFRYTMEINALAREALINADGIIEESFWPGRYAVELSSAAYGATWQFDTEALPNDLVKRGLAVRRDDGELELTIKDYPYAHDGLMVWNTIRQWAADYVNVYYKSDEAVAADPELKAFWDEVRNVGHGDKKDEPWWPVLDTRDSLAETLTTIMWVTSGHHSAVNFGQYHFGGYFPNRPTTIRKSMPVEEEAGRDEEMKKFLKQPETTLLDMLPTQMQAIRVMTTLDILSSHSPDEEYMGELAEPSWLEEPMVKAAFEKFGGRMKEIEGFIDECNNNPELRNRCGAGIVPYELLKPFSKPGVTGRGIPNSISI

SEQ ID NO: 5323 - protein, 102 aa, Zea mays
  UNSURE (1)..(102): unsure at all Xaa locations
  Clone ID: PAT_MRT4577_19842C.1.pep
  unsure (1)..(102): unsure at all Xaa locations
LRTRTTRERKKKRRGAATGGGSXAXRSGERRKPADNPXSERKPTGNXGXSAGPRTRAAXXAGHEKANPRGGGGGHXRASPRDGRQQATAAXDPEDTPREKGT

SEQ ID NO: 5324 - protein, 78 aa, Zea mays
  Clone ID: PAT_MRT4577_19845C.1.pep
CMGLLEPRMNTALTTDTERPCNQKHRWAPPNVTTRRYTLWTRVNITVANGITCPVGPQRSIATVSVGVARPPVTDGNC

SEQ ID NO: 5325 - protein, 300 aa, Zea mays
  Clone ID: PAT_MRT4577_20026C.1.pep
MGDLLGSPRVAFHHSIRSSPTTPFLRGPSPGAAPRQEEVCSFNNMSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAQKGDAGEGQ

SEQ ID NO: 5326 - protein, 85 aa, Zea mays
  UNSURE (1)..(85): unsure at all Xaa locations
  Clone ID: PAT_MRT4577_2019C.1.pep
  unsure (1)..(85): unsure at all Xaa locations
FSAALNNGYEFWGPLFGKXFFPMWVIKPLDPFLKGFMGPQNSPPTIVVLWSVLLAPVFSLLWGKIDPFVGGTETVNPNNCNPIIC

SEQ ID NO: 5327 - protein, 213 aa, Zea mays
  Clone ID: PAT_MRT4577_20206C.1.pep
MTENLHSRKMVQPKKFRGVRQRHWGSWVSEIRHPLLKRRVWLGTFETAEEAARAYDEAAVLMSGRNAKTNFPIQRSSTGEPTPAAGRDARSNFSSGSSTTNLSQILSAKLRKCCKAPSPSLTCLRLDPEKSHIGVWQKRAGARADSNWVMTVELNKDAASTDAASQSTSATTAPPATPMDEEERIALQMIEELLSSSSPASPSNGDDQGRFII

SEQ ID NO: 5328 - protein, 43 aa, Zea mays
  Clone ID: PAT_MRT4577_20284C.1.pep
TNYLRPDIKRGRFSFDEEEAIIQLHSILGNKWSAIAARLPGRT

SEQ ID NO: 5329 - protein, 60 aa, Zea mays
  UNSURE (1)..(60): unsure at all Xaa locations
  Clone ID: PAT_MRT4577_20295C.1.pep
  unsure (1)..(60): unsure at all Xaa locations
MAVSQESLSLVGTMRGHNGEVTGXATPIDNLPFIVSSSRDKYLLVWDLTNLVHSTSEIRR

SEQ ID NO: 5330 - protein, 97 aa, Zea mays
  UNSURE (1)..(97): unsure at all Xaa locations
  Clone ID: PAT_MRT4577_20297C.1.pep
  unsure (1)..(97): unsure at all Xaa locations
SQLLRANVQQFLPVKQLAALTYRAYLQQQXLMPFSQLAGVSPATFLTRPQLLPFXQHAAPNAGALLQXLQHMLPFIQLALTNPAAFYQQPIIGGALF

SEQ ID NO: 5331 - protein, 111 aa, Zea mays
  UNSURE (1)..(111): unsure at all Xaa locations
  Clone ID: PAT_MRT4577_20794C.1.pep
  unsure (1)..(111): unsure at all Xaa locations
GSAGFGGVGERIEMAASDVEYRCFVCGLGWATDDHLLHNVLSTYGEVLEYKIILDRQTHKYRGLXFDTFCTDDAMQNAIEGMNGKELYCSNITVNEGQSRGGRGSERGGGY

SEQ ID NO: 5332 - protein, 71 aa, Zea mays
  Clone ID: PAT_MRT4577_20797C.1.pep
SRGVGCPIPSARPLDVIPPAALDPYKHRPSSGSNSSFWTTNFGARVWNNNSALIVGRRGSILLADYYLFEK

SEQ ID NO: 5333 - protein, 82 aa, Zea mays
  UNSURE (1)..(82): unsure at all Xaa locations
  Clone ID: PAT_MRT4577_20809C.1.pep
  unsure (1)..(82): unsure at all Xaa locations
MAAADVEYRCYVGGLAWATRNESLEKAGASYGEILDSKVITDRXTERTRGFGYVTFSSDNSMLYAIENMNGKVLDCRNIIVN

SEQ ID NO: 5334 - protein, 406 aa, Zea mays
  Clone ID: PAT_MRT4577_21027C.1.pep
MKKLHWLVRFLFGPVPVYFSALAILIVLTNAQYFGLVGVGVAPRTAKLASSAPVVSVMKYCDIFRGEWVPDAEAPYYNHKTCHMIQEHQNCLKYGRPDLGFLKWRWRPSGCELPRFDPLQFLQFARGKSLAFVGDSLARNHMQSLLCLLSQVAYPKDLSANPSDQNKVYHYRAYNFTISMFWSPFLVRAREPDHDGPAHTGHWSLYLDEPDDKWVSQMPRFDYVLVSAANWFSRPSLFYERRRLVGCSFCSRQYGVPDLTLYYSQRRAWRVALRAINDLERLRGRVIVRMLSPMSHFENGTWDHGGDCRRTQPLRANQTAMEGRDLHFYTAQMEEFRAAEKAAAEKGRRLMLMDATAAMLMRPDGHPSRYGHWPNEKVQLYNDCIHWCLPGPIDIWNDMLFQMLLA

SEQ ID NO: 5335 - protein, 164 aa, Zea mays
  Clone ID: PAT_MRT4577_21028C.1.pep
MKKLHWLVRFLFGPVPVYFSALAILIVLTNAQYFGLVGVGVAPRTAKLASSAPVVSVMKYCDIFRGEWVPDAEAPYYNHKTCHMIQEHQNCLKYGRPDLGFLKWRWRPSGCELPRFDPLQFLQFARGKSLAFVGDSLARNHMQSLLCLLSQVAYPKDLSGNPSD

SEQ ID NO: 5336 - protein, 84 aa, Zea mays
  UNSURE (1)..(84): unsure at all Xaa locations
  Clone ID: PAT_MRT4577_21080C.1.pep
  unsure (1)..(84): unsure at all Xaa locations
PERVVHARGASAKGFFXCTHYVTSVRCAYLLRAPDMRTPVIVRFXTVIHERWCLKTMRDPRGFGVKFYTRXGNWNLLGNNCRVF

SEQ ID NO: 5337 - protein, 50 aa, Zea mays
  Clone ID: PAT_MRT4577_21176C.1.pep
MESKGGILSSSSRSMMYEAPLGYCIEDGRPAGGAKKFQSAAYSNCAKKAC

SEQ ID NO: 5338 - protein, 44 aa, Zea mays
  Clone ID: PAT_MRT4577_21206C.1.pep
ARIRVECAQSRDDTAIGMVMFIVDSTLCIPAACSSVPSISVHGP

SEQ ID NO: 5339 - protein, 134 aa, Zea mays
  Clone ID: PAT_MRT4577_21269C.1.pep
ERRPKLFFFLCSFFFLFTFNQLSTLNPAANLQQQLLPLSPLSAAYPQQFLPFNQLTALNSPAYLQQQQLLPFSQLAGVSPATLLTQPQGLPFYQNAAPNAGTLLQLSKSLPFNQLALTNPTNFYQQPIIGGALF

SEQ ID NO: 5340 - protein, 134 aa, Zea mays
  UNSURE (1)..(134): unsure at all Xaa locations
  Clone ID: PAT_MRT4577_21270C.1.pep
  unsure (1)..(134): unsure at all Xaa locations
ERRHKLFFFLCSFFFLFTFNQLATLNPAGNLQQQLLPLSQLSAGYPXQFLPFNQLTALNSPAYLQQQQLLPFSQLAGVSPATLLTQPQWLPFYQNAVPKGGTLLQLQKWLAFNQLGLTNPANFYQQPINGGALF

SEQ ID NO: 5341 - protein, 89 aa, Zea mays
  UNSURE (1)..(89): unsure at all Xaa locations
  Clone ID: PAT_MRT4577_2141C.1.pep
  unsure (1)..(89): unsure at all Xaa locations
KFHLICSTIACPFVEGCXLLHFAPGGYPAAAKMLNLSSSAVSGPSRTHVDHAALTGASHPASTVKTRMCTMYNTTEVLQFGDTCHFAHS

SEQ ID NO: 5342 - protein, 485 aa, Zea mays
  Clone ID: PAT_MRT4577_21539C.1.pep
MALSVEKTSSGREYKVKDLSQADFGRLELDLAEVEMPGLMACRTEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPEINTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 5343 - protein, 123 aa, Zea mays
  UNSURE (1)..(123): unsure at all Xaa locations
  Clone ID: PAT_MRT4577_21542C.1.pep
  unsure (1)..(123): unsure at all Xaa locations
MGLSVEKTSSGREYKVKDLSQADFGRLEIELAEVEMPGLMACRAEFGPSKPFAGARIXGSLHMTIQTGVLIETLTALGAEVRXMXCNIFYTQDHAAADMARDSAAAFGWKAETLXEXWWCNER

SEQ ID NO: 5344 - protein, 131 aa, Zea mays
  Clone ID: PAT_MRT4577_21544C.1.pep
MGQIQFASSPSSAAMALSVEKTSSGREYKVKDLSQADFGRLEIDLAEVKMPGRMACLVVFGPSKPFAGARISGSLHMTIHTAVLIETLTALGAEVRWCSCNIFSTQDHSAACISRDSADVFDMEGETLDEY

SEQ ID NO: 5345 - protein, 486 aa, Zea mays
  UNSURE (1)..(486): unsure at all Xaa locations
  Clone ID: PAT_MRT4577_21545C.1.pep
  unsure (1)..(486): unsure at all Xaa locations
MALSVEKTASGREYKVKDLSQADFGRLELELAEVEMPGLMACRAEFGPSQPFKGARISGSLHMTIQTAVLIETLTALGAEVRWCSCNIFSTQDHAAAAIARDSAAVFAWKGETLEEYWWCTERCLDWGAGGXGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 5346 - protein, 201 aa, Zea mays
  UNSURE (1)..(201): unsure at all Xaa locations
  Clone ID: PAT_MRT4577_21546C.1.pep
  unsure (1)..(201): unsure at all Xaa locations
MALSVEKTSSGREYKVKDLSQADFGRLEIDLAEVEMPGLMACRAXEFGPSKPFAGARISGSLHMTIXQTAVLXVETLXTALXAEVRWCSCNIFSTQDHALXAVIARDSVSVFAWXKGETLEEYWWCTERCLDWGEAGGPDLIXDDGGDATLLIHEGVQAEEDYEXKTGKIPXDPESTDNARVQXIGLTIIREGLKGDPKKY

SEQ ID NO: 5347 - protein, 120 aa, Zea mays
  Clone ID: PAT_MRT4577_21551C.1.pep
MALSVEKTSSGREYKVKDLSQADFGRLEIELAEVEMPGLMACRAEFGPSKPFAGARISGSLHMTIQTVVLIETLTALGAEVRWCSCNIFSTQDHAVGVIARDLVGGFAWKGETLEEYWWC

SEQ ID NO: 5348 - protein, 78 aa, Zea mays
  UNSURE (1)..(78): unsure at all Xaa locations
  Clone ID: PAT_MRT4577_21705C.1.pep
  unsure (1)..(78): unsure at all Xaa locations
MALLALCTSATSATHIPGHLSPLLIPLATMNPSMQYCMQQHVVAHLLAXPTLMLHQLLAXPLQPCQMPIMMPGMMPPM

SEQ ID NO: 5349 - protein, 321 aa, Zea mays
  Clone ID: PAT_MRT4577_2185C.1.pep
MAPAVAAAASAAMRQALRDRQILDAVGTGAAALSLAGSSFIVICYLLFRELRKFSFKLVFYLAVSDMFCSLFTILGGPSNAFYCFAHDYSAHFFCVASFLWTTTISFTLHRTVVKHKTDVEEFGSIFHLYVWGTSLSTTVLRSIGSDYGRPGTWCWIQQGSMAKVLHLITFYLPLWGAILYNGFTYYEVNRMLNNATQMAAGISDQSNQSDIRAGRKAFNRWGYYPLILIGSWAFATINRLYDFANPGHRIVWLSFLDVGFAGLMGLFNSIAYGLNSSVRRAISERIDTFLPERIKRSLPALSRLRSQQENELTSLIVEGN

SEQ ID NO: 5350 - protein, 137 aa, Zea mays
  Clone ID: PAT_MRT4577_21869C.1.pep
MSSTGGGGRGKAKPATKSVSRSSKAGLQFPVGRIARYLKAGKYAERVGAGAPVYLSAVLEYLAAEVLELAGNAARDNKKNRIVPRHIQLAVRNDEELSKLLGTVTIAAGGVMPNIHQTLLPKKAGQKGDIGSASQEF

SEQ ID NO: 5351 - protein, 74 aa, Zea mays
  Clone ID: PAT_MRT4577_22005C.1.pep
VRQERDTRAFFLSLSKSVLLAAVVLAASRPFPPLHAIAAGIRRLHRSLAPAPVCSEAPETGGARGSPAFGADAW

SEQ ID NO: 5352 - protein, 114 aa, Zea mays
  UNSURE (1)..(114): unsure at all Xaa locations
  Clone ID: PAT_MRT4577_22008C.1.pep
  unsure (1)..(114): unsure at all Xaa locations
TLRSVFSLESAMNGAKFNGAVKADAKLAAKSKGAEKPAKGMKGKASKDPNKPKRAPTAFFVFMEEFRMEXFMEKNPKNKSAAXVGKXAGDRRKSLSESDKAPYVAKANKLKLEY

SEQ ID NO: 5353 - protein, 137 aa, Zea mays
  UNSURE (1)..(137): unsure at all Xaa locations
  Clone ID: PAT_MRT4577_22068C.1.pep
  unsure (1)..(137): unsure at all Xaa locations
DAYGHQLQHTKHNILPTIAAKIFCXLILLGRSANIATATIFPQCSQTPITSLLPPYLSPTVSSMCENPIIQPYKIQHAISTSILPLLPLFLQQPSALLQHLPFVHLVAQNISAQQLQQLVLTNLSSYSHQHNFFSFN

SEQ ID NO: 5354 - protein, 387 aa, Zea mays
  Clone ID: PAT_MRT4577_22093C.1.pep
MLPSHLNGHSALGRRRPRLSAAAGESPAAAGVEAAAPLEEHDRIYFQAYSHLGIHETMIKDRVRTDAYHAAIMRHQKFIEGKVVLDVGCGTGILSVFCARAGAKRVYAVEACEIVVQAREIVKANNLTDQIVVIHGRVEDVDLEEKVDVIISEWMGYMLLYESMLPSVLFARDKWLKPGGLILPSHATLFMAPVTNRERYEDSVDFWRDVYGINMSALVPLAKKFTSEEPSIETIGGENVISWPSVFKRFDCYNFTAEEFKSITSKYKVSSMMLAPIHGFGFWFEVEFNEPIESSHNFPSSLDPLEIIQKKRRRSSEDIVLSTAPEDEPTHWQQTILYFPDPIEVKQDQIIEGSVTVSQSEENPRFLNIHLECFTGGQTLVKDCAMR

SEQ ID NO: 5355 - protein, 160 aa, Zea mays
  UNSURE (1)..(160): unsure at all Xaa locations
  Clone ID: PAT_MRT4577_22265C.1.pep
  unsure (1)..(160): unsure at all Xaa locations
MAAEGEKKMITLKSSDGEEFEVEEAVAMESQTIRHMIEDDCADNGIPLPNVNSKILPKVIEYWNKHVHAGGGGGGGLKGGSDDVXAASATGPAAXGEDLKNWDADFVKGDQATLFDLILGGNYLNIKGLVDLTWQTGGGMIKGQTPEEIRKTLNIKNDFT

SEQ ID NO: 5356 - protein, 176 aa, Zea mays
  Clone ID: PAT_MRT4577_22268C.1.pep
MAAEGEKKMITLKSSDGEEFEVEEAVAMESQTIRHMIEDDCADNGIPLPNVNSKILSKVIEYCNKHVHAAAAAAAASKAGSDDVGAAAANSTAASGEDLKNWDADFVKVDQATLFDLILAANYLNIKGLLDLTCQTVADMIKGKTPEEIRKTFNIKNDFTPEEEEEIRRENQWAFE

SEQ ID NO: 5357 - protein, 176 aa, Zea mays
  Clone ID: PAT_MRT4577_22270C.1.pep
MAAEGEKKMITLKSSDGEEFEVEEAVAMESQTIRHMIEDDCADNGIPLPNVNSKILSQGIEYWNKHVHGGAAAAAGSKGGSHDVGGASAKRNGGSGGDLQNWDGDFVKGDQGTLFHLLLGGNYLNIKGLVDLTWQNGGGMVQGKTPEEIRKNFHIQNGFTPEEEEEIRRENQWAFQ

SEQ ID NO: 5358 - protein, 145 aa, Zea mays
  UNSURE (1)..(145): unsure at all Xaa locations
  Clone ID: PAT_MRT4577_22271C.1.pep
  unsure (1)..(145): unsure at all Xaa locations
MAAEGEKKMITLKSSDGEEFEVEEAVAMESQXTIRHMIEDDCADNGIPLPNDNSKILFKGIEYWNKHVHAXAAEPAXKGGSDDVGGGFGNRNGGFGEDLKNWDADFVKGDQATLFDLILAGNYLNIKGVVELTCETGGGMIKGQT

SEQ ID NO: 5359 - protein, 305 aa, Zea mays
  Clone ID: PAT_MRT4577_22272C.1.pep
MGASFTKQGSMLEISSCCLRSLSVRCLPLYIYIYIHICMCVAAAWLGWIKSCRVGADRAPRSATEKVNGPSGKKTSNILICSALGTSRPAGPGIPNISPTLRLLSGAARVPSSIRSAECTPPFPTPIESMAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQATLFDLILAANYLNIKGLLDLTCQTVADMIKGKTPEEIRKTFNIKNDFTPEEEEEIRRENQWAFE

SEQ ID NO: 5360 - protein, 87 aa, Zea mays
  UNSURE (1)..(87): unsure at all Xaa locations
  Clone ID: PAT_MRT4577_22369C.1.pep
  unsure (1)..(87): unsure at all Xaa locations
ATHIQALXTTTDAIGXHESWMQFCMKQQGVXNLYAWXALMLTTVALPLSXCLMXMMMPSLMPPMTMMPMPXMMPSXMVPXMMSPITI

SEQ ID NO: 5361 - protein, 69 aa, Zea mays
  Clone ID: PAT_MRT4577_22410C.1.pep
LEFDYFALSMQWPGNICASISDCCDTNCCCSSEPLQTYTIHGLWPDYDYGTWPSCCHGTQFEMDKILPL

SEQ ID NO: 5362 - protein, 172 aa, Zea mays
  Clone ID: PAT_MRT4577_22488C.1.pep
MDSTFIMIKTDGVQRCLIDEIISRFEKKGFYLKDLKLVNVERSLDDKHYNNLVSKSFFQGLECYIISEPEVCMVWEDKSVVTTVRKIIGATNPLTSETGTIRGDFAGDIGRNVIHGSDSIDSANKEIALCVPEGPGDCQSIQHPCIYYNQTCIASHHILTDRGSMSPLVLSQ

SEQ ID NO: 5363 - protein, 191 aa, Zea mays
  Clone ID: PAT_MRT4577_22672C.1.pep
HKGIFIIEVLTRSCRSSVSISLLPVGPSPDIQRILAGIAYNWPILLGGQAHWTVGLVATLMAISSIIAADTSAFLCGRAFGRTPLTNISPKKTLEGALAGLAGCVLTTVLLSTALRWPRSLLSATAYGILIFLGSLFGDLVESLIKRDAGVKDSGSLIPGHGGILDRVDSYVFTGALCYSFVRVALPLYGV

SEQ ID NO: 5364 - protein, 377 aa, Zea mays
  Clone ID: PAT_MRT4577_22699C.1.pep
MVQQAAKEVIPLLTPYKMGQFELSHRVVLAPLTRCRSYGNVPQPHAAVYYSQRATRGGLLIAEATGVSATAQGFPESPGIWTQEQVEAWKPIVDAVHRKGAIFVCQIWHVGRVSTNELQPNGDAPISSTDKQISPDAKSGTAYSKPRRLRTDEVPGIVDDFRRAARNAIQAGFDAVEIHGAHGYLLEQFMKDSCNDRTDQYGGSLENRCRLAVEVVDAVVREVGARRVGIRLSPFVDFVDCVDSDPVALGHYMVQQLNRHSGLLYCHMVEPRITAHGRRQIPHGLLPFRKAFHGTFIAAGGGGYDREEGNKVVAEGYADLVAYGRLFLANPDLPRRFELDVALNKYDRSTFYTQDPIVGYTDYPFFEEEDGKNEESV

SEQ ID NO: 5365 - protein, 42 aa, Zea mays
  Clone ID: PAT_MRT4577_22775C.1.pep
KDVSSLSRVHVQMIDIPRINVPGSRCSRTHLLLLHQWHFRLF

SEQ ID NO: 5366 - protein, 133 aa, Zea mays
  UNSURE (1)..(133): unsure at all Xaa locations
  Clone ID: PAT_MRT4577_22776C.1.pep
  unsure (1)..(133): unsure at all Xaa locations
MAAKICCLLMLLGISASAATATIFPQCSQAPIASLLPPYLSPAVSSVCENPILQPYRIQQAIAAGILTLITLVLPPIITLLPEVPLGPLLAPNIKGQPLPQLGLTKLGGYFXQQQVLSFNQLTALNSASYLQQ

SEQ ID NO: 5367 - protein, 488 aa, Zea mays
  Clone ID: PAT_MRT4577_22832C.1.pep
MAGNALANYVQVYVMLPLDVITVDNTFEKEDETRAQLKKLTEAGADGVMIDVWWGLVEGKEPGVYDWSAYRQVFKLVQEAGLKLQAIMSCHQCGGNVGDVVNIPIPQWVRDVGKSNPDIFYTNRSGLTNIEYLTLGVDDQPLFHGRTAIQLYADYMKSFRENMADFLDAGVVVDIEVGLGPAGEMRYPSYPQSQGWVFPGVGEFICYDKYLQADFKAAAEEAGHPEWDLPDDAGTYNDTPEKTQFFADNGTYQTDKGKFFLTWYSNKLIKHGDKILDEANKVFLGCKVQLAIKVSGIHWWYNVPNHAAELTAGYYNLDDRDGYRTIAHMLTRHRASMNFTCAEMRDSEQSSEAKSAPEELVQQVLSAGWREGLNLACENALNRYDATAYNTILRNARPQGINKNGPPEHKLHGFTYLRVSDELFQEQNYTTFKTFVRRMHANLDYNPNVDPVAPLERSKAEIPIEEILEVAQPKLEPFPFDKDTDLPV

SEQ ID NO: 5368 - protein, 227 aa, Zea mays
  UNSURE (1)..(227): unsure at all Xaa locations
  Clone ID: PAT_MRT4577_23014C.1.pep
  unsure (1)..(227): unsure at all Xaa locations
MAAQILRLLMLLGLSASAATATIMPQCSHAAIALLLPPYLSPTEHSVXENPIIQPYRIQQAIAGGMLPLSPLLLQQXSTLSQHIPSEHPLAQNITAQHLQQRALANLAAYSHNQQILPFNQLRSLNSAYYLPQHHLPFSQLSAGYPQXSLPFNQLTVLNSPAYXQQRQLLPLNQLAGVSPATFLTXPQLLTYYQHAVPNAGTIXQLQHKLPCNPLALTYPGAFYQQP

SEQ ID NO: 5369 - protein, 156 aa, Zea mays
  Clone ID: PAT_MRT4577_23077C.1.pep
MAAFNKLGGLLRHSALVSGITGGSSPAVFNAARLMSTKLFIGGLDWGVDDVKLREAFSSFGEVTEARVITDRETGRSRGFGFVNYSDSDAAKEAISAMDGKEIDGRQVRVNMANERPAGNRGGGGYGGGGYGGGGYGGGGGYGGGGYGGGSQSYDA

SEQ ID NO: 5370 - protein, 581 aa, Zea mays
  Clone ID: PAT_MRT4577_23359C.1.pep
MADEAKAKGNAAFSAGRFEEAARHFTDAIALAPDNHVLYSNRSAALASLHRYSDALADAQKTVELKPDWAKGYSRLGAAHLGLGDAASAVAAYEKGLELDPSNEGLKAGLQDAKKAAAAPPRRGSSGPDAIGQMFQGPELWSKIASDPSTRAYLNEPDFMHMMREVQRNPSSISMYLSDPRMMQVLSLMLNVKIQRPEASEPSQSTPPPPKQQQQQQTPPSETKARDVEPEPEAEPMDLTDEEKDRKQTKAAAQKEKELGNAAYKKKDFEVAIQHYTKALELDDEDISYLTNRAAVYIEMGKYDECIKDCDKAVERGRELRADFKMISRALTRKGTALVKLAKTSKDFDIAIETFQKALTEHRNPDTLKKLNEAEKAKKELEQQEYYDPKLADEEREKGNEFFKEQKYPEAIKHYTEALKRNPKDPRVYSNRAACYTKLGAMPEGLKDAEKCLELDPTFTKGYTRKGAIQFFMKEYDKAVETYQAGLKHDPNNQELLDGVKRCVEQINKANRGEISQDELQERQNKAMQDPEIQNILTDPIMRQVLIDFQENPSAAQEHLKNPGVMQKIQKLVSAGIVQMR

SEQ ID NO: 5371 - protein, 581 aa, Zea mays
  Clone ID: PAT_MRT4577_23360C.1.pep
MADEAKAKGNAAFSAGRFEEAARHFTDAIALAPGNHVLYSNRSAALASLHRYSDALADAQKTVELKPDWAKGYSRLGAAHLGLGDAASAVAAYEKGLELDPSNEGLKAGLQDAKKAAAAPPRRGSSGPDAIGQMFQGPELWSKIASDPSTRAYLNEPDFMHMMREVQRNPSSISMYLSDPRMMQVLSLMLNVKIQRPEASEPSQSTPPPPKQQQQQQTPPSETKARDVEPEPEAEPMDLTDEEKDRKQTKAAAQKEKELGNAAYKKKDFEVAIQHYTKALELDDEDISYLTNRAAVYIEMGKYDECIKDCDKAVERGRELRADFKMISRALTRKGTALVKLAKTSKDFDIAIETFQKALTEHRNPDTLKKLNEAEKAKKELEQQEYYDPKLADEEREKGNEFFKEQKYPEAIKHYTEALKRNPKDPRVYSNRAACYTKLGAMPEGLKDAEKCLELDPTFTKGYTRKGAIQFFMKEYDKAMETYQAGLKHDPKNQELLDGVRRCIEQINKANRGEISQDELQERQNKAMQDPEIQNILTDPIMRQVLNDFQENPRAAQEHLKNPGVMQKIQKLVSAGIVQMR

SEQ ID NO: 5372 - protein, 180 aa, Zea mays
  UNSURE (1)..(180): unsure at all Xaa locations
  Clone ID: PAT_MRT4577_23412C.1.pep
  unsure (1)..(180): unsure at all Xaa locations
MASSMFSSAAVVTSPAQATMVAPFTGLKSSAAFPVTRKANNDITSITSNGGRVSCMKVWPPIGKKKFETLSYLPDLSDSELAKEVDYLLRNKWIPCVEFELEHGFVYREHGNSPGYYDGRYWTMWKLPXFGCTDSAQVLKEVEECKKEYPNAFIRIIGFDNTRQVQCISFVAYKPPSFTG

SEQ ID NO: 5373 - protein, 129 aa, Zea mays
  Clone ID: PAT_MRT4577_23507C.1.pep
NVVLEIQATMGGTPVMPSKKPMWKGVVVAYLVVALCYFPVSFVGYWAFGDSVDGDILVTLNRPRWLIALANMMVVIHVIGSYQIYAMPVFDMIETVLVKKLRFPTCLTLRLIARTVYVAFTMFIAITFS

SEQ ID NO: 5374 - protein, 162 aa, Zea mays
  Clone ID: PAT_MRT4577_23568C.1.pep
MAPIGMGSTLPDGQLAWFDESDQMQQVSIHSLAAGKKVILFGVPGAFTPTCSNQHVPGFITQAEELKAKGVDEILLVSVNDPFVMKAWAKTYPDNKHVKFLADGAAAYTKALGLELDLTEKGLGLRSRRFALLADDLKVTVANVEEGGQFTISGAEEILKAL

SEQ ID NO: 5375 - protein, 113 aa, Zea mays
  UNSURE (1)..(113): unsure at all Xaa locations
  Clone ID: PAT_MRT4577_23569C.1.pep
  unsure (1)..(113): unsure at all Xaa locations
LQQQFPFSXVGVAYPQHFFSFNQLGALNFAVYLKKQQLPPFSQLVYVSPVAFLTQQQLLRFYLHVGPNGGTLLQLQQLLPFNQLVLTNPKRFYQQPIIGGALFLDCLWVIVQK

SEQ ID NO: 5376 - protein, 101 aa, Zea mays
  Clone ID: PAT_MRT4577_23653C.1.pep
PTRASRPSNKCQRALADAERESTFIMIKPDEIQRRLIGEIISRCEKKVLYLKDSNLANVERSFAEKHYSDLECKPFFQGVVDYIISDPVEVMVCEGKSRIT

SEQ ID NO: 5377 - protein, 70 aa, Zea mays
  Clone ID: PAT_MRT4577_2365C.1.pep
PTRPKKNIKKKKKKKKKKKRKKKKKNKKKKKKKKKKKKKKKKGGGRFRGSKFTSACLQSINFFFGSIKLN

SEQ ID NO: 5378 - protein, 43 aa, Zea mays
  UNSURE (1)..(43): unsure at all Xaa locations
  Clone ID: PAT_MRT4577_23760C.1.pep
  unsure (1)..(43): unsure at all Xaa locations
WELDYLLLSLQWRGIIXASTRHXCTTNGCXRSEPVYTITIHGL

SEQ ID NO: 5379 - protein, 92 aa, Zea mays
  Clone ID: PAT_MRT4577_23824C.1.pep
VVVVPITSVATVAAATELPTGTGGTERWGPRGQVILFATVMFTLVQRVYLRSSRLLWPMCVFDGKVAMCQLLVWCSSSAPAGHCCQPAWTVD

SEQ ID NO: 5380 - protein, 584 aa, Zea mays
  Clone ID: PAT_MRT4577_2386C.1.pep
MALTDATAFPYGLRVLVVDDDPTWLKILEKMLRKCSYEVTTCGLASVAIQILRERRNKFDIVISDVNMPDMDGFKLLELIGLEMDLPVIMMSIDGETSRVMKGVQHGACDYLLKPVRMKELRNIWQHVYRKKMHEVKEIEGNDSYDDLQMFRNGVEGFDERDLFMRADSDTMRKRKDVNKDHADQDSSDGATVKKARVVWSVDLHQKFVNAVNQIGFDKVGPKKILDLMNVPGLTRENVASHLQKYRLYLSRLQKQNEERIMGAARQDFNQKGPSDHLNLRSSFQEQPGNLSNGCQHSSQKVEAQTNILDPHLDDTKTSMPLKVPDKNGISASDAVDPHNITTASPLSGVFSFERMPVNQDRKLSETMILECESWSGSVPPKQFMQYPKHNHERCDLLGDYSCLPKPDLEHPIAPGHLYAPPPVISMSYNVEKDVRDFSDVKPDLLGCMKSLSPALTCTVESVSAQLSDSVVTSTNTDVRFSSVEGLSSIKDCDFDQERNGAILFTSEEASILCGTDFTCLPEDLSGYQLQGVSFGNKGLNSIDLYQCNDTMLIPGLQNNWYDDDVEFSSETVEFPLLDGGLFA

SEQ ID NO: 5381 - protein, 61 aa, Zea mays
  Clone ID: PAT_MRT4577_24024C.1.pep
SSHACDYLRQLARTIAEYNQACTDPFMNLKGILVGKRATDIYYDNMVTVTYWRTHTMISDR

SEQ ID NO: 5382 - protein, 588 aa, Zea mays
  Clone ID: PAT_MRT4577_24055C.1.pep
MPTKATLRSDNQEMSKEELRRQHQAELARQKNEETARRLAGVGTGSGDGRGPARASNELVAYKNVNDVPFVRDLVIQVDQKNEAVLLPIYGSMVPFHVSTVKSVTSHQDNRTCTIRIFFNVPGMPFSNDSKFNSQGAIYLKEITFRSKDPRHSSEVVQQIKTLRRQVASRESERAERATLVTQEKLQIGSNRMKMMRLSDVWIRPAFGGRGRKLTGNLEAHFNGFRYSTSRSDERVDIMFGNIKHAFFQPAEKEMITLLHFHLHNHIMVGNKKTKDVQFYVEVMDVVQTLGGSRRSALDPDEIEEEQRERDRKNRINMDFQNFVNKVNDHWSQPQFKGLDLEFDVPLRELGFHGVPYKASAFIIPTSTCLVELIETPFLVVSLSEIEIVNLERVGFGTKNFDMAIVFKDFKKDVLRIDSIPSASLDAIKEWLDTTDLKYYESRLNLNWRPILKTIIDDPQKFIDDGGWEFLNMEASDSETEDTEESDQGYVPSDAEPESESEDDDSDSESLVESDDDDEESDEDSEEEKGKTWEELEREASNADREHGAESDSEEERRRRKAKTFGKSRAPERSSFKGAPPSKKPKFR

SEQ ID NO: 5383 - protein, 87 aa, Zea mays
  UNSURE (1)..(87): unsure at all Xaa locations
  Clone ID: PAT_MRT4577_24378C.1.pep
  unsure (1)..(87): unsure at all Xaa locations
KRTPAFGEALKNWDADFVKVDQAPLFDLILVSNYFNIKGLLDLSCQTVVDMIKGKTPEEIRKPFNIKNGFPPXEEKEIPRETHWAFE

SEQ ID NO: 5384 - protein, 102 aa, Zea mays
  Clone ID: PAT_MRT4577_24381C.1.pep
SSDLGSQIIMAQLLQQLVLSNLAWISHQQRVVPFNLLGSLNSASYLQQQQLPFTQLPAAYPQQFLPFNQLSALNSPAYLQQQQLLPFSHLAGVNPSTFFTQP

SEQ ID NO: 5385 - protein, 110 aa, Zea mays
  Clone ID: PAT_MRT4577_24661C.1.pep
RVGPGRPSFLVRYRVVFPSPGGLSWFVWCLLLPICVFDCKVVLCQLLVLCSSWVSADPCIKQHGLRLDGCCYPRQGLFSVIFKEKMAVFGVAKKRKLCIRKKKKKERAAA

SEQ ID NO: 5386 - protein, 128 aa, Zea mays
  UNSURE (1)..(128): unsure at all Xaa locations
  Clone ID: PAT_MRT4577_24765C.1.pep
  unsure (1)..(128): unsure at all Xaa locations
MAAKISRLQMLLGLSASAATATISPQCSQAPIACLLSPNLLTAVYCVCENAILQPYRIQQATATCIRPLSPSFLQQXSAILQQXPIVHSLVENIKEQQLQKLVLAHLATNSEPHKHREPNQLRALNSA

SEQ ID NO: 5387 - protein, 593 aa, Zea mays
  Clone ID: PAT_MRT4577_24964C.1.pep
MDLLDARHRHTPDLSSSQDAASNMGLPLAGAAYQPYVSELLSFSIERLHKEPELLRVDAERVRRQMQEVAVENYAAFIAASEALSFVRAQLESFDGHLEAMIEEIPNLTSGCTEFVESAQQILEERKLNQTLLANHTTLLDLLEIPQLMDTCIRNGNYDEALDLEAFVSKIWKLHPDLPVVQGLATEVKKTVQSLVSQLLQKLRSNIQLPECLRIVAHLRRIGVFSESELRLQFLRCREAWLSGILEDLDQRNVYDYLKGMVTCHRVHLFDVVNQYRAIFNNDKSGNDENYDGGLLFSWAMQQVSNHLTTLQVMLPNITEGGSLSNILEQCMYCAMGLGLVGLDFRGLLPPIFENAVLNLFSKNMSTAVENFQVILDSHCWVPMPSVGFVANGVVDETSDDVTPPSVLMEHPPLAVFVNGVSAAMNELRPCAPLSLKVVLAQEVVKGLHAVSDSLVRYKAMRMLRGNESALFLSLCQTFIEVAYPYCAACFGRCYPDGATLISECQGTFDAVRQLLTVPARSNSSSIERRQSGGIERRQSGAIERKQSVESTGTAVTDNGLSADGPGLETNSSAATTTSPVDDGGSTHPPASK

SEQ ID NO: 5388 - protein, 122 aa, Zea mays
  Clone ID: PAT_MRT4577_24965C.1.pep
LRGNESALFLSLCQAFIEVVHPYCAACFGRCYSNGATLISECQGTLDAVRQLLTIPARSNSSSIERKQSGAIERKQSVESSGTAVTDNELSADGPGLEINDAATTTTPPVEDDVSTHPPGSK

SEQ ID NO: 5389 - protein, 256 aa, Zea mays
  UNSURE (1)..(256): unsure at all Xaa locations
  Clone ID: PAT_MRT4577_24969C.1.pep
  unsure (1)..(256): unsure at all Xaa locations
MDLDARHRHTPDSSSSPHAASDMGLPLAGAAYQPYVSELLSFSIERLHKEPELLRVDAERVRRQMQEVAVENYGAFIAASEALSFVRAQLESFDGHLEAMIEEIPNLTSGCTEFVESAQQILEERKLNQTLLANHTTLLDLLEIPPLMDTCIRNGNYDEALDLEAFVSKISKLHPDLPVVQGLAAEVKKTVQSLISQLLQKLRSNIQLPECLRIVAHLRRIGVFSESELRLQFLRCRESWLSGILEDLDXRNVFDY

SEQ ID NO: 5390 - protein, 238 aa, Zea mays
  Clone ID: PAT_MRT4577_25003C.1.pep
MAADPSAAAAPADPDGPDAVRFTWNAWPRSKVEASRCVVPLAAAISPVRSPESLASPPLPYPPLRCKPPCSALLNPFARVDFTAKIWICPLCFSRNHFPPHYAGISENNVPAELFTQCSTVEYLVAGPPGSPAPLPPVFLFVIDTCVIEEELEYVKLSMRKAVALLPEHALVGLVTFGTQVHLHELGFSELSKIYVFPGSKEISKEQILDQLGLSGGGRPGFPKMTQQPGVQQVNGMH

SEQ ID NO: 5391 - protein, 249 aa, Zea mays
  Clone ID: PAT_MRT4577_25022C.1.pep
MTAGFQLGVIGSLTLSVASSVAIVICNKALISTLGFPFATTLTSWHLMVTFCTLHVAQRLRFFEPKAIDGQTVVLFGLLNGTSIGLLNLSLGFNSIGFYQMTKLAIIPFTVLLETIFLKKRFSETIKFSLLVLLLGVGIASVTDLKLNCLGSVLSGLAIATTCVGQILTNTIQRKLKVSSTQLLYQSAPYQAAILFATGPFVDHLLTGRSVFAHRYTFPVVGFIVLSCLIARTYAHMYYGRKGDPQGTT

SEQ ID NO: 5392 - protein, 340 aa, Zea mays
  Clone ID: PAT_MRT4577_25025C.1.pep
MTAGFQLGVIGSLTLSVASSVAIVICNKALISTLGFPFATTLTSWHLMVTFCTLHVAQRLRFFEPKAIDGQTVVLFGLLNGTSIGLLNLSLGFNSIGFYQMTKLAIIPFTVLLETIFLKKRFSETIKFSLLVLLLGVGIASVTDLKLNCLGSVLSGLAIATTCVGQILTNTIQRKLKVSSTQLLYQSAPYQAAILFATGPFVDHLLTGRSVFAHRYTFPVVGFIVLSCLIAVSVNFSTFLVIGTTSPVTYQVLGHLKTCLVLSFGYTLLHDPFTVRNILGILVAIFGMALYSIFSVREGKKKSAGDALPVSQMPDKETEPLLATKDNSDTKKANGVAHDC

SEQ ID NO: 5393 - protein, 108 aa, Zea mays
  UNSURE (1)..(108): unsure at all Xaa locations
  Clone ID: PAT_MRT4577_2505C.1.pep
  unsure (1)..(108): unsure at all Xaa locations
MYISVPTMAAKMFWLLMLLGLSASAATATIFPQCSQAPIAILFSPYLXQRCLSACENPILXPYRIQQAITAGILPLXPLVFHISLSLLHQVPLGHLLTHNIRAQQTQQ

SEQ ID NO: 5394 - protein, 89 aa, Zea mays
  UNSURE (1)..(89): unsure at all Xaa locations
  Clone ID: PAT_MRT4577_25172C.1.pep
  unsure (1)..(89): unsure at all Xaa locations
LHASGLPVNKTLKVKGYMGDLCRMDFSKTDFYAFAPPDFYTRFGIVGVKADSVMNKTKXIEDHXLPMLDEEFTFLLSVPELSFLWVEVQ

SEQ ID NO: 5395 - protein, 70 aa, Zea mays
  UNSURE (1)..(70): unsure at all Xaa locations
  Clone ID: PAT_MRT4577_25345C.1.pep
  unsure (1)..(70): unsure at all Xaa locations
RDGAHAVPSPERGEMDEVVYADPDTEAEDQDERWARLLPELLCDVVRRVXASGGERWPARKDVDSCACLC

SEQ ID NO: 5396 - protein, 92 aa, Zea mays
  Clone ID: PAT_MRT4577_25349C.1.pep
HIESNARAHMHEDSVLGATTNHRAAQASWSTGQQAQRRHGARLHVDQCRQPTPRPRARPRRHEAPARELTGCMGPLDEHGGAGMAGPQFQPA

SEQ ID NO: 5397 - protein, 208 aa, Zea mays
  Clone ID: PAT_MRT4577_25500C.1.pep
MDPMQSSVRGRRSSLHADAVITIGGVRPAPPPQTSTQHVCQDEAMVSSGDPSWMSGYSTDSCRGGYYTSALNLEGASIRELKLKYQKLKYRNKPNNCNADDHVNAERSPGRKAEEKKVLARKHEDCDDDPFIEEVKKTREAHQEIERDRKARDDKFYELEKIKLDLKRDRLDTMIMQTDTSAMDSEAKQYFKLMKEEILARRFKSRKA

SEQ ID NO: 5398 - protein, 503 aa, Zea mays
  Clone ID: PAT_MRT4577_25719C.1.pep
MDRADPARGRLAVLSSHLRGAGAEEAAGLERSPVSAPAPGPRAGALAVVDGRTGKRHEVKVSEDGTVRATDFKKITTGKDDKGLKIYDPGYLNTAPVRSSICYIDGDEGILRYRGYPIEELAESSSFVEVAYLLMYGNLPTQSQLAGWEFAISQHSAVPQGLLDIIQSMPHDAHPMGVLASAMSTLSVFHPDANPALQGQDLYKSKQVRDKQIVRVLGKAPTIAAAAYLRLAGRPPVLPLNTLSYSENFLYMLDSLGDRTYKPNPRLARALDILFILHAEHEMNCSTAAVRHLASSGVDVFTALSGGVGALYGPLHGGANEAVLKMLNEIGSMENIPDFIVGVKNRKRKMSGFGHRVYKNYDPRAKVIRKLADEVFSIVGRDPLIEVAIALEKAALSDEYFIKRKLYPNVDFYSGLIYRAMGFPTEFFPVLFAIPRMGGWLAHWKESLDDPDTKIIRPQQVYTGFWLRHYTPVRERVLSSQSEELGQVATSNATRRRRAGSAL

SEQ ID NO: 5399 - protein, 212 aa, Zea mays
  UNSURE (1)..(212): unsure at all Xaa locations
  Clone ID: PAT_MRT4577_25837C.1.pep
  unsure (1)..(212): unsure at all Xaa locations
FVLEVRNVIGDRGLEVVGDTCKKLRRLRIERGDDDPGLQEEQGGVSQLGLTAVAVGCRDLEYIAAYVSDITNGALESIGTFCKNLYDFRLVLLDRQKQVTDLPLDNGVRALLRSCTKLRRFALYLRPGGLSDTGLDYIGQYSGNIQYMLLGNVGESDHGLIRFAIGCTNLRKLELRSCCFSEQAXSLAVLHMPSLRYIWVQGYKASPAGLEL

SEQ ID NO: 5400 - protein, 47 aa, Zea mays
  Clone ID: PAT_MRT4577_25961C.1.pep
TLLSHEFGGGLDMPSNPLKELHQPPPGPLYGGLGGKPKKAEVGHMFL

SEQ ID NO: 5401 - protein, 74 aa, Zea mays
  UNSURE (1)..(74): unsure at all Xaa locations
  Clone ID: PAT_MRT4577_25984C.1.pep
  unsure (1)..(74): unsure at all Xaa locations
MAAKICWLLVLLGLSVSAATATXIFPECSQAPIASHLRPXLSTTVSSVCENPDLQGYRIQQAIESGMLPLSALF

SEQ ID NO: 5402 - protein, 60 aa, Zea mays
  Clone ID: PAT_MRT4577_26014C.1.pep
LRIFFRSLVVWGSRSPPSNVISRCGFPPCLFGYLPVPSARVSETAPFFSFSLEQADPDCD

SEQ ID NO: 5403 - protein, 80 aa, Zea mays
  UNSURE (1)..(80): unsure at all Xaa locations
  Clone ID: PAT_MRT4577_26151C.1.pep
  unsure (1)..(80): unsure at all Xaa locations
MAAPMVYSXYLLQVYRSRLLLRALISNKGCSPIMLLLACHDAETYYLNTKTGGANGSIRYXKXYTHGSYAGLXIAIDLLD

SEQ ID NO: 5404 - protein, 79 aa, Zea mays
  UNSURE (1)..(79): unsure at all Xaa locations
  Clone ID: PAT_MRT4577_26217C.1.pep
  unsure (1)..(79): unsure at all Xaa locations
GERIEMASXDVEYRCFFSCLAWTTDDHSMHNAFSTYSEVLDSKIIIDRETHRSRGFGFGTXFSTQEXIQNAIQVLNMTE

SEQ ID NO: 5405 - protein, 123 aa, Zea mays
  UNSURE (1)..(123): unsure at all Xaa locations
  Clone ID: PAT_MRT4577_26254C.1.pep
  unsure (1)..(123): unsure at all Xaa locations
LESKIILDRXTQRSRGXGVGTFSTXEAMPNAIEGMNSKELDGRNITVNEAQSRGYRGGDRCGRYGGRRGGGRYGDGWRHDSGDGYSGGGGYRDGCGGYGGGGRVYMSNNRGGGYRNSNWNWRN

SEQ ID NO: 5406 - protein, 647 aa, Zea mays
  Clone ID: PAT_MRT4577_26256C.1.pep
MSRDLDCPVQTQMAVAVLDRSFSSEYPGGSRTEGRQLSWKRVFVQTDNGSVLGIELERGENVQTVKKKLQIALNVPTDESSLTFGDLVLNDDLSSIRNDSPLLLKRNQIHRSNSTPCLSPTGQDVWQRDRSGPIEILGCSSPSSRMKQIAKDVIKAIMNGVDPVAINSGMGGAYYFKNIWGERVAIVKPTDEEPFAPNNPKGFVGKALGQPGLKRSVRVGETGFREVAAYLLDYDHFANVPPTMLVKITHTIFNVNDCVGCKSKVFCNKSESVSKIASLQEFIPHDFDASDHGTSSFPVSAVHRIGILDIRIFNTDRHAGNLLIKKVGPGADNFGEQTELIPIDHGLCLPECLEDPYFEWIHWPQSSVPFSVEELEYIAKLDPIKDAEMLRVELPMIREACLRVLVLSTVFLKEAAAFGLCLSEIGDMMSRQFTAKEEEPSQLELLCMETRKWVEERELFLPDEAGVEDGDDDFTQFPLDSDAFEPPAFCKFGSVKTSSRNPLSKLDECDEEDGDLSEEEGEHGDVLTSGALPQKVPPISKLSSSMKGLGFIGKSKPYRTGGVPKGKVTGRTNYSGKASEHQSGSRSANELLPPSASFVKLSDMSRKEWSAFLEKFQELLPSALRTRKHSAGVGQRPMPRLGTSCQF

SEQ ID NO: 5407 - protein, 369 aa, Zea mays
  Clone ID: PAT_MRT4577_26477C.1.pep
MEGGRDVFLGAAARAPPPPPSCPFHGSATATRSGGAQMLSFSSNGVAGLGLCSGASKMQGVLSRVRRPFTPTQWMELEHQALIYKHFAVNAPVPSSLLLPIKRSLNPWSSLGSSSLGWAPFRSGSADAEPGRCRRTDGKKWRCSRDAVGDQKYCERHIKRGCHRSRKHVEGRKATPTTADPTMAVSGGSLLHSHAVAWQQQGKSSAANVTDPFSLGSNRNLLDKQNLGDQFSVSTSMDSFDFSSSHSSPNQAKVAFSPVAMQHEHDQLYLVHGAGSSAENVNKSQDGQLLVSRETIDDGPLGEVFKGKSCQSASADILTDHWTSTRDLRPPTGVLQMSSSNTVPAENHTSNSSYLMARMANSQTVPTLH

SEQ ID NO: 5408 - protein, 472 aa, Zea mays
  Clone ID: PAT_MRT4577_2654C.1.pep
MVASKAAPFDEVSSVEAGAYGGRDDDGRPRRTGTVWTASAHIITAVIGSGVLSLAWAIAQLGWAAGPAVMLLFAVVIYYTSTLLAECYRSGDPVAGKRNYTYMDAVRASLGGAKVRLCGAIQYANLFGVAIGYTIAASISMLAIKRADCFHAKGHKHACRSSSNPYMILFGVAEVVFSQIPDFDQIWWLSIVAAVMSFTYATIGLVLGIMQTVANGGFQGSLTGISIGAGVTPTEKVWRSLQAFGNIAFAYSYSIILIEIQDTVKAPPPSEAKVMKRATMVSVATTTVFYMLCGCMGYAAFGDAAPDNLLTGFGFYEPFWLLDIANVAIVVHLVGAYQVFCQPLFAFVEKWAAATWPDSAFIAREFRVGPFALSLFRLTWRTAFVCLTTVAAMLLPFFGDVVGLLGAVSFWPLTVYFPIEMYVVQRAVRRWSTHWICLQMLSAACLLVSVAAAAGSIADVIGALKVYRPFSG

SEQ ID NO: 5409 - protein, 55 aa, Zea mays
  UNSURE (1)..(55): unsure at all Xaa locations
  Clone ID: PAT_MRT4577_2657C.1.pep
  unsure (1)..(55): unsure at all Xaa locations
GKCDFDLAATFYXSVVYLVVEXDMQFALALETNSGPHQIRSCDGDGIDRFDNLTI

SEQ ID NO: 5410 - protein, 165 aa, Zea mays
  UNSURE (1)..(165): unsure at all Xaa locations
  Clone ID: PAT_MRT4577_26641C.1.pep
  unsure (1)..(165): unsure at all Xaa locations
MASSTMALSSTAFVGXVVNVSSSFVFGEARVXTMRKTGXRPSXALSSGRPWYXGPDRVLYLGPLCEDAASYLTDEFPGDYGWDTAVLSVDPETFAKNRELEVIHSRWAMLGAIGCVFPEMLVRNGVKFGEGVWFKAGSQIFREGGLDYLGNTNLIHADNILAIWA

SEQ ID NO: 5411 - protein, 87 aa, Zea mays
  Clone ID: PAT_MRT4577_26783C.1.pep
GGGGPLYVGGGFGGGGGASGGAGGSGGGGGGFGGGNRGGGFGNSHGNWRNLPVGPARPSFLFSSRDVSPSPKGLSSFVSFVVAPLCF

SEQ ID NO: 5412 - protein, 70 aa, Zea mays
  Clone ID: PAT_MRT4577_2697C.1.pep
YPVRNKNVYPSQEGLSSLVSCLMFPICVFDCKVPLCQLIELCSSSVSEDPCIKQHGLRIDGCCYPRQALF

SEQ ID NO: 5413 - protein, 654 aa, Zea mays
  Clone ID: PAT_MRT4577_26995C.1.pep
MDGCDCIEPLWPTDDLLVKYQYISDFFIALAYFSIPLELIYFVKKSSFFPYRWVLIQFGAFIVLCGATHLINLWTFTTHTKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRSGSSLQLSHTLRHQITVGSSVPMNLPVVNQVFSSNRAIIIPHTSSLARVRPLAGRYVPPEVAAVRVPLLHLSNFQINDWPELSAKSFAIMVLMLPSDSARKWHVHELELVEVVADQVRAVSFAMVTITYYFHPEKDVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDEHFYLKVQVKDTGCGVSPQDLPHVFTKFAHPQSGGNRGFNGSGLGLAICKRFVSLMGGHIWIDSEGTGRGCTATFVIKLGVCDNTNTYQQQLIPLVWPSSADSDLRAPKALPDGRGSTPLKSRYQRSV

SEQ ID NO: 5414 - protein, 634 aa, Zea mays
  Clone ID: PAT_MRT4577_26996C.1.pep
MDGCDCIEPLWPTDDLLVKYQYISDFFIALAYFSIPLELIYFVKKSSFFPYRWVLIQFGAFIVLCGATHLINLWTFTTHTKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRSGSSLQLSHTLRHQITVGSSVPMNLPVVNQVFSSNRAIIIPHTSPLARIRPLTGRYVPPEVAAVRVPLLHLSNFQINDWPELSAKSFAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDDHFYLKVQVKDTGCGIGPQDLPHVFTKFAHPQSGGNRGFNGSGLGLAICKRFVSLMGGHIWIDSEGTGRGCTATFVVKLGVCDNTNTYQQQLIPLVWPSSADSDLRAPKPLPDGRGSTPLKSRYQRSV

SEQ ID NO: 5415 - protein, 127 aa, Zea mays
  UNSURE (1)..(127): unsure at all Xaa locations
  Clone ID: PAT_MRT4577_27161C.1.pep
  unsure (1)..(127): unsure at all Xaa locations
MAAKMVWLLMLLGLSASAATATIIPPCSHAPIASLLSPHLLPAXTSACENPIXLNHYRIQQAISDGILTLXPSIIQQSSTLLQQIPLVHLLAQNIRAQLLQQLVLANLAAYSQQQQFLPFNQLSSLN

SEQ ID NO: 5416 - protein, 75 aa, Zea mays
  UNSURE (1)..(75): unsure at all Xaa locations
  Clone ID: PAT_MRT4577_27290C.1.pep
  unsure (1)..(75): unsure at all Xaa locations
MATTDVKYRCFDGGLAWATSNEALDNAFASYGEILDSKVITDRXTGRSRGYSYVTFTSENFMLDAIENMNGKELD

SEQ ID NO: 5417 - protein, 89 aa, Zea mays
  UNSURE (1)..(89): unsure at all Xaa locations
  Clone ID: PAT_MRT4577_27305C.1.pep
  unsure (1)..(89): unsure at all Xaa locations
MAAKISCLVRLLGLSASPTTSTILPQCSQATITNLLPPYLSPTVSSVYENPILQPYTIQHSIATCILPLSPXFLQQSSILLQHLHSYHL

SEQ ID NO: 5418 - protein, 68 aa, Zea mays
  UNSURE (1)..(68): unsure at all Xaa locations
  Clone ID: PAT_MRT4577_27312C.1.pep
  unsure (1)..(68): unsure at all Xaa locations
MALFVKKTSSGRDSKVKDLSQADFVRLKIDLPXVKMPALMACRPKFGPSKPFAGPRISGSFHMTIQTA

SEQ ID NO: 5419 - protein, 43 aa, Zea mays
  Clone ID: PAT_MRT4577_27575C.1.pep
REEIRGDQEDQRRRAQPPRYGGSEAPRDHRRRSGSHGGGIRVT

SEQ ID NO: 5420 - protein, 294 aa, Zea mays
  UNSURE (1)..(294): unsure at all Xaa locations
  Clone ID: PAT_MRT4577_27638C.1.pep
  unsure (1)..(294): unsure at all Xaa locations
MGGAQFPGDNDVAEVDAARDGEVDRRDVGKMKHGCEHYRRRCKIVAPCCNQVFPCRHCHNEATASGDRHTICRQDVEKVVCLLCETKQPVSQVCISCGVNMGEYFCDICKFYDDDTDKGQYHCIDCGICRVGGKENFFHCVKCGSCYSVILRDNHQCVENSMRQNCPXICYEYLFDSLQGTRVLNCGHTMHLTCFEEMVAHNKYTCPICSKNXLDLTHHWEMLDQEIEATIMASCVSXKIWVLCNDCNKVSEVNFHVIGHKCSHCRSYNTRTTSRPADLSGSSSPSTDSSDNNI

SEQ ID NO: 5421 - protein, 205 aa, Zea mays
  UNSURE (1)..(205): unsure at all Xaa locations
  Clone ID: PAT_MRT4577_27663C.1.pep
  unsure (1)..(205): unsure at all Xaa locations
MADKILGLLRLLXLSASAATATIFPQCXQATIAFLLPPXLTNGGLXVCENPNLQPYRIQQAXIKGGVIPLSRLCLQQTXPMXQQIPLGHLLQHNIRAQQLQQLVLANLAAYSQQQQILAFNQLAXLDSASYFQQQQLRFSLVSAVYPQLFLALNRLTALNSRAYLQEQRLLPLSQIGGVSPATFLTQPQLMSFXQHAEPNAGTLL

SEQ ID NO: 5422 - protein, 400 aa, Zea mays
  Clone ID: PAT_MRT4577_27700C.1.pep
MAVLSAADASPVSAIGFEGYEKRLEITFSEAPVFVDPHGRGLRALSRAQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNCYFGVLKSGGNAYVIGDPARPGQKWHVFYATEYPEQPMVNLEMCMTGLDKKKASVFFKTNADGNTTCAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKARVLDE

SEQ ID NO: 5423 - protein, 400 aa, Zea mays
  Clone ID: PAT_MRT4577_27701C.1.pep
MAVLSAADASPVSAIGFEGYEKRLEITFSEAPVFVDPHGRGLRALSRAQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHVFYATEYPEQPMVNLEMCMTGLDKKKASVFFKTNADGNTACAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKAGVLDE

SEQ ID NO: 5424 - protein, 70 aa, Zea mays
  Clone ID: PAT_MRT4577_27715C.1.pep
MGGDDVEYRCFLSSLAWATSNESLDNAFGCYGEILDSKVITDRQTSRSRGFGLHNFYFENSMLDAIENMN

SEQ ID NO: 5425 - protein, 413 aa, Zea mays
  Clone ID: PAT_MRT4577_27770C.1.pep
FLEQLLASLANHIDRWGYPATTWCKFRHADAAGEPTVVTVSCPDVFWLLPRGRRPVAVPWDLLKDRLLQLCPVAPPFGFGSHDAYLAAAAGLQDVPPPAPQLFLLKLCCFDRMGLLHDVTRVLCELELTIRRVKVSTTPDGSVLDLFFITDARGLLHTKSRREETQDRLESVLGDSLTCCEIDPAGEDMVSCCLQSWAWASLTPAVIAQMFSTADRVEEQPIGTRGGGGGTIISVTMDNSLSPAHTLIQIQCGDHKGLLYDVMRIVKDCNIQISYGRFYASQNGRCEIDLFAVQSDGKKILDQHRQRALCCRLRMELRRPLHVALVNRGPDTELLVANPVEVSGKGRPLVFYDITLALKNLQRRIFLAEIGRHVVEGREWEVYRLHFGEEHELSSALRKKIVDAVTNMLMGWD

SEQ ID NO: 5426 - protein, 46 aa, Zea mays
  Clone ID: PAT_MRT4577_2779C.1.pep
IGRMSKPKEISGWLLRAVGVSSRLKPLHASGRSSVNNAVANGSVIH

SEQ ID NO: 5427 - protein, 162 aa, Zea mays
  Clone ID: PAT_MRT4577_28038C.1.pep
MAPIAVGDALPDGQLGWFDENDQLQQVSVHALAAGKKVILFGVPGAFTPTCSNQHVPGFITQAEQLKAKGVDEILLISVNDPFVMKAWAKTYPENKHVKFLADGSGAYTKALDLELDLTDKGLGVRSKRFALLADDLTVTVANIEEGGQFTISGAEEILKAL

SEQ ID NO: 5428 - protein, 162 aa, Zea mays; identical to SEQ ID NO: 5427
  Clone ID: PAT_MRT4577_28039C.1.pep

SEQ ID NO: 5429 - protein, 133 aa, Zea mays
  UNSURE (1)..(133): unsure at all Xaa locations
  Clone ID: PAT_MRT4577_28064C.1.pep
  unsure (1)..(133): unsure at all Xaa locations
MAAKMFCLLMLLGFCASAATATIHPQCSEATIPRLLSPLLSQSRLRACENPSVQPYRIQQAITAGIXPLSPLFLSTXSGLLHKLPLVHXLEQNMRQQQLQQHVLANLAGYSHEQQVLXPLNQLAELNYAYYSK

SEQ ID NO: 5430 - protein, 370 aa, Zea mays
  Clone ID: PAT_MRT4577_28160C.1.pep
MAMMVDPPNGIGNQGKHYYSMWQTLFEIDTKYVPIKPIGRGAYGIVCSSINRETNEKVAIKKIHNVFDNRVDALRTLRELKLLRHLRHENVIALKDIMMPIHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMSEADLEFIDNPKARRYIKSLPYTPGVPLVSMYPHAHPLAIDLLQKMLIFDPTKRISVTEALEHPYMSPLYDPSANPPAQVPIDLDIDENISSEMIREMMWQEMLHYHPEVATAISMS

SEQ ID NO: 5431 - protein, 228 aa, Zea mays
  UNSURE (1)..(228): unsure at all Xaa locations
  Clone ID: PAT_MRT4577_28161C.1.pep
  unsure (1)..(228): unsure at all Xaa locations
MAMMVDPPNGIGNQGKHYYSMWQTLFEIDTKYVPIKPIGRGAYGIVCSSINRETNEKVAIKKIHNVFDNRVDALRTLRELKLLRHLRHENVIALKDIMMPIHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDXYGTSIDVWSGWCIFAELL

SEQ ID NO: 5432 - protein, 370 aa, Zea mays
  Clone ID: PAT_MRT4577_28162C.1.pep
MAMMVDPPNGIGNQGKHYYSMWQTLFEIDTKYVPIKPIGRGAYGIVCSSINRETNEKVAIKKIHNVFDNRVDALRTLRELELLCHFRHENVIALKDIMMPIHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMSEADLEFIDNPKARRYIKSLPYTPGVPLVSMYPHAHPLAIDLLQKMLIFDPTKRISVTEALEHPYMSPLYDPSANPPAQVPIDLDIDENISSEMIREMMWQEMLHYHPEVATAISMS

SEQ ID NO: 5433 - protein, 381 aa, Zea mays
  Clone ID: PAT_MRT4577_2836C.1.pep
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSVMRAALECCHKGWGTSVIVGVAASGQEIATRPFQLVTGRVWKGTAFGGFKSRTQVPWLVDKYMKKEIKVDEYITHNMNLADINDAFHLLHEGGCLRCVLAMQI

SEQ ID NO: 5434 - protein, 170 aa, Zea mays
  UNSURE (1)..(170): unsure at all Xaa locations
  Clone ID: PAT_MRT4577_28380C.1.pep
  unsure (1)..(170): unsure at all Xaa locations
MDSHRLVXDXIPDGQXLRWIDENDHLQQVSVHALAAGKKVILFCVPGAFTPTCSNQHGPGFVTQAEQLXAKVVDEILLISVXDTFVMKAWANTYPENKHVKFLADGSVAYTKALDLELNLTDKGLGARSKRFALLADDLTVIGANIXEGAQDYISDAEEILKALYRLRLL

SEQ ID NO: 5435 - protein, 224 aa, Zea mays
  Clone ID: PAT_MRT4577_2855C.1.pep
MDHAAEAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEVILTHPHIKIPNKGKIYSVNEGNARNWDA

SEQ ID NO: 5436 - protein, 49 aa, Zea mays
  Clone ID: PAT_MRT4577_28783C.1.pep
VVLNSVVASVRTCDRFSEVTVCVSIYTAKSQFVPMDHGKQQGARRRAAG

SEQ ID NO: 5437 - protein, 137 aa, Zea mays
  Clone ID: PAT_MRT4577_28843C.1.pep
AKDLKEGENIQSRLIDMTDGGCDYTFDCTGNVHVMRSALEACHKGWGESIIIGVAAAGQEISTRPFQLVTGRVWKGCAFGGVKGRSQMGQLVQDYMDNKLKVDEFITHRQPLGGINEAFHDMHAGDCIRCVVDMRKV

SEQ ID NO: 5438 - protein, 72 aa, Zea mays
  Clone ID: PAT_MRT4577_28858C.1.pep
WDSYAWPLLNTKKLGTQPCDSFSAVAKLRNGVFVKKPTCVSFPVVAKPREGVFWNYKPPEKKDWCFQPANAS

SEQ ID NO: 5439 - protein, 80 aa, Zea mays
  UNSURE (1)..(80): unsure at all Xaa locations
  Clone ID: PAT_MRT4577_28915C.1.pep
  unsure (1)..(80): unsure at all Xaa locations
MDPYMHAASNESNYSXWTTNSGARVWNNNYVLTVGQRRAILLEDYHLIEKLAHVHRQRIPERVVHAQXDSANGFFEGTHD

SEQ ID NO: 5440 - protein, 562 aa, Zea mays
  Clone ID: PAT_MRT4577_29116C.1.pep
MADVHEPLVRRKRKKVLVDYLVKFRWILVIFVVLPISTLIYFNIFLGDMWSAMKSEKKRQKQHDENVQKVVKRLKQRNPKKDGLVCTARKPWIAVGMRNVDYKRARHFEVDLSSFRNILEIDKERMVAKVEPLVNMGQITRATCPMNLALAVVAELDDLTVGGLINGYGIEGSSHLYGLFSDTVVAMEVVLADGRVVRATKDNEYSDLFYGIPWSQGTLGFLVSAEIKLIPIKEYMKLTYTPVKGGLKEIAQAYADSFAPRDGDPAKVPDFVEGMVYTESEGVMMTGVYASKEEAKKKGNKINCVGWWFKPWFYQHAQTALKRGEFVEYIPTREYYHRHTRCLYWEGKLILPFGDQFWFRFLLGWLMPPKVSLLKATQGEAIRNYYHDNHVIQDMLVPLYKVGDALEFVHREMEVYPLWLCPHRLYKLPVKTMVYPEPGFEHQHRQGDTSYAQMFTDVGVYYAPGAVLRGEEFNGAEAVHRLEQWLIENHSYQPQYAVSELNEKDFWRMFDASHYEHCRQKYGAVGTFMSVYYKSKKGRKTEKEVQEAEAAILEPAYADEEA

SEQ ID NO: 5441 - protein, 102 aa, Zea mays
  Clone ID: PAT_MRT4577_29121C.1.pep
MDGGAKVVKNASAARGGWGGPKKKPGSRSMKACLHFPVRRIGRYLKHGRYYQRVRTRARVYLAAVLEYLGDELLELAANATRDNKKNRIMPRHILMAIRTDY

SEQ ID NO: 5442 - protein, 181 aa, Zea mays
  UNSURE (1)..(181): unsure at all Xaa locations
  Clone ID: PAT_MRT4577_29151C.1.pep
  unsure (1)..(181): unsure at all Xaa locations
MMLANKLGGLLKNATSSNMSVYQAIRCMSSSKLFVGGLSYGTDDHSLRDEFAKYGQVIEAKIILDRESGRSRGFGFITYTSSEEASAAITAMDGKTLDGRNIRVNHANGRTDQASSCMSSKLFGGWYGGGGXGGYGGGGGYGGGXNRGXYGGGDYGGNRNRGGGGDYGVAGXRWRHLYCWR

SEQ ID NO: 5443 - protein, 230 aa, Zea mays
  Clone ID: PAT_MRT4577_29152C.1.pep
MSVYQAIRCMSSSKLFVGGISYGTDDHSLRDEFAKYGQVIEAKIILDRESGRSRGFGFVTYTSSEEAAAAITALDGKTLDGRSIRINHANEKTGGFRGGGGYGGGGYGGGGGYGGGGGHYGGGGGSGGYGGGDYGGNYSNRGGGDDYEVAGGGGGTFTAGGSDSFANSNFGSDSSFGGNGAGGFDATGGSTGDDGFSGTPDDNFGGNKNEEAMDDIFKDDEPDSYADKRS

SEQ ID NO: 5444 - protein, 170 aa, Zea mays
  Clone ID: PAT_MRT4577_29288C.1.pep
ECLLVLAEAGPDGIVFETIPNKLEAQAYVELLDECNISIPAWFSFNSKDGVHIVSGDSLIECATIANGCSKVGAVGINCTPPRFIHGLILFIRKVTDKPILIYSNSGERYDAEKKEWVESTGVSDGDFVSYVNEWCKDGAVLIGGCCRTTSNTIKAISRSLNQRHSSLIY

SEQ ID NO: 5445 - protein, 61 aa, Zea mays
  UNSURE (1)..(61): unsure at all Xaa locations
  Clone ID: PAT_MRT4577_29321C.1.pep
  unsure (1)..(61): unsure at all Xaa locations
MAIKPTMAXNKIGYDKKLRSLLDEYTKVLIALADNVGSKQVHNIRPGLMDDSVVLMGKNTL

SEQ ID NO: 5446 - protein, 64 aa, Zea mays
  UNSURE (1)..(64): unsure at all Xaa locations
  Clone ID: PAT_MRT4577_29410C.1.pep
  unsure (1)..(64): unsure at all Xaa locations
MEQTFIMIKPDGVQLSLIADIISLLXKKGFYLKGMKIMNVERSFTQQQYADLADXPVFRGLVEN

SEQ ID NO: 5447 - protein, 125 aa, Zea mays
  UNSURE (1)..(125): unsure at all Xaa locations
  Clone ID: PAT_MRT4577_29677C.1.pep
  unsure (1)..(125): unsure at all Xaa locations
QHTKHTSVPALAAGPYCLHMLLGLXSASAATATMFPQCXSQAPIAALRAPYLSPAESXLCENPVVEPYRIHHAVTAXILPLSPLLLRQSSVLLHQLPLVHXLAHIIKAQQLRHLVLANLAAYCQE

SEQ ID NO: 5448 - protein, 175 aa, Zea mays
  UNSURE (1)..(175): unsure at all Xaa locations
  Clone ID: PAT_MRT4577_29685C.1.pep
  unsure (1)..(175): unsure at all Xaa locations
MRSFGKTHKSNGYFKXFQEKFTRRRAGKTDYRFRIRLINLDKNKYNTPXTDLLRDLPDKDITAQIISASIARDMALASAYSHEVPRYGLEVGLTNYAAAYCTGLLMARRVLETRGLDKEYERYVEDTGEDFSVEPTDERMPFRALLNDDLIRTTTDKRDFVALKGCLDGGLGICH

SEQ ID NO: 5449 - protein, 247 aa, Zea mays
  Clone ID: PAT_MRT4577_29912C.1.pep
MADLQTPLVRPKRKKVLVDYLVQFRWILVIFVVLPASALIYFNIYLGDMWSAMKSEKKRQKEHEDNVQKVVKRLKQRNPKKDGLVCTARKPWIAVGMRNVDYKRVRHFEVDLSAFRNILEIDPERMVAKVEPLVNMGQISRATCPMNLSLAVVAELDDLTVGGLINGYGIEGSSHIYGLFSDTVVALEIVLADGRVVRATKDNEYSDLFYGVPWSQGTLGFLVSAEIKLIPIREYMRLTYTPVKGPL

SEQ ID NO: 5450 - protein, 446 aa, Zea mays
  Clone ID: PAT_MRT4577_29971C.1.pep
MMSRQCANRIFLTGGSSFLHGLKSRVASSRSHGTVRLNWRCVRTNLWRAERLGVKATPSEHIIAVLQASDIFSGIRKWSKLQLVAMTGVMACVVLVVPSSDAVDALKTCTCLLKECRIELAKCIANPSCAANVACLNTCNNRPDETECQIKCGDLFENSVVDEFNDCAVSRKKCVPKKSDVGEFPVPDPSSLVKSFNMADFNGKWYISSGLNPTFDTFDCQLHEFHVEGDKLIANITWRVRTPDSGFFTRSTVQRFVQDPSQPGILYNHDNEFLHYQDDWYIISSKVENKDDDYIFVYYRGRNDAWDGYGGSVLYTRSKTVPETIIPELERAAKSVGRDFSTFIMTDNTCGPEPPLVERIEKTVVEGEKTIVREVKEIEEEVEELEKEEASLFQKLAEGLMEVKQDFMNFLQGLSKEEMELLDQLNMEATEVEQVFSRALPLRKLR

SEQ ID NO: 5451 - protein, 109 aa, Zea mays
  UNSURE (1)..(109): unsure at all Xaa locations
  Clone ID: PAT_MRT4577_29996C.1.pep
  unsure (1)..(109): unsure at all Xaa locations
VGLILPCPTNSNRSGCAAPRAGGGDGILDIAWAFDGMIFILDYCTAGISGVHINPSVTFGLFLARKVSLVRALLYIVAQCLGAICGVCLVKGLQSAYYVRYGCXRNELS

SEQ ID NO: 5452 - protein, 214 aa, Zea mays
  Clone ID: PAT_MRT4577_30206C.1.pep
MWRGGSTAASAARALRSRLLLDPIHHPATSLAPIASARTSSSSTPSTAAANTIVEEAAAAVSVSQHTGSISDSLRHYGKCYWELSKARLSALVVATSGAGYVLGSGNIVDIAGLCCTCAGTMMVAASANTLNQVFEIKNDAKMKRTMRRPLPSGRISPAHAAMWATSVGVAGTALLAWKANGLAAGLAASNLVLYAFVYTPLKQIHPGNTWVGA

SEQ ID NO: 5453 - protein, 462 aa, Zea mays
  UNSURE (1)..(462): unsure at all Xaa locations
  Clone ID: PAT_MRT4577_30207C.1.pep
  unsure (1)..(462): unsure at all Xaa locations
MHAYVSSLGGPAGSPFPPGQSATHRASSSPQPAPAAAMWRGGATTAFVARALRSRLLLDPIHHPVTSLAPISSARTSSSSTSSTAAANTIVEEAAAVAAVSVSQHTGSISDALRHYGKCYRELSKVRLSALVVATSGAGYVLGSGNIVDIAGLCCTCAGTMMVAASANTLNQVFEIKNDAKMKRTMRRPLPSGRISPAHAAMWATSVGVAGTALLAWKANGLAAGLAASNLVLYAFVYTPLKQIHPVNTWVGAVVGAIPPLLGWAAASTELSLNAMILPAALYFWQIPHFMALAYLCRNDYLAGGYRMFSFADPTGRRTAWVSLRNCLYMLPLGLFAYNWGLTSEWFSFEASILTLGLTIASXFICSDVLEPSPKTARXYGSLLYLPAFMSGLXLHXLPSEHKAHDLAEKNELDGVLXGADLQDEERARQKRQDXARVQSRPPVSYASVAPFPFLPVPIYES

SEQ ID NO: 5454 - protein, 50 aa, Zea mays
  UNSURE (1)..(50): unsure at all Xaa locations
  Clone ID: PAT_MRT4577_30429C.1.pep
  unsure (1)..(50): unsure at all Xaa locations
MEXKGGKKSSSSRSMXYEAPLGYSIXDXRPAGGXKKFQSSXYSNFXKKPS

SEQ ID NO: 5455 - protein, 138 aa, Zea mays
  Clone ID: PAT_MRT4577_30483C.1.pep
MAGKGGKGLLAAKTTAAKSTDKDKDRKKAPVSRSSRAGLQFPVGRIHRQLKSRASAHGRVGATAAVYSAAILEYLTAEVLELAGNASKDLKVKRITPRHLQLAIRGDEELDTLIKGTIAGGGVIPHIHKSLINKTAKE

SEQ ID NO: 5456 - protein, 68 aa, Zea mays
  UNSURE (1)..(68): unsure at all Xaa locations
  Clone ID: PAT_MRT4577_3049C.1.pep
  unsure (1)..(68): unsure at all Xaa locations
MDPYKHRPSSGSNYSFWTTKCGAPVWNNNYALTVXTXGPILLEDYHILQKLAQFDRERIPERVVHARR

SEQ ID NO: 5457 - protein, 345 aa, Zea mays
  Clone ID: PAT_MRT4577_30592C.1.pep
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEEATFVDPKLRGRYCVCFDPLDGSSNIDCGVSIGTIFGIYIIKDKDNVTLEDVLQPGKNMLAAGYCMYGSSCTLVLSTGTGVNGFTLDPSLGEFILTHPDIKIPKKGKIYSVNEGNAKNWDAPVAKFVEKCKYPKDGSPPRSLRYIGSMVADVHRTLLYGGVFLYPADEKNPNGKLRILYEVFPMSFLMEQAGGQSFTGKERALDLVPTKIHDRSPIFLGSYDDVEEIKALYAEQAKSSSASS

SEQ ID NO: 5458 - protein, 61 aa, Zea mays
  Clone ID: PAT_MRT4577_30632C.1.pep
PIVSRIKTQHIQVSAIDLSPHALPIADVPSRQRERGMEMMTRILSGARRAVGMSGTAVGAS

SEQ ID NO: 5459 - protein, 180 aa, Zea mays
  UNSURE (1)..(180): unsure at all Xaa locations
  Clone ID: PAT_MRT4577_30763C.1.pep
  unsure (1)..(180): unsure at all Xaa locations
MMLANKLGGLLKNATSSNMSVYQAIRCMSSSKLFVGGLSYGTDDHSLRDEFAKYGQVIEAKIILDRESGRSRGFGFITYTSSEEASAAITAMDGKTLDGRNIRVNHANERTGGFRSSGGYGGGSYGGGGYGGGSGGYGGGGSGDYGGGSGGYGGNYGNRAGGGYGGGGDXGGAGGVYTSL

SEQ ID NO: 5460 - protein, 189 aa, Zea mays
  Clone ID: PAT_MRT4577_30764C.1.pep
MMLANKLGGLLKNATSSKSSNMSVYQAIRCMSSSKLFVGGLSYGTDDHSLRDEFAKYGQVIEAKIILDRESGRSRGFGFITYTSSEEASAAITAMDGKTLDGRNIRVNHANERTGGFRSSGGYGGGGYGGGGGGYGGGGYGGGYGGGSGGYGGGGSGDYGGGSGGYGGNYGNRAGGGYGGGGDYGVAGG

SEQ ID NO: 5461 - protein, 212 aa, Zea mays
  Clone ID: PAT_MRT4577_30766C.1.pep
MMLANKLGGLLKNATSSNMSVYQAIRCMSSSKLFVGGLSYGTDDHSLRDEFAKYGQVIEAKIILDRESGRSRGFGFITYTSSEEASAAITAMDGKTLDGRNIRVNHANERTGGFRSSGGYGGGGYGGGGGGYGGGGYGGGYGGGSGGYGGGGSGDYGGGSGGYGGNYGYRAGGGYGGGEDVSSFRIMFPCPLFAVQVPVITQNVNCSSVFFT

SEQ ID NO: 5462 - protein, 63 aa, Zea mays
  Clone ID: PAT_MRT4577_30805C.1.pep
PPNCTAVFLSHCWNFPLGPLPLKGLLLALLLIPVAPSKKKLLPCRSGKFSQSLDGDDVEIFDQ

SEQ ID NO: 5463 - protein, 163 aa, Zea mays
  UNSURE (1)..(163): unsure at all Xaa locations
  Clone ID: PAT_MRT4577_30807C.1.pep
  unsure (1)..(163): unsure at all Xaa locations
MTPIADGDALPDDQLGWFDENHHLEHVSVHXVAPGKKAILFGVPXGAFTPTXSNQNVRGFITQADQLXAXAVYEILLIRXNDPFTMKAWAKXYPENXHVKITPDGSGAYTKALDLEVDLTDKRLTVPSKRMGLLGDXLTVTAANIEEGGXFTISGAVEILKEL

SEQ ID NO: 5464 - protein, 27 aa, Zea mays
  Clone ID: PAT_MRT4577_30836C.1.pep
ADEGYYVHKRRLELDPSRLLRISLNSG

SEQ ID NO: 5465 - protein, 56 aa, Zea mays
  UNSURE (1)..(56): unsure at all Xaa locations
  Clone ID: PAT_MRT4577_3100C.1.pep
  unsure (1)..(56): unsure at all Xaa locations
MAVTITWVKARQIFDSRGNPTVEVDVGLSDGSYXRGAVPSGASTGIYEALELRDGG

SEQ ID NO: 5466 - protein, 63 aa, Zea mays
  Clone ID: PAT_MRT4577_3101C.1.pep
GWGFFLWGKNAGVKLVFSFLENLGWHLTNSKFGKQKRGGGLLPAQTLFDKQHLEFLQSCFSPP

SEQ ID NO: 5467 - protein, 104 aa, Zea mays
  UNSURE (1)..(104): unsure at all Xaa locations
  Clone ID: PAT_MRT4577_31081C.1.pep
  unsure (1)..(104): unsure at all Xaa locations
LAPPPIPIKQLPGGYPXQFFPFTQWQALNFPVYFNHHQLLPLSKXVGVSPVTFLTQPQWLRFYQHAGPNVGTFLQLQQLLPFNHLVLTNLAVFYQQPIMGGALF

SEQ ID NO: 5468 - protein, 242 aa, Zea mays
  Clone ID: PAT_MRT4577_31087C.1.pep
MRKAYRDSIKVLEADIQHANTLASEFPRDYDGACLQMRLSYSPAAHIFLFLVQWTDCSLAGALGLLRILIYKVYVDGTTTMSTHERKASIKEFYAVIFPSLLQLQRGITDVEDKKQKAVCMEKYRKKDEDGRDTLSDIDVEREEECGICMEMNSKVVLPNCTHAMCIRCYQDWSSRSQSCPFCRDNLKKTCPSDLWIYVEDQDVVDMETVSSENLRRLFMYISKLPLIVPDVIFSVYDSHIK

SEQ ID NO: 5469 - protein, 39 aa, Zea mays
  UNSURE (1)..(39): unsure at all Xaa locations
  Clone ID: PAT_MRT4577_31117C.1.pep
  unsure (1)..(39): unsure at all Xaa locations
GGVTSMNPFVXKFFPQVYRNKQXPDPQYCKYDNQLLQTF

SEQ ID NO: 5470 - protein, 83 aa, Zea mays
  Clone ID: PAT_MRT4577_31126C.1.pep
MAAADVEYRCLFSGLAWGTSNEYLVNALDSYGEILNFKAIINRNTERYGGYSYITFSCKNSMLDAIENMNSMELDCRYITDNQ

SEQ ID NO: 5471 - protein, 107 aa, Zea mays
  UNSURE (1)..(107): unsure at all Xaa locations
  Clone ID: PAT_MRT4577_31337C.1.pep
  unsure (1)..(107): unsure at all Xaa locations
CFLLETTKFPFSQGLAANPKEFFPFNQLEALNFPVYXQKQQLLPFSQLVGVSPVTFLTQPQLLPFYQPVAPNVGTLLQLQQLLPFNQLVLTNPAVFYQQPIIGGALF

SEQ ID NO: 5472 - protein, 231 aa, Zea mays
  Clone ID: PAT_MRT4577_31410C.1.pep
MPAAMAAAAAQRLLAASTKIIGVGRNYIAHAKELGNPVPKEPVLFLKPTSSFLHAGVATAAVEIPEPLESLHHEVELAVVISRRGRDVPEASAMDFVGGYALALDMTARDLQSVAKSAGLPWTLAKGQDTFTPISAVVPKSAVTNPDDLELWLKVDDELRQKGPTSDMLFKIPFLISYISSIMTLMEGDVILTGTPEGVGPVRVGQKITAGITDLIDVEFDVQRRNRSFST

SEQ ID NO: 5473 - protein, 227 aa, Zea mays
  Clone ID: PAT_MRT4577_31412C.1.pep
MAAAAAQKLLEASTKIIGVGRNYIAHAEELGNPIPKEPVLFLKPTSSFLHAGVATAAVEIPEPLESLHHEVELAVVISRRGRDIPEASAMDFVGGYALALDMTARGLQSVAKSAGLPWTLAKGQDTFTPISAVVPKSSVTNPDDLELWLKVDDELRQKGSTSDMIFKIPFLISYISSIMTLMEGDVILTGTPEGVGPVRVGQKIKAGITDLIDVEFDVQRRNRSFST

SEQ ID NO: 5474 - protein, 231 aa, Zea mays; identical to SEQ ID NO: 5472
  Clone ID: PAT_MRT4577_31418C.1.pep

SEQ ID NO: 5475 - protein, 200 aa, Zea mays
  UNSURE (1)..(200): unsure at all Xaa locations
  Clone ID: PAT_MRT4577_31447C.1.pep
  unsure (1)..(200): unsure at all Xaa locations
QPVKEVTNSPQPVKESCRXGGQTKPRXNVITPRVKPEINTHSAPILAGNLPDPSERSWQTKPSSAKLSYKLPMPVDDKDPRSAGAQRPHHSQQLESKPRVSANPWHSSPLTKDFRPGGHVKTPPSAEGASAFSQPVSDFKKMKRQFYSGPMASGPGLSMPSSLNDRRSSAAQAQHLVMPGNLQGLFWQPSSASPKVPPKM

SEQ ID NO: 5476 - protein, 101 aa, Zea mays
  Clone ID: PAT_MRT4577_31461C.1.pep
MAGERFCFLMLLGLSASAGTATIFPQCSQASIASFLAPYLSPAASSACENPILQPYMIQQAIVAGMLHLSPSVLLQPSALLQQLPLVHFFAQNMNAHHLQP

SEQ ID NO: 5477 - protein, 47 aa, Zea mays
  Clone ID: PAT_MRT4577_31624C.1.pep
RTRGKKKKKKKKKKKKKKKKKKKKKKKKKKTKKKKKKKKKKNWGGPF

SEQ ID NO: 5478 - protein, 535 aa, Zea mays
  UNSURE (1)..(535): unsure at all Xaa locations
  Clone ID: PAT_MRT4577_31653C.1.pep
  unsure (1)..(535): unsure at all Xaa locations
MPPPLLEFAILATACRFSKPLTVLRRLGVLGPPTVRRNAAEAFVPSPFRQVVVQSGKLLGTPRFCHTTAGMSECLPDVYASQVLKVLKSTSADNADLSGALHQFAVHMDEDIILMVLQKQRSNWQVALAFFNWAAXLPGYAHGSRAYTEMLDILGRMKKVRHMRQLFDEIPEERRQVVVTNKMFAVLLNRYAGAHKVQEAIEVFYLRKDYGFELDLVGFQILLMSLCRYKHVEEAEALFREKKDEFPHVTKSWNIILNGWCVKGSLRDAQRIWNDIIASKVERDLFTFGTFINALAKNGRISAAVKLFKQMWEKGINPDVAICNCIIDQLCFKKKIPEALEIFGEMNDRLCQADVATYNTLIKYMCKIKRMEKVYELLDDMEAKGCPPNNRTYSYILKTTEKPKDVIALMQRMERTGCKLDSDIYNLILNLYIKWKYEKGMQQIWDEMERRGSGPDQRSFTIMVHGLHSQGKLDEALQYYTTMKSRGMIPEPRTKILVKAMHMKKDGAATEDDSASMAGKHLKLDHRSRLFNVHR

SEQ ID NO: 5479 - protein, 114 aa, Zea mays
  UNSURE (1)..(114): unsure at all Xaa locations
  Clone ID: PAT_MRT4577_32127C.1.pep
  unsure (1)..(114): unsure at all Xaa locations
CTNNGSPVGRLLMLLGPSASTATATIFPHCLHAPIPSLLSPYLSPAWSTECENPFLNPYRIQQAITPGILPLLPLFLHQSXALLHQLPLAHILTQNIRPQHLLQLVLANLDDYS

SEQ ID NO: 5480 - protein, 115 aa, Zea mays
  UNSURE (1)..(115): unsure at all Xaa locations
  Clone ID: PAT_MRT4577_32138C.1.pep
  unsure (1)..(115): unsure at all Xaa locations
FPSFPFFKSKXSDRQVNVPXSFNQKEDKLVLKNKSSKWHEQLQCWCLNFRGRVTGALVKNFQLVASXRTXPKNQESDKVILQFRKIRKNLFTMDYRYPISAFQAFSICLNNFYTK

SEQ ID NO: 5481 - protein, 60 aa, Zea mays
  Clone ID: PAT_MRT4577_32366C.1.pep
RSLPRVITTHRRGDPAISPPWSPATERALRGYPQREEFVRFDLIVKCLIRLTLGCCDVQR

SEQ ID NO: 5482 - protein, 122 aa, Zea mays
  UNSURE (1)..(122): unsure at all Xaa locations
  Clone ID: PAT_MRT4577_32400C.1.pep
  unsure (1)..(122): unsure at all Xaa locations
MSDSEEEHFESKADAGACKTYPEHADTVRKNGFIVIKNLPCKDVEVSTSKTGKHGLATCYFGAIYILNGKKLEDIESSSHNXDIPHVNRTEYXLIDISXDGFVSLLTAHGNTKXDDLRLLTD

SEQ ID NO: 5483 - protein, 71 aa, Zea mays
  Clone ID: PAT_MRT4577_3242C.1.pep
LTHSPRPPHPFLLVARRRRRGIRLQKLLASSARSSHDLTMRLIETWAQCGGAGDPGSSPTESVNTTHYRLL

SEQ ID NO: 5484 - protein, 276 aa, Zea mays
  Clone ID: PAT_MRT4577_32479C.1.pep
MHRDRGVSAAAIPGDRKRIGEPMDRSSPSTSWGFSGGREKERIGVGKQPEMPRSGGGSTAMSKSKLSDAESETDSEESDVSGSDGEDTSWISWFCSLKGNEFFCEVDDDYIQDDFNLCGLSNQVPYYDYALDLILDVESSHGDMLTEEQNELIESAAEMLYGLIHVRYIITSKGLSAMLDKYRNVEFGRCPRVNCSGQPCLPVGQSDVPRSSTVKIYCPRCEDIYTPRSKYLSNIDGTYFGTTFPHLFLMTYPHLKPQKPLQQYVPRVFGFKIRKP

SEQ ID NO: 5485 - protein, 81 aa, Zea mays
  Clone ID: PAT_MRT4577_32699C.1.pep
KIIQRILHNHHAKKKKQEYKLMRISYPNFFYSGILIKKCMYGCWIIDFYQKTKMPTLNLNDLHTAKIQFERIRIGLVIRPF

SEQ ID NO: 5486 - protein, 131 aa, Zea mays
  UNSURE (1)..(131): unsure at all Xaa locations
  Clone ID: PAT_MRT4577_3269C.1.pep
  unsure (1)..(131): unsure at all Xaa locations
DVEYRXFVGGLTWATDDHSLHNAFSTYGEVLKCKIILYRETQRSRGFRLDTFSTEDAMRNAIKGMNGKELDRRNITVNEAQSHSGRGGCGGGYGGGRGRGGYSGSGRRDCSGGYGRGDCYGGGSGYRGGGR

SEQ ID NO: 5487 - protein, 115 aa, Zea mays
  UNSURE (1)..(115): unsure at all Xaa locations
  Clone ID: PAT_MRT4577_3282C.1.pep
  unsure (1)..(115): unsure at all Xaa locations
SGVPATTSRASHAPGELLKLPCDWALISDPELRLYAQLYAXDEYAFLKDYAESHKRLCELGFTXRSTRPSKSDLATVVVLAQIASGVAVAAGTVMAGYLYEASKMVKYRATFFST

SEQ ID NO: 5488 - protein, 227 aa, Zea mays
  Clone ID: PAT_MRT4577_32931C.1.pep
MARRTSYLASRENAALSYGDIASSRAGDASSRENLATSLANNIISRNNDVSGNEAPTSRVGYVNNEFKTPFHSQQILLSPWSNQDNALKVSSFSNRILDQMRSKTVAPPSGVLGSPLKSKSKGKGVVCQRAREEIQVQANARPRDPLDKIPTIPTSIHDSMARVDMLFSTSGNVTKSHSEGSSLRELIKPGRQTMTKFEKMHLFKQIIDLVDRLRNCNAQGFTLQHL

SEQ ID NO: 5489 - protein, 52 aa, Zea mays
  UNSURE (1)..(52): unsure at all Xaa locations
  Clone ID: PAT_MRT4577_33067C.1.pep
  unsure (1)..(52): unsure at all Xaa locations
FLTQQQLWPLYMLAARSVGTLLQLRQVLPFKQXALANPTAFYQHPVMGGALF

SEQ ID NO: 5490 - protein, 478 aa, Zea mays
  UNSURE (1)..(478): unsure at all Xaa locations
  Clone ID: PAT_MRT4577_33348C.1.pep
  unsure (1)..(478): unsure at all Xaa locations
MSSPAVRRVVLLSSLLCAGALGFLPCSHAAAVAPGYVAVSAASFVPSSTCSSPDRVPPHRRNGTSAVLRLTHRHGPCAPSRASSLAAPSVADTLRADQRRAEYILRRVSGXRASAVGLQGXAAVATVPASWGYDIGTLNYVVTASLGTPGVAQTMEVDTGSDLSWVQCKPCAAAPSCYSQKDPLFDPAQSSSYAAVPCGGPVCAGLGIYAASACSAAQCGYVVSYGDGSNTTGVYSSDTLTLSASSAVQGFFFGCGHAQSGLFNGVDGLLGLGREQPSLVEQTAGTYGGVFSYCLPTKPSTAGYLTLGVGGPSGAAPGFSTTQLLPSPNAPTYYVVMLTGISVGGQQLSVPASAFAGGTVVDTGTVVTRLPPTAYAALRSAFRSGMASYGYPTAPSNGILDTCYNFAGYGTVTLPNVALTFGSGATVTLGADGILSFGCLAFAPSGSDGGMAILGNVQQRSFEVRIDGTSVGFKPSSC

SEQ ID NO: 5491 - protein, 164 aa, Zea mays
  Clone ID: PAT_MRT4577_33495C.1.pep
MDASGAGSKAKKGAAGRKAGGPRKKSVSRSVKAGLQFPVGRIGRYLKKGRYAQRVGIGAPVYLAAVLEYLAAEVLELAGNAAKDNKKTRIVPRHVLLAIRNDVELGKLLAGVTIAHGGVLPNINPVLLPKKVAEKASSGGSKESKSPKKAAKSPKKAAKSPKKA

SEQ ID NO: 5492 - protein, 164 aa, Zea mays
  Clone ID: PAT_MRT4577_33496C.1.pep
MDASGAGSKAKKGAAGRKAGGPRKKSVSRSVKAGLQFPVGRIGRYLKKGRYAQRVGTGAPVYLAAVLEYLAAEVLELAGNAAKDNKKTRIVPRHLLLAIRNDVELGKLLSGVTIAHGGVLPNINPVLLPKKVAEKASSGGSKESKSPKKAAKSPKKAAKSPKKA

SEQ ID NO: 5493 - protein, 80 aa, Zea mays
  Clone ID: PAT_MRT4577_33565C.1.pep
KIRVTPVIPEMVRMIQNRSHKILPFTTTRRSRPRAETRKTDSLPSTRPVPRYRHLSGRRATETAARGRNSSNAWVDRESG

SEQ ID NO: 5494 - protein, 76 aa, Zea mays
  Clone ID: PAT_MRT4577_33624C.1.pep
DLQISQGSQCFTVLHALGARPEGPPYITITGLDDSNSGYATGGGLDIIVRTLCDVAHTCGLTLELNAGPAGSHEAE

SEQ ID NO: 5495 - protein, 241 aa, Zea mays
  UNSURE (1)..(241): unsure at all Xaa locations
  Clone ID: PAT_MRT4577_33776C.1.pep
  unsure (1)..(241): unsure at all Xaa locations
MMEGGSRADGRNPNQLRPFTCTGNPLHRAHGSARWAQGDTVVLAAVYGPKPGTRKGENPEKASIEVVWKPKTGQIGRQEREYEMTLKRTLQSICLLTVHPNTTTSVVLQVVGDDGSLMSCAINASCAALAFAGIPMKHLAVAISCGVMDNGVVILDTSRAEEQQARSFAHLVFPNSRKSVEXEGPDTARXEESERGLITCITHGAMSEDDYFNCIERGVMASSRISDFMRKTLQKEVSRDA

SEQ ID NO: 5496 - protein, 73 aa, Zea mays
  Clone ID: PAT_MRT4577_33813C.1.pep
AALFFFFFFFFFFFFFFFFFFFFFFFFFYFFRKNIINIGFIRGKKGGGPQAISLGQGREPIDTWTHIIGRKNN

SEQ ID NO: 5497 - protein, 330 aa, Zea mays
  UNSURE (1)..(330): unsure at all Xaa locations
  Clone ID: PAT_MRT4577_33820C.1.pep
  unsure (1)..(330): unsure at all Xaa locations
PAAAVLQVAGVPAAAVQVAHPLLLSRAPSSIGSMGAVASSAGGARGGDGTVLGDLPENCVAEVLLRLDPLEICRLARLSRTFRGAASGDGVWESKLPRNYARLLAVAAAGDGEGXGRPPRRRRGQSCCPSANVYARLCRRNRFDGGKKEFWLDKGGGGLCMSISSRALSITGIDDRRYWNFIPSDESRFRTVAYLSQIWWFEVRGEVEFFFPEGTYSLFYRIHLGRPFKRLGRRVYSSEHVHGWDMKPVRFQMSTSDGQHVQSKCYLSDPGIWINHHVGDFVVKDSSRPVNIRFAMIQIDCTHTKGGLCVDSVVVKPQHLAQKKAPWTYV

SEQ ID NO: 5498 - protein, 104 aa, Zea mays
  UNSURE (1)..(104): unsure at all Xaa locations
  Clone ID: PAT_MRT4577_33852C.1.pep
  unsure (1)..(104): unsure at all Xaa locations
MRPRRGSHCARSTAIHGALSSITPAAAGPPPAXASKPTNPAPVHHHGHGNPKPDAVAASLRRGAPADARGLRALIKALSSSASSTSTVAAVHAHATKIGLDRER

SEQ ID NO: 5499 - protein, 211 aa, Zea mays
  Clone ID: PAT_MRT4577_33901C.1.pep
MAAKMFALFALLALCATATSATHIPGHLSPLLMPLATMNPWMQYCMKQQGVANLLAWPTLMLQQLLASPLQPCQMPMMMPGMMPPMTMMPMPNMMPSMMVPTMMSPITIASMMPPMMMPNMVSPMMMPSMMPSTMTPSMMPPIMMPSMIPPMMMPSMVSSMIMPNMMTVPQCYSDSISHIIQQQQLPFMFSPTAVAISPMFLQQPFVGAAF

SEQ ID NO: 5500 - protein, 156 aa, Zea mays
  Clone ID: PAT_MRT4577_33903C.1.pep
EAREHRHGRMFALFALLALCATATSATHIPGHLSPLLMPLATMNPWMQYCMMQQGLASLMACPSLMLQQLLALPLQTMPVMMPQMMTPNMMSPLMMPSMMSPMVLPSMMSQMMMPQCHCDAVSQIMLQQQLPFMFNPMAVAISPMFLQQPFVGAAF

SEQ ID NO: 5501 - protein, 216 aa, Zea mays
  UNSURE (1)..(216): unsure at all Xaa locations
  Clone ID: PAT_MRT4577_33904C.1.pep
  unsure (1)..(216): unsure at all Xaa locations
MAAKMFALFALLALXCATATSATHIPGHLSPLLMPLATMNPWMQYCMKQQGVANLLAWPTLMMQQLLASPLQPCQMPMMMPGMMPPMPMMPMPSMMSSMMVPTMMSPMTMASMMPPMMMPSMISPMMMPSMMSSMIMPSMMMPTMMSPMMMTSMIPPMMMPSMVSPMMMPNMMTVPQCYSDSISHIIQQQLPFMLSPTAMAIPPMFLQQPFVGAAF

SEQ ID NO: 5502 - protein, 219 aa, Zea mays
  UNSURE (1)..(219): unsure at all Xaa locations
  Clone ID: PAT_MRT4577_33908C.1.pep
  unsure (1)..(219): unsure at all Xaa locations
MEQGNHIGIAGEKFALVGLLTFCANGNYGNHIPRDLVTILVAMXTMNPWMQYCMKHQGVANLLAXPTLKLHQLLASPLQPCQMPMMMPGMMPPMTMMPMPNMMPSMMVPTMMSPITIASMMPPMMMPNMVSPMMMPSMMPSTMTPSMMPPIMMPSMIPPMMMPSMVSSMIMPNMMTVPQCYSDSILHIIQQQQLPFMFSPTAVAISPMFLQQPFDGAAF

SEQ ID NO: 5503 - protein, 100 aa, Zea mays
  UNSURE (1)..(100): unsure at all Xaa locations
  Clone ID: PAT_MRT4577_33937C.1.pep
  unsure (1)..(100): unsure at all Xaa locations
MAAKIFCLLMLLGLSASAATATIFPQCSQAPIASLLPPYLSPTVSSVCENPILXSYRIQQAISDGILPLSPXTIYYHETYYRXLLLVHLWAQNINAQHLR

SEQ ID NO: 5504 - protein, 328 aa, Zea mays
  Clone ID: PAT_MRT4577_3398C.1.pep
MENSAAAAAERPRLTRAAAKRSAVVTAVAVAAKRKRVALSQLPTLPNAVLGAHDDDDDKPVRKQRLLPAAKPKRRLAVDYIAAVQIDVTPNMRGILIDWLVEVAEELKLVSDTLYLTVSYIDRFLSAKVLNRQKLQLLGVSAMLIASKYEEISPPNVEDFCYITDNTYTKQEVVKMESDILNVLKFEVGSPTAKTFLRMFIRSAQEDNKKYPSLQLEFLGSYLSELSLLDYGLIRSLPSLVAASAVFVARLTLDPHTHPWSKKMQTLTGYKPSELKDCVAAIHNLQLNRTCQSMVAIREKYRQHRFKGVSALLPPVEIPASYFNTLKE

SEQ ID NO: 5505 - protein, 132 aa, Zea mays
  UNSURE (1)..(132): unsure at all Xaa locations
  Clone ID: PAT_MRT4577_34063C.1.pep
  unsure (1)..(132): unsure at all Xaa locations
MGERIEMAASDVDYRCWVRGLTWATDDHSLHXAFSTYGEALEFKIILHRETHRFLRFLGIVTFSTVEAMRNAIEGMTCKELDGRYIPXNEAQSRGGSXGGVGGGYGGGRGGGGHRRWRAPEMAAAATAVAAG

SEQ ID NO: 5506 - protein, 256 aa, Zea mays
  Clone ID: PAT_MRT4577_3412C.1.pep
MSEGKKYLIVLAHHEPKSLNHSFAQRAQQVLTAAGNEVKLIDLHAVNFNPVSDRRNFKTTANPEFLKQQIEERHATEHDGFADDIKESLEAVDWCDVLILQFPFWWFSMPAILKGWIDKVWASGRVYGPNKKFTAGVWKGKKAFLSITTGSSEPTYAGPDSRMGDINSLLFPINHGILAFVGFTVLPPFIAYSASHATEDQRKQFLDEYEQRLLNLENLTPISYPPNEAFDSTGILKADWKAAQAHQNSNPAPREG

SEQ ID NO: 5507 - protein, 147 aa, Zea mays
  Clone ID: PAT_MRT4577_34279C.1.pep
SSSCASASVSFSSSPRRRSRSLIAALRWGDAGCETKLSLPGALKGTRPLPQPLPGRRRRRGYRTTGRRGSAPVVPTRSITNRRPILLASATADILLRESVVDYYTLVLISFSFLSFLISFSFLSRPCDQGVNVTNYCHDFSECIQVM

SEQ ID NO: 5508 - protein, 73 aa, Zea mays
  UNSURE (1)..(73): unsure at all Xaa locations
  Clone ID: PAT_MRT4577_35057C.1.pep
  unsure (1)..(73): unsure at all Xaa locations
DGKAIDGRQVRVNMANXRPSRNRGGGGYGGAGYVGGGSGGDDGNVGGGYGGAIQNYNALGGQDPIRCIINQEI

SEQ ID NO: 5509 - protein, 438 aa, Zea mays
  Clone ID: PAT_MRT4577_35061C.1.pep
MHIDMIKKPRRFFPFRNLDWRCCLLPVGAVGWGSFQLGYSGNADLEPGRCRRTDGKKWRCSRDAVADQKYCERHMNRGRHRSRKHVEGQPGHAAKAMSAVAVAAAAAAAAALAGAGATAAAGLAANQHRQPGKSYATGATDPCSLQYSRGLANKLSNESENMQDSDSVSMLTSMNTGNTAGSVFPFSKQNTDLFEVSSSRPEFGLVPSDSLTSSPHSSLKSVKNLLSSRSLSEHQSSASLQHFVDWPRTPPAQGGLSWPEAEDMPRAQTSQLSVSAPMASSELSSASTSPIHDHEKLILSPLKLGRDREYSPSGLVSAAANRYEVSQLEATWATTFRDSSTGGPLGEVLAKNNSNAEARSCPSAAPPLTDYYCWDSGHGMQSSPVGVLQRTTAFGSVSSSTGSSPRVESHGACCDGTSNLMDDDLGSVVVSHPSIRLL

SEQ ID NO: 5510 - protein, 426 aa, Zea mays
  Clone ID: PAT_MRT4577_35063C.1.pep
KPCRLFLFRILIWRCCVLGAVGWGSFQLGYSGNADLEPGRCRRTDGKKWRCSRDAVADQKYCERHMNRGRHRSRKHVEGQPGRAAKAMSAVAVAAAAAAAALAGAGATAAAGLAVNQHRQPGKSYATGATDPCSLQYSRGLANKLSNESENMQDSDNVSMLTCMNTGNTAGSVFPFSKQNTDLFEVSSSRPEFGLVPSDSLTRSPHSSLKSVKNLLSSRSLSEHQSSTSLQHFVDWPRTPPAQGGLSWPEAEDMPRAQRSQLSVSAPMASSELSSASTSPIHDHEKLILSPLKLGREYSPSGLVSVAGASRDEVSQLEATWATTFRDSSTGGPLGEVLAKNNSNAEARSCPSAAPPLTEYYCWDSGHGMESSPVGVLQRTTAFGSVSSSTGSSPRVENHGASCDGTSNLMDDLGSVVVSHPSIRLL

SEQ ID NO: 5511 - protein, 583 aa, Zea mays
  Clone ID: PAT_MRT4577_35068C.1.pep
MEAGGGASELGLLGAGSGRLLKHGRGDAAGGEDHGWVVVVGGGGRAKQARTASVGTGDAAATAAVPFLLGSCGGPGHGGERMLSFSSAAAAAPDDGGAMPPLYYGTPASCSGLMSSARVRGPFTPPQWIELEHQALIYKYLSANSPVPHSLLVPIRRSGSLASSPYPPPYFGTSTFGWGSFQLGYSGNADLEPGRCRRTDGKKWRCSRDAVADQKYCERHMNRGRHRSRKHVEDQPGHAAKAMSAVAVAAAAAAATQHAAALAGAGATAAAGLAVNRHRQPGKSYATGATDPCSLQYSRELANKLSNESENMQDSDNLSMLTSMNTGNTGSVFPFSKQNTAPFEVSSSRPEFGLVPSDSLTSSPHSSLENVKNLLGSRSMNEHQNPASLQHFVDWPRTPAQGGLSWPEAEDMQAQRSQLSISAPMASSELSSASTSPIHDHEKLILSPLKLGREYTPSGVVSAAANRYEVSQLEATWATMFRDSSTGGPLGEVLAKNNSNAEARGCPSAAPPLTDYYCWDSGHGMQSSPVGVLQRTTAFGSVSSSTGSSPRVESHGACCDGTSNLMDDDLGSVVVSHPSIRLL

SEQ ID NO: 5512 - protein, 476 aa, Zea mays
  Clone ID: PAT_MRT4577_35069C.1.pep
MSSARVRGPFTPPQWIELEHQALIYKYLSANSPVPHSLLVPIRRSGSLASSPYPPPYFGTSTFGWGSFQLGYSGNADLEPGRCRRTDGKKWRCSRDAVADQKYCERHMNRGRHRSRKHVEDQPGHAAKAMSAVAVAAAAAAATQHAAALAGAGATAAAGLAVNRHRQPGKSYATGATDPCSLQYSRELANKLSNESENMQDSDNVSMLTSMNTGNTAGSVFPFSKQNTDLFEVSSSRPEFGLVPSDSLTSSPHSSLKSVKNLLSSRSLSEHQSSASLQHFVDWPRTPPAQGGLSWPQAEDMPRAQRSQLSVSAPMASSELSSASTSPIHDHEKLILSPLKLGRDREYSPSGLVSVAGASRDKVSQLEATWATMFRDSSTGGPLGEVLAKNSSNAEARSCPSAAPPLTDYYCWDSGHGMQSSPVGVLQRTTAFGSVSSSTGSSPRVESHGACCDGTSNLMDDDLGSVVVSHPSIRLL

SEQ ID NO: 5513 - protein, 594 aa, Zea mays
  Clone ID: PAT_MRT4577_35127C.1.pep
MDTLFRLVSLQASEQQQQQQSASYNSRSTTSSGSRSSSHQTNASYNYYYHSNSSGGGGGGQYYYGQQHPQQHQHQQYYLEPYQQEECGNTHHLYMDEDFSSSSSSRQHFHSHGAVVQPPTSSTATPTAPTPSLSTSSTAAGAAHALFEAADLSFPPDLNLDFSSPASSSGGGAASSAAVGGGGGGRWASQLLLECARAVAGRDSQRVQQLMWMLNELASPYGDVEQKLASYFLQGLFARLTASGPRTLRTLAAASDRNTSFDSTRRTALRFQELSPWSSFGHVAANGAILESFLEAAAASPEPQRLHILDLSNTFCTQWPTLLEALATRSADDTPHLSITTVVSSAPSAPTAAVQRVMREIGQRMEKFARLMGVPFSFRAVHHAGDLAGLDLDALDLRDGGATTALAINCVNSLRGVVPGGARRRDAFAASLRRLDPRVVTVVEEEADLVAFDPGAPDESGDTEAAFLKVFGEGLRFFSAYMDSLEESFPKTSNERLALERGAGRAIVDLVSCPASESMERRETAASWARRMRSSGFSPVAFSEDVADDVRSLLRRYREGWSMRDAGLDDSEAGAGVFLAWKEQPLVWASAWRP

SEQ ID NO: 5514 - protein, 305 aa, Zea mays
  Clone ID: PAT_MRT4577_35131C.1.pep
MESASDVQMQHRAEDSETTIEIKIKTLDSQTYNLRVNKCVPVPLLKEKIATVTGILSEQQRLICRGRVLKDDELLSAYHVEDGHTLHLVVRHPGQSATFGNAATEANTSNSGRRHGPTVARSVVLEAVNVDPGSSELPAFVAQILQSVLGTINAQSTGTPTSSDTGSLDPSQSSIPNTIRVELDQQQAPLLFQSEPAHESSQPNVIPDALTTMSQYINFMRDSFRREGFSLNGQTEGNVENRTAEPESASVLGLHNASLLAENMHSTRQIIVEQAGALLSQLSTQLGDLENVTDSAIRRDIQSSA

SEQ ID NO: 5515 - protein, 48 aa, Zea mays
  Clone ID: PAT_MRT4577_35394C.1.pep
YRVPVSFCHRVSDRSTFELGVGTPVVPFVCSRYETRPHKNEQGFCSQL

SEQ ID NO: 5516 - protein, 301 aa, Zea mays
  UNSURE (1)..(301): unsure at all Xaa locations
  Clone ID: PAT_MRT4577_35583C.1.pep
  unsure (1)..(301): unsure at all Xaa locations
MASCRMALLLGLLLLVVASPAIADDDSGIYYQLALMWPGAYCEQTSAGCCKPTTGVSPARDFYITGFTVLNAITDAAVTGCSNKVPYDPNLITGIQGLDQYWSNIRCPSNNGQSSWKTXWXKKAGACSGLSEKDYFETALSFRSRINPLVRLKAKGIEPDFGLYGLKAITKVFKSGINATPVIQCSKGPFDKYMLFQLYFCAAGNGTFIDCPAPQQYTCSKEILFHPFKKWMLKQQLNQDDDPFQLPGVAXTTDTPTPSRSGCSSSSSTRTTTLSSCLASPWTTDTPYRRLSLRFCQVCME

SEQ ID NO: 5517 - protein, 301 aa, Zea mays
  UNSURE (1)..(301): unsure at all Xaa locations
  Clone ID: PAT_MRT4577_35585C.1.pep
  unsure (1)..(301): unsure at all Xaa locations
MASCRMALLLGLLLLVVASPAIADDDSGIYYQLALMWPGAYCEQTSAGCCKPTTGVSPARDFYITGFTVLNATTDAAVTGCSNKVPYDPNLITGIQGLNQYWSNIRCPSNNGQSSWKNAWKKAGACSGLSEKDYFETALSFRSRINPLVRLKAKGIEPDFGLYGLKAITKVFKSGINATPVIQCSKGPFDKYMLFQLYFCAAGNGTFIDCPAPQQYTCSKEILFHPFKKWMLKQQLNQDDDPFQLPGVAXQLIHRPLQEVDAQAAAQRGRTTTLSSCLASPWTTDTPYRRLCLRFCQVCME

SEQ ID NO: 5518 - protein, 104 aa, Zea mays
  UNSURE (1)..(104): unsure at all Xaa locations
  Clone ID: PAT_MRT4577_35600C.1.pep
  unsure (1)..(104): unsure at all Xaa locations
MAAADVKYRCFVGGLAWAXTSNESLENAFACYREILDYKDITDRETGRSRGLRLDTLYYENSMLDAIDNMNGKELDGRNITANQAQTRDGGGGGCSYSGCRGRG

SEQ ID NO: 5519 - protein, 79 aa, Zea mays
  UNSURE (1)..(79): unsure at all Xaa locations
  Clone ID: PAT_MRT4577_35623C.1.pep
  unsure (1)..(79): unsure at all Xaa locations
GIFKKSPFGVLXPRGVGHLGKPSKKRGRKGRPNFKVGICGKNGGEPSSVAFFGKGGVGYVFCSPFRVPIDRQSPAQGFV

SEQ ID NO: 5520 - protein, 95 aa, Zea mays
  UNSURE (1)..(95): unsure at all Xaa locations
  Clone ID: PAT_MRT4577_35656C.1.pep
  unsure (1)..(95): unsure at all Xaa locations
MDASGAVSKGKKGAAGRKAGGPRKKSVTRAVKAALEFPVERIGRYLKKGRYAQRVCTGAPVYLAAVLXYLCCQVLDLPGHAAKDNMKTRIISCHV

SEQ ID NO: 5521 - protein, 58 aa, Zea mays
  Clone ID: PAT_MRT4577_3574C.1.pep
GEKKQILFINKRGSQIFLHTYMLIGGDAVDHLKLDTYLLKLIQHGGTSEVHMLTDDKF

SEQ ID NO: 5522 - protein, 121 aa, Zea mays
  Clone ID: PAT_MRT4577_35832C.1.pep
KQFFPFDHQAALKFASFLYEQELPFSQLPVSYPQQFFPFIQLAALNSLAYLRQLQLLPLSQLAGVSPATFFTQPQLLAFYQGAGPNAGTLLQLQQLLPFNQLALSNLAVFPPPPIFGGALF

SEQ ID NO: 5523 - protein, 137 aa, Zea mays
  Clone ID: PAT_MRT4577_35964C.1.pep
DAWFPLAVAGGSSRTPEPNAPRRAALCRGTEAKCVTRQGRSRAPDRKHRGAVRADIGHEGARPRRAGARLRRLRRWSGRGGWQTDADGRGGRGDGGLRRLAAREDATRQRTPMVPGMGLPLHPSAPDEPHARPSRQG

SEQ ID NO: 5524 - protein, 451 aa, Zea mays
  Clone ID: PAT_MRT4577_360C.1.pep
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRGDVVPKDVNAAVATIKTKRPIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 5525 - protein, 122 aa, Zea mays
  Clone ID: PAT_MRT4577_36122C.1.pep
MCLSEEKTYTGREHKGKDLSHADFVRLEIELTAVEMPSLMACRAAFVPDRPFAGARIWERVHMTIQTVGLIETLTALGAEVRWRYCNMLLTQDHAGVDIARDSDCVFVWKGETLEEYWWCTE

SEQ ID NO: 5526 - protein, 52 aa, Zea mays
  UNSURE (1)..(52): unsure at all Xaa locations
  Clone ID: PAT_MRT4577_36165C.1.pep
  unsure (1)..(52): unsure at all Xaa locations
MEQTFIMIKPDCVHRGLIGGIISRFEKKGFYLNGMKFMNVEGSFAXQHYADL

SEQ ID NO: 5527 - protein, 456 aa, Zea mays
  Clone ID: PAT_MRT4577_362C.1.pep
QKRKKKKKKKKNKKKKKKKRGRPPCWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAILLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 5528 - protein, 34 aa, Zea mays
  Clone ID: PAT_MRT4577_36316C.1.pep
KNVCRYMCSSRILLAQSKLVGLSHCLRYMNTCID

SEQ ID NO: 5529 - protein, 99 aa, Zea mays
  UNSURE (1)..(99): unsure at all Xaa locations
  Clone ID: PAT_MRT4577_36430C.1.pep
  unsure (1)..(99): unsure at all Xaa locations
FIQLPTTLPHQFLPFIQLPAFNSHTYFQHQQLLPFKQLAGVNPTPLLVYIPQLFPFYQHPAPNADTLSQLQQFHPPNQLSLTNPAAFXYQQPIIGGALF

SEQ ID NO: 5530 - protein, 416 aa, Zea mays
  Clone ID: PAT_MRT4577_3650C.1.pep
MGYCKIRHVIWIRLLCLYICVEPSLGSGLYTIAEASACRLQPMRIERDLHMATGDGETSYTKNSRIQEKTMFQIKPVLEEATRAVYTALHPQTMVVADLGCSSGPNTLRFVSEVIGIIARHCKEYGRQHDHTQLQFFLNDLPGNDFNNLFQLIQQFNKSTAINHKSEAAEALPPPCYISGLPGSYYTRIFPSESVHLFHSLFCLQWRSEAPEGNKKTCLDIYITKTMSPSMVKLFQQQFQKDFSLFLRLRYEELVSGGQMVLTFIGRKHENVFTGESNHLYGLLAQSLKSLVDEGLVEKEKLESFYLPMYSPSVGEVEAILKQVGLFNMNHVKVFQTNWDPYDDLESDVVHNSIRSGENVAKCLRAVMQPLVASQFGEPILDKLFKEYARRVAKHLENEKTKHAIIVLSIEKAIHL

SEQ ID NO: 5531 - protein, 100 aa, Zea mays
  UNSURE (1)..(100): unsure at all Xaa locations
  Clone ID: PAT_MRT4577_36533C.1.pep
  unsure (1)..(100): unsure at all Xaa locations
MASATGLKSSFRPKKSEWGATKQGAEPRPPTVSMRRRASAYVDELGKTGKTIAXPGRGILPMHQSSATRGKRVASIGLENTEDNRHAXRTMVVHGERTMG

SEQ ID NO: 5532 - protein, 382 aa, Zea mays
  Clone ID: PAT_MRT4577_3653C.1.pep
MPMRIERDLHMAIGNGETSYTKNSRIQEKAMFQMKSVLEEATRAVCTALLPQTMVVADLGCSSGPNTLRFVTEVTRIIAHHCKLEHNRRHDHLPQLQFFLNDLPGNDFNNLFQLIEQFNKSSTTHKGDAATEALQPPCYISGLPGSYYTRIFPSESVHLFHSLFCLQWRSQAPEQLKGTQKSCLDIYITKTMSPSMVKLFQQQFQKDFSLFLRLRYEELVSGGQMVLTFIGRKHEDVFTGESNHLYGLLAQSLKSLVDEGLVEKEKLESFYLPIYSPSVGEVEAIVKQLGLFNMNHVKVFEINWDPYDDSEGDDVHNSIESGENVAKCLRAVMEPLVASQFGERILDKLFKEYARRVAKHLENEKTKHAVLVLSIEKAIIHV

SEQ ID NO: 5533 - protein, 70 aa, Zea mays
  UNSURE (1)..(70): unsure at all Xaa locations
  Clone ID: PAT_MRT4577_36578C.1.pep
  unsure (1)..(70): unsure at all Xaa locations
ACMLSSTLFVGGASYGTXDHSLRDESAKYGXISNAEIILDXRSXGRSRGXDSITYTCTDEATAAITGMAG

SEQ ID NO: 5534 - protein, 118 aa, Zea mays
  UNSURE (1)..(118): unsure at all Xaa locations
  Clone ID: PAT_MRT4577_36609C.1.pep
  unsure (1)..(118): unsure at all Xaa locations
CLLMLLGLTASAATATILLQCLQAPIAAYLTAYLXPAVSTVCENLILQPYRIQQAIAARILPVSPLLLQQLSALLQQVPMVHLMTHDIKVQQLQQLVLGNLAAYCQQQXIVAFNRLAA

SEQ ID NO: 5535 - protein, 360 aa, Zea mays
  Clone ID: PAT_MRT4577_36673C.1.pep
FLCVAIGLWAGLAIGFTTEYFTSNAYSPVRDVADSCRTGAATNVIFGLALGYKSVIVPVFAIAVSIYVGFTLASIYGIAVAALGMLSTVATGLAIDAYGPISDNAGGIAEMAGMSRRIRQRTDALDAAGNTTAAIGKGFAIGSAALVSLALFGAFVSRAGVEDVNVLNPKVFVGLLVGAMLPYWFSAMTMKSVGSAALKMVEEVRRQFITIPGLMEGRAAPDYARCVRISTDASLKEMMPPGALVLLAPLVAGTFFGVSTLAGLLAGALVSGVQIAISASNSGGAWDNAKKYIEAGASDHAKSLGPKGSDAHKAAVIGDTIGDPLKDTSGPSLNILIKLMAVESLVFAPFFAAHGGLIFK

SEQ ID NO: 5536 - protein, 107 aa, Zea mays
  UNSURE (1)..(107): unsure at all Xaa locations
  Clone ID: PAT_MRT4577_36721C.1.pep
  unsure (1)..(107): unsure at all Xaa locations
LLHKFFFFFFREAFGGGVKSSFLPKKSEWGATRHAAAPRPPTVSMVVRASAYADELVKTAKTIASPWRGFLAMDESNATCGKXLASIRLXEHRCQPGGFPDCWWSRL

SEQ ID NO: 5537 - protein, 78 aa, Zea mays
  Clone ID: PAT_MRT4577_36948C.1.pep
PVIMPQMMTPNMMSPFIMPSIMSPMVFPSIMLQKIMPQCPWDPVFQIILQHQFPFMFNPMAMAIPPMFLQQPFVGGAF

SEQ ID NO: 5538 - protein, 215 aa, Zea mays
  UNSURE (1)..(215): unsure at all Xaa locations
  Clone ID: PAT_MRT4577_36961C.1.pep
  unsure (1)..(215): unsure at all Xaa locations
MAIKRTKAEKKIAYDQKLCQLLEEYTKVLIAVADNVGSKQLQEIRKGLRGDSIVLMGKNTLIRRCIKVHSEKTSNKDFLELSNLLVGNVGLIFTKGDLKEVREEVAKYKVGAPARVGLVAPVDVVVPPGNTGLDPSQTSFFQVLNIPTKINKGTVEITIPVELIKKGDKVGSSESALLAKLGIRPFSYGLVICNVYDSGSVFSPXEXLDLTEEDL

SEQ ID NO: 5539 - protein, 1089 aa, Zea mays
  Clone ID: PAT_MRT4577_37056C.1.pep
MSVWNYVVTAHKPTSVSHSCVGNFTSPNQLNLIIAKCTRIEIHLLTPQGLQPMLDVPIYGRIATIELFRPHNETQDFLFIATERYKFCVLQWDTEKSELITRAMGDVSDRIGRPTDNGQIGIIDPDCRLIGLHLYDGLFKVIPFDNKGQLKEAFNIRLEELQVLDIKFLHGCAKPTIVVLYQDNKDVRHVKTYEVALKDKDFVEGPWSQNNVDNGAGLLIPVPAPLGGVIIIGEEQIVYCNANSTFKAIPIKQSIIRAYGRVDPDGSRYLLGDNTGILHLLVLTHERERVTGLKIEYLGETSIASSISYLDNGVVYVGSRFGDSQLVKLNLQADASGSFVEILERYVNLGPIVDFCVVDLDRQGQGQVVTCSGAFKDGSLRVVRNGIGINEQASVELQGIKGLWSLKSSINDPFDMYLVVSFIGETRFLAMNMEDELEETEIEGFDAQPQPLSCQNAINDLLIQVTANSVRLVSCTSRELVNQWNAPAGFSVNVASANASQVLLATGGGHLVYLEIRDAKLVEVKHAQLEHEISCLDLNPIGENPQYSSLAAVGMWTDISVRIFSLPDLELIRKENLGGEIVPRSVLLCTLEGVSYLLCALGDGNLFSFLLNASTGELTDRKKVTLGTQPISLRTFSSKGTTHVFASSDRPTVIYSSNKKLLYSNVNLKEVNHMCPFNTAAFPDSLAIAKEGELSIGTIDDIQKLHIRTIPLNEQARRICHQEQSKTLAFCSFKYNQSVEESETHLIRLLDHQTFESLCVYPLDQYECGCSIISCSFADDSNVYYCVGTAYVIPEENEPTKGRILVFAVEDGSLQLIVEKETKGAVYSLNAFNGKLLAAINQKIQLYKWMSREDGSHELQSECGHHGHILALYTQTRGDFIVVGDLMKSISLLVYKHEESAIEERARDYNANWMTAVEMLDDEVYVGAENGYNLFTVRKNSDAATDDERARLEVVGEYHLGEFVNRFRHGSLVMRLPDSDIGQIPTVIFGTINGVIGIIASLPHDQYIFLEKLQSTLVKYIKGVGNLSHEQWRSFHNDKKTAEARNFLDGDLIESFLDLSRSKMEEVSKAMGVPVEELSKRVEELTRLH

SEQ ID NO: 5540 - protein, 36 aa, Zea mays
  Clone ID: PAT_MRT4577_3717C.1.pep
IPRSFARYSSALLTTPRWLPNRIAPIQQRHHMAEHV

SEQ ID NO: 5541 - protein, 92 aa, Zea mays
  Clone ID: PAT_MRT4577_37192C.1.pep
CLVMSGRGKGGKGLGKGGAKRHRKVLRDNIQGITKPAIRRLARRGGVKRISGLIYEETRGVLKVFLENVIRDAVTYTEHAKRKTVTAMDVVY

SEQ ID NO: 5542 - protein, 237 aa, Zea mays
  Clone ID: PAT_MRT4577_37203C.1.pep
MAGQERRTIDLEEGWAFMQKGITKLKNILEGKPEPQFSSEDYMMLYTTIYNMCTQKPPHDYSQQLYDKYRESFEEYITSMVLPSLREKHDEFMLRELVQRWSNHKVMVRWLSRFFHYLDRYFISRRSLTPLKEVGLTCFRELIYQEIKGQVKDAVIALIDKEREGEQIDRGLLKNVLDIFVEIGLGQMECYENDFEDFLLKDTTEYYSVKAQSWILEDSCGDLRAYGSCHSKGCSHL

SEQ ID NO: 5543 - protein, 180 aa, Zea mays
  Clone ID: PAT_MRT4577_37333C.1.pep
MADAPASPGGGGGSHESGSPRGGGGGGGGSVREQDRFLPIANISRIMKKAIPANGKIAKDAKETVQECVSEFISFITSEASDKCQHEKRKTINGDDLLWAMATLGFEDYIEPLKVYLQKYREMEGDSKLTSKSSDGSIKKDALGHVGASSSAVQGMGQQGTYNQGMGYMQPQYHNGDISN

SEQ ID NO: 5544 - protein, 61 aa, Zea mays
  UNSURE (1)..(61): unsure at all Xaa locations
  Clone ID: PAT_MRT4577_37451C.1.pep
  unsure (1)..(61): unsure at all Xaa locations
GDNAQHRQAPAAATRYKHDXPAXSSLTFXIXSXXXTSTFLXPXSPLLLTRXRHQPEXLPPR

SEQ ID NO: 5545 - protein, 110 aa, Zea mays
  Clone ID: PAT_MRT4577_37519C.1.pep
MAEVHNERPVGMVGGVRDAPVGRENDLEAIELARFAVAEHNSKTNAMLEFERLVKVRHQVVAGTLHHFTVEVKEAGGGEKKLYEAKVWEKAWENFKQLQSFELVGDAAVA

SEQ ID NO: 5546 - protein, 131 aa, Zea mays
  UNSURE (1)..(131): unsure at all Xaa locations
  Clone ID: PAT_MRT4577_37567C.1.pep
  unsure (1)..(131): unsure at all Xaa locations
PPISLLAELKAKLNELTPLNPLECNQKELSGALTKYXNCLGKSFNTTYILXAYRTEXFEVHTANNMIANHFYRQGLFDLADXCIVPECAELGSASXCSYRFRTCMLSLEAMIEXNLEPALTWRAKNHDHMM

SEQ ID NO: 5547 - protein, 452 aa, Zea mays
  Clone ID: PAT_MRT4577_37639C.1.pep
MGTQAPENYPAEKDARSAREKAIDDWLPITSSRNAKWWYSAFHNVTAMVGAGVLSLPYAMSELGWGPGIAVLVVSWVITLYTLWQMVEMHEMVPGKRFDRYHELGQHAFGDRLGLWIVVPQQLVVEVGVNIVYMVTGGKSLKKFHDVLVCGDTGVCEGKDNIKTTYFIMIFASVHFVLSQLPNFNSISGVSLAAAVMSLSYSTIAWGASVHKGRMSGVDYHLRATTTPGKVFGFFGALGDVAFAYAGHNVVLEIQATIPSTPDKPSKKPMWKGVVVAYVVVALCYFPVALIGYWAFGNTVEDNILITLSKPKWLIALANMMVVVHVIGSYQIYAMPVFDMIETVLVKKLRFPPGLTLRLIARTLYVAFTMFIAITFPFFGGLLGFFGGFAFAPTTYFLPCVMWLAIYKPKRFSLSWLTNWMCIILGVLLMILSPIGGLRQIIMEAKTYQFYS

SEQ ID NO: 5548 - protein, 454 aa, Zea mays
  UNSURE (1)..(454): unsure at all Xaa locations
  Clone ID: PAT_MRT4577_37645C.1.pep
  unsure (1)..(454): unsure at all Xaa locations
MGTQAPENYPAEKVQDARSAREKAIDDWLPITSSRNAKWWYSAFHNVTAMVGAGVLSLPYAMSELGWGPGIAVLVVSWVITLYTLWQMVEMHEMVPGKRFDRYHELGQHAFGDRLGLWIVVPQQLVVEVGVNIVYMVTGGKSLKKFHDVLVCGDNGVCEGKDNIKTTYFIMIFASVHFVLSQLPNFNSISGVSLAAAVMSLSYSTIAWGASVHKGRMSGVDYHLRATTTPGKVFGFFGAXXXVAFAYAGHNVVLEIQATIPSXXDKPSKKPMWKGVVVAYVVVALCYFPVALIGYWAFGNTVEDNILITLSKPKWXXXXXXXXXXXXXXXSYQIYAMPVFDMIETVLVKKLRFPPGLTLRLIARTLYVAFTMFIAITFPFFGGLLGFFGGFAFAPTTYFLPCVMWLAIYKPKRFSLSWLTNWMCIILGVLLMILSPIGGLRQIIMDAKTYQFYS

SEQ ID NO: 5549 - protein, 456 aa, Zea mays
  UNSURE (1)..(456): unsure at all Xaa locations
  Clone ID: PAT_MRT4577_37648C.1.pep
  unsure (1)..(456): unsure at all Xaa locations
MGTQAPENYPAEKVQDARSAREKAIDDWLPITSSRNAKWWYSAFHNVTAMVGAGVLSLPYAMSELGWGPGIAVLVVSWVITLYTLWQMVEMHEMVPGKRFDRYHELGQHAFGDRLGLWIVVPQQLVVEVGVNIVYMVTGGKSLKKFHDVLVCGDTGVCEGKDNIKTTYFIMIFASVHFVLSQLPNFNSISGVSLAAAVMSLSYSTIAWGASVHKGRMSGVDYHLRATTTPGKVFGFFGALGDVAFAYAGHNVVLEIQATIPSTPDKPSKKPMWKGVVVAYVVVALCYFPVALIGYWAFGNTVEDNILITLSKPKWLIALANMMVVVHVIGSYQXIYAMPVFDMIETVLVKKLRFPPXLTLRLIARTXYVAFTMFITITFPFLGGLLGFFGGFAFXAPTTYFLPCVMWLAIYKPKRFSLSWXTNWXATILGVLLNNLSPIGGLRQIIMDAKTYQFYS

SEQ ID NO: 5550 - protein, 456 aa, Zea mays
  UNSURE (1)..(456): unsure at all Xaa locations
  Clone ID: PAT_MRT4577_37650C.1.pep
  unsure (1)..(456): unsure at all Xaa locations
MGTQAPENYPAEKVQDARSAREKAIDDWLPITSSRNAKWWYSAFHNVTAMVGAGVLSLPYAMSELGWGPGIAVLVVSWVITLYTLWQMVEMHEMVPGKRFDRYHELGQHAFGDRLGLWIVVPQQLVVEVGVNIVYMVTGGKSLKKFHDVLVCGDTGVCEGKDNIKTTYFIMIFASVHFVLSQLPNFNSXISGVSLAXAAVMSLSYSTIAWGASVHKGRMSGVDYHLRATTTPGKVFGFFGALGDVAFAYAGHNVVLEIQATIPSTPDKPSKKPMWKGVVVAYVVVALCYFPVALIGYWAFGSTVEDNILITLSKPKWLIALANMMVVVHVIGSYQIYAMPVFDMIETVLVKKLRFPPGLTLRLIARTLYVAFTMFIAITFPFFGGLLGFFGGFAFAPTTYFLPCVMWLAIYKPKRFSLSWLTNWMCIILGVLLMILSPIGGLRQIIMEAKTYQFYS

SEQ ID NO: 5551 - protein, 72 aa, Zea mays
  Clone ID: PAT_MRT4577_37706C.1.pep
NPNKSIFSEQKHPWAQLIFKMKRGDRNIAPGPHGSVGPNEGGGVSLVVGDPDKLFSDLATGEESYERLGRAL

SEQ ID NO: 5552 - protein, 80 aa, Zea mays
  Clone ID: PAT_MRT4577_37757C.1.pep
PPVRSFRKNIMFVQFDKGAAAANGDKFLPAGGGGSPFVKVSLDGAPYLGKVDLKMFRSFQQLFKGLENIFSFFTIGSCGF

SEQ ID NO: 5553 - protein, 263 aa, Zea mays
  UNSURE (1)..(263): unsure at all Xaa locations
  Clone ID: PAT_MRT4577_37761C.1.pep
  unsure (1)..(263): unsure at all Xaa locations
MDPKMTEVTQMFARFKAAYTRNDLDACVTLLSQLKVHLTKFPSLPPSFEQTPNAVEELKLARDIYEHAVVLSVKLEDQDAFERDFCQLKPYYMDTCGIIPPSPEEYPILGLNLLRLLVQNRIAEFHTELELLPVKALEHPCIKHAVELEQSFMEGAYNRVLSARQAVPHETYVYFMDLLAKTVRDEIAGCSEKGYDSLSVSDAKQMLMFSSDQDLHEYITEEHPEWXELKNGRXVFFQKAKESQPXREIPSLQLINXTLSYAR

SEQ ID NO: 5554 - protein, 267 aa, Zea mays
  Clone ID: PAT_MRT4577_37763C.1.pep
MDPKMTEVTQMFARFKAAYTRNDLDACVTLLSQLKVHLTKFPSLPPSFEQTPNAVEELKLARDIYEHAVVLSVKLEDQDAFERDFCQLKPYYMDTCGIIPPSPEEYPILGLNLLRLLVQNRIAEFHTELELLPVKALEHPCIKHAVELEQSFMEGAYNRVLSARQAVPHETYVYFMDLLAKTVRDEIAGCSEKGYDSLSVSDAKQMLMFSSDQDLHEYITEEHPEWEFKNGAVFFQKAKESQPYKEIPSLQLINQTLSYARELERIV

SEQ ID NO: 5555 - protein, 239 aa, Zea mays
  UNSURE (1)..(239): unsure at all Xaa locations
  Clone ID: PAT_MRT4577_37764C.1.pep
  unsure (1)..(239): unsure at all Xaa locations
MPVIHCCCYLLIGFRWKTEIAQMLRPHSRLAYTRNDLDACVTLLSQLKVHLTKFPMLSPSFEQTPNAVEELKLARDIYEHAVDLSVKLEDQDAFERDFCQLKPYYMDTCGIIPPSPEEYPILGLNLLRLLVQNRIAEFHTELELLPVKALEHPCIKHAVXLEQSFMEGAYNRVLSARQAVPHETYVYFMDLLAKTVRDEIAGCSEKGYDSLSASDAKQMLMFSSDQDLHEYITDEHPEW

SEQ ID NO: 5556 - protein, 319 aa, Zea mays
  Clone ID: PAT_MRT4577_37835C.1.pep
MAIKRTKAEKKIAYDQKLCQLLEEYTKVLIAVADNVGSKQLQEIRKGLRGDSIVLMGKNTLIRRCIKVHSEKTGNKDFLELSNLLVGNVGLIFTKGDLKEVREEVAKYKVGAPARVGLVAPVDVVVPPGNTGLDPSQTSFFQVLNIPTKINKGTVEIITPVELIKKGEKVGSSESALLAKLGIRPFSYGLQVTSVYEDGSVFSPEVLDLSEEDLIEKFATGVSMVASLSLAISYPTLAAVPHMFINGYKNVLAVAVETDYSYPHADKIKEYLKDPSKFAVAAPVAAGDAGAAAAPKEEEKAAEPEEESDEEMGFSLFDD

SEQ ID NO: 5557 - protein, 179 aa, Zea mays
  Clone ID: PAT_MRT4577_37871C.1.pep
MSRHPITKWAQRSDRVFLTIELPDAKDVKLNLKPEGHFNFSAKGSDDLPYEFDLELFDAVNVEESKAAVAPRTICYLIKKAESKWWPRLLKKEGKAPVFLKVDWDKWQDEDDEDVGFNDFSDMDFSKLDMGGADDDDFEDDEDDVVESANKDEEGGKTEKSNGEEEAAAAAAAAEEVKP

SEQ ID NO: 5558 - protein, 176 aa, Zea mays
  Clone ID: PAT_MRT4577_37872C.1.pep
MSRHPITKWAQRSDRVFLTIELPDAQDVKLNLKPEGHFNFSAKGSDDLPYEFDIELFDAVNVEESKAAIAPRTICYLIKKAKSGWWPRLLKQEGKPPVFLKVDWDKWQDEDDEDAGFNDFGGMDFSKLDIGGADDDDIGDDEDDVVESANKDEEGGKTEESKEEEAAPAAAEEVKP

SEQ ID NO: 5559 - protein, 190 aa, Zea mays
  UNSURE (1)..(190): unsure at all Xaa locations
  Clone ID: PAT_MRT4577_37945C.1.pep
  unsure (1)..(190): unsure at all Xaa locations
ETCTLLLPAXINVNQASTKSKFDNXLYGGRHSLPHGLMRATDIMIAGNGAXTXGYCDVRKGXAPTLKQAGARNIGTYIDPICSLQALMKGLQDLTFEDVIXEADILTTTTGNNDITMGDHMRKMNNNAXIVCNIDHYDTEIDMLRLQTYPGDKRITIKPHTDQMVFPETNTGIIVHAEGLLMNLRCATGH

SEQ ID NO: 5560 - protein, 120 aa, Zea mays
  UNSURE (1)..(120): unsure at all Xaa locations
  Clone ID: PAT_MRT4577_37965C.1.pep
  unsure (1)..(120): unsure at all Xaa locations
PFTHLAALTSAFYLQPTQXPFSQXPXASPHQFFPLTTLAALNSPAYLPTPHLXPFTQLAGVSPAPFLIHPQLLPFSQHAAPNAGPLLQPPQLXPFTPLAFPPPAAFSQHPLIGGPSFSFL

SEQ ID NO: 5561 - protein, 187 aa, Zea mays
  UNSURE (1)..(187): unsure at all Xaa locations
  Clone ID: PAT_MRT4577_37967C.1.pep
  unsure (1)..(187): unsure at all Xaa locations
SPCLLQQSSAXLHQSPXAHLFAQHIRAQQXPHLVXAPLXXYSQPQQFFPFTTLAALNSASYLPTTTXPFTQXPXASPQQFFPFTHLAALNSPAYSQQPHLXPFTQLAGVTPAPFLTHPQLSPFSQHAAPNAGPLLQLPQLXPFTPXPPTNPAAFSPHPLIGGPSFRFLMSYSLNNKVFCLMFVASQK

SEQ ID NO: 5562 - protein, 53 aa, Zea mays
  Clone ID: PAT_MRT4577_38034C.1.pep
MSARIFFLLMLLGLSASAATATIFPQCSQSPIASLLPPYLSPVLSSLCQNPIL

SEQ ID NO: 5563 - protein, 103 aa, Zea mays
  UNSURE (1)..(103): unsure at all Xaa locations
  Clone ID: PAT_MRT4577_38142C.1.pep
  unsure (1)..(103): unsure at all Xaa locations
QQQQRPCSQQQGADPQQFLPSNQQAALNSPAEQQQQQXRPHSQQAGVSPATFLRQPQLLPFNQHEAPNAGTLXQLQQXLPFNQHAFTNPAAFHQQPIIGGALF

SEQ ID NO: 5564 - protein, 116 aa, Zea mays
  Clone ID: PAT_MRT4577_38299C.1.pep
GSPGFGLGGERIYMAAKDVEYRCFVSGLTWATDDHSLHNAFSTYGEVLKSKIIHRSARRMRSRGFGFDTFSTDEAMRNAFDGMNRKELDGRNITLYEAHSRRVRVSCRGCGYGGGR

SEQ ID NO: 5565 - protein, 278 aa, Zea mays
  Clone ID: PAT_MRT4577_38506C.1.pep
SFQIGLPAKFTIFNFGAQKDVSNWGLFFCVAVGLWAGLIIGFVTEYYTSNAYSPVQDVADSCRTGAATNVIFGLALGYKSVIIPIFAIAVSIYVSFSIAAMYGIAMAALGMLSTMATGLAIDAYGPISDNAGGIAEMAGMSHRIRERTDALDAAGNTTAAIGKGFAVGSAALVSLALFGAFVSRAGVKVVDVLSPKVFIGLIVGAMLPYWFSAMTMKSVGSAALKMVEEVRRQFNTIPGLMEGTAKPDYATCVKISTDASIREMILPGALVMLTPLIV

SEQ ID NO: 5566 - protein, 130 aa, Zea mays
  UNSURE (1)..(130): unsure at all Xaa locations
  Clone ID: PAT_MRT4577_38545C.1.pep
  unsure (1)..(130): unsure at all Xaa locations
MKGDKSKGAAKDDAKLXVKSKGTENPAKARKGKVAKDPNKPKRATSAFCTFMEEFRKVFXETNPKNKPAAGEEEVAGDRRKSRRETAKAPYVSKAXNTLKLQXNKAIKTYNKGERTANKKAPAKEQQEAD

SEQ ID NO: 5567 - protein, 106 aa, Zea mays
  Clone ID: PAT_MRT4577_38578C.1.pep
MAASDVEYRCFGGGLAWATNNQSLENAFPSYGEILDYKVITDRQTARSRRFGFVTLSCENSMLDAINNMNGKDLDGRNITVNQTHSHAGGRGTGGYSRKTERRRRL

SEQ ID NO: 5568 - protein, 205 aa, Zea mays
  Clone ID: PAT_MRT4577_38644C.1.pep
MVFVKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKCRDLDQEYEGNVEATGEDFSVEPADERRPFRALLDVGLIRTTTGNRVFGALKGALDGGLDIPHSDKRFAGFKKDEKQLDAEIHRKYIYGGHVAD

SEQ ID NO: 5569 - protein, 389 aa, Zea mays
  Clone ID: PAT_MRT4577_38702C.1.pep
MWGERTHHKHWHQGHGTSGNSNNKKHDKRQPKFIPDNYSSVDEVTTALREAGLESSNLILGIDFTKSNEWSGRHSFRRKSLHAINGTPNPYEQAISIIGRTLSPFDDDNLIPCFGFGDASTHDHSVFSFYPENRPCRGFEEVLVRYRQIVPHLNLSGPTSFAPLIYAAISVVENSNWQYHVLVIIADGQVTAANINDGRLSPQEQATIQAIVDASYYPLSIVMVGVGDGPWDAMQHFDDCIPERAFDNFQFVNFTGIMSTSKDMSKKEAAFALAALMEIPSQYKATQGLRPPEKQAQRIGSPRILPPPNKVLENDNAAAAASHPPQTASSKSTGIGKSAADEQVCPICLTNPKDMAFQCGHLTCKECGPTLSTCPLCRALITMRVRLYS

SEQ ID NO: 5570 - protein, 93 aa, Zea mays
  Clone ID: PAT_MRT4577_38703C.1.pep
GTERWGPRGSYILFATVMFTLVQRVYLPSSSLVVPILVFDCKGPFCQVVMLGSFSASANPCINQHGLWIDGCFYSCQDLFLINSKEKMVLLGA

SEQ ID NO: 5571 - protein, 107 aa, Zea mays
  UNSURE (1)..(107): unsure at all Xaa locations
  Clone ID: PAT_MRT4577_3890C.1.pep
  unsure (1)..(107): unsure at all Xaa locations
GKELDGRNITANQAQSRGGGGGGGGYGGGRXGSSSYGGRRRDRGYGGCGSYCXRREGGGCGYXRRGGYEGRREGGGGGYVLQCMLRLQVLMCRPMLASAEVYYLSIV

SEQ ID NO: 5572 - protein, 82 aa, Zea mays
  UNSURE (1)..(82): unsure at all Xaa locations
  Clone ID: PAT_MRT4577_39022C.1.pep
  unsure (1)..(82): unsure at all Xaa locations
MAEEKHHHHHLFHHKKDEEQEEQLAGGGYGESFEYRGGGVXEVVSTDKNEYEEXKEEKQYKHKQXXXEAXAXXXXAXXXYXK

SEQ ID NO: 5573 - protein, 111 aa, Zea mays
  UNSURE (1)..(111): unsure at all Xaa locations
  Clone ID: PAT_MRT4577_39039C.1.pep
  unsure (1)..(111): unsure at all Xaa locations
MAAKIFCFLMLVGLSASVGTATIFPQCSQAPIASLLSPYLLTTVSLMGETPIGXPFRIQPGIATSILPLLPLVLQQPXALLQELPLGHLGGQNIRAQQLQQLVLANLAAYS

SEQ ID NO: 5574 - protein, 350 aa, Zea mays
  Clone ID: PAT_MRT4577_39086C.1.pep
MAMASTYAPGGGARALAQGRCRVRGPAGLGFLGPSKAAGLPRPLALARRMSSPVAVGARLRCAASSSPAAARPATAPRFIQHKKEAFWFYRFLSIVYDHVINPGHWTEDMRDDALEPADLFSRHLTVVDVGGGTGFTTLGIVKHVNPENVTLLDQSPHQLDKARQKEALKGVTIMEGDAEDLPFPTDSFDRYISAGSIEYWPDPQRGIKEAYRVLRFGGLACVIGPVYPTFWLSRFFADMWMLFPKEEEYIEWFKKAGFRDVKLKRIGPKWYRGVRRHGLIMGCSVTGVKRERGDSPLELGPKAEDVSKPVNPITFLFRFLVGTICAAYYVLVPIYMWIKDQIVPKGMPI

SEQ ID NO: 5575 - protein, 128 aa, Zea mays
  Clone ID: PAT_MRT4577_3916C.1.pep
HASGEVPSHNRIMWEYLHVITGRSAVIVGIVALFTGMKHLGHRYDSENVEELTWALMLWVLSVIVVVLCLEYKEVKRRIGDRSARGHWVLGNTEEEDSVDLLHPDGAARNSESSATGVMEVQLEPLTR

SEQ ID NO: 5576 - protein, 107 aa, Zea mays
  UNSURE (1)..(107): unsure at all Xaa locations
  Clone ID: PAT_MRT4577_39173C.1.pep
  unsure (1)..(107): unsure at all Xaa locations
CKREQLLVTQLCYADTQRVRPFKPVAAIXSHVYLQQQLLLPFSQLASVSPHAFLTQPQLFPFYQHVAPSVGTXLQLQQLLPFNQLALTNPLAFYLQPIIGGASFSFL

SEQ ID NO: 5577 - protein, 131 aa, Zea mays
  UNSURE (1)..(131): unsure at all Xaa locations
  Clone ID: PAT_MRT4577_39195C.1.pep
  unsure (1)..(131): unsure at all Xaa locations
VLGTLGAYXKQREFFPFTQRGALNFAVYLQHQLPFGQLVVASPQHFFPFTQLAALNFAVFLQQQQLPPFSQLVDVSPVAFLTQHQLLPFYLHVGPNAGPLLQLQQLLPFNQLVLTNPTGFYQQPIIGGALF

SEQ ID NO: 5578 - protein, 686 aa, Zea mays
  Clone ID: PAT_MRT4577_39279C.1.pep
MAAAEARGGEFPVGMKVLVVDDDPTCLVVLKRMLLECRYDVTTCPQATRALTMLRENRRGFDVIISDVHMPDMDGFRLLELVGLEMDLPVIMMSADSRTDIVMNGIKHGACDYLIKPVRMEELKNIWQHVIRKKFNENKDHEHSGSLDDTDRNRPTNNDNEYASSANDGGDGSWKSQRKKREKEDDETDLENGDPSSTSKKPRVVWSVELHQQFVNAVNHLGIDKAVPKKILELMNVPGLTRENVASHLQKFRLYLKRIAQHHAGIPHPFVAPVSSANVAPLGGLEFQALAASGQIPPQALAALQDELLGRPTSSLALPGRDQSSLRVAAIKGNKHHEEREIAFGQPIYKCQNNAYGAFPQNSPAVGGLQPFAAWPNNKVGMTDSTSTLGNVGNSQNSNMLLHELQQQPDTLLLGTLHNIDAKPSGVVMPSQSLNTFPASEGISPNQNPLIIPSQPPSFVSSIPPSMKHESLLGLPSTSTSLLGGLDMVNQASTSQALISSHGTNLPGLMNRSSNAIPSPGISNFQSGNIHYVVNQNAMGVSSKPPGVLKTESTDSLSCSYGYIGGSTSVDSGLFSSQSKNPQYGLLQNQNDVNGSWSPSQDFDSFGNSLGQGHPGTTSSNFQSSALGKLPDQGRGRNHGFVGKGTCIPSRFAVDEVESPTNNLSHSIGNSGDIVNHDIFGFSGHM

SEQ ID NO: 5579 - protein, 713 aa, Zea mays
  UNSURE (1)..(713): unsure at all Xaa locations
  Clone ID: PAT_MRT4577_39280C.1.pep
  unsure (1)..(713): unsure at all Xaa locations
MAAAEARGADFPVGMKVLVVDDDPTCLVVLKRMLLECRYDVTTCPQATRALTMLRENRRGFDVIISDVHMPDMDGFRLLELVGLEMDLPVISQYIFLLVFLFSMXMWCWNTSEIIADEIAVMSADSRTDIVMKGIKHGACDYLIKPVRMEELKNIWQHVVRKKFNGNKDHEHSGSLDDTDRNRPTNNDNEYASSANDGGDGSWKSQKKKREKEDDETDLESGDPSTSKKPRVVWSVELHQQFVNAVNHLGIDKAVPKKILELMNVPGLTRENVASHLQKFRLYLKRIAQHHAGIPHPFVASASSAKVAPLGGLEFQALAASGQIPPQALAALQDELLGRPTSSLALPGRDQSSLRLAAIKGNKPHGEREIAFGQPIYKCQNNTYGAFSQSSPAVGGLPSFAAWPNNKLGMTDSSNTLGNVGNSQNSNMLLHELQQQPDTLLSGTLHNIDVKPSGVVMPSQSLNVFPASEGISHNQNPLVIPSQSPSFLASVPPSMKHESLLGSPSPSTSLLGGLDMVNQASTSQPLISSHGANLPGLMNRSSNAMPSPGISNFQSGNIPYVVTQNAMGVSSRPPGVLKTECTESLTHSYGYIGGSTSVDSSLLSSQAKNPQYGLLQSQNDVSSSWLSSQDFDSFGNSLGQGHPGSTSSSFQSSALGKLPDQGRGRNHGFVGKGTCIPSRFAVDEVGSPTNLSHNIVNSGDIVNPDIFGFSGQM

SEQ ID NO: 5580 - protein, 275 aa, Zea mays
  Clone ID: PAT_MRT4577_39495C.1.pep
LPDMWGFASNAWASGLGKRSPPNCTSSSAACSDDEASSCTSREEGLECPICWESFNIVENVPYVLWCGHTLCKNCVLGLQWAVIKVPTVPMQLPFFVCCPWCNLLSLRILYKGNLTFPRKNYFLLWMVEGMNGERARSRPATHSEQHTPWLSSSSRANGNAGCSNPTRRHLPLPPPVDTTSPTNANHANHGVPVPLLNAERVQASLRKSLSFLVHLTSKFPLVFIFLLIVLYAIPASAAVLLLYILITVLFALPSFLILYFAYPSLDWLVREIFA

SEQ ID NO: 5581 - protein, 414 aa, Zea mays
  UNSURE (1)..(414): unsure at all Xaa locations
  Clone ID: PAT_MRT4577_39766C.1.pep
  unsure (1)..(414): unsure at all Xaa locations
MPRDGAQAAPPPERGEMDEVVEADPDTEAEDQEERWARLLPELLSDVVRRVEASGGERWPARKDVVSCACVCRRWREAAVSVVRPPAESGKITFPSSLKQVDXWLPLYGVISGFDTYRPFRYLGYSLRSFXWPIQCRSVFYLTSVYLNLTPFLKTQPGPRERPMQCFIKRNKNNSTFYLYLGFTSSPVDKGKFLMAARRFRRGPHTEYIISLDAEDLSQGSNAYMGKLRSDFWGTNFKIYDSKPPYDGAKASSSRSSRRFGSRRISPQVSAGNYEVGQVSYKYNLLKSRGPRRMYCTLECPSAQETWENSLKTKFRRPLGPTTLRNKAPRWHEHLQCWCLNFHGRVTVASVKNFQLVAAADPSEPTTNVDDETVLLQFGKVDSDMFTMDYRQPLSAFQAFAISLSSFGTKLACE

SEQ ID NO: 5582 - protein, 358 aa, Zea mays
  Clone ID: PAT_MRT4577_39767C.1.pep
MPRDGAQAAPPPERGEMDEVVEADPDTEAEDQEERWARLLPELLSDVVRRVEASGGERWPARKDVVSCACVCRRWREAAVSVVRPPAESGKITFPSSLKQPGPRERPMQCFIKRNKNNSTFYLYLGFTSSPVDKGKFLMAARRFRRGPHTEYIISLDAEDLSQGSNAYMGKLRSDFWGTNFKIYDSKPPYDGAKASSSRSSRRFGSRRISPQVSAGNYEVGQVSYKYNLLKSRGPRRMYCTLECPSAQETWENSLKTKFRRPLGPTTLRNKAPRWHEHLQCWCLNFHGRVTVASVKNFQLVAAADPSEPTTNVDDETVLLQFGKVDSDMFTMDYRQPLSAFQAFAISLSSFGTKLACE

SEQ ID NO: 5583 - protein, 357 aa, Zea mays
  Clone ID: PAT_MRT4577_39768C.1.pep
MPRHTAPAAPPSERGEMDEVVEADPDTEAEDQEERWATLLPELLSDVLLRVEASGAEQWPARKDIVSFACVCRWWRKAAVSVVRPPAESAKITFPSSLKQPGPRENPMQCFIMRNKNSTFYLYLGFTSSPVYKGKFLMAARRLRRGPHTEYIISLDAEDLSQGSNSYMGKLRSDFWGTNFKIYDSKPPYDGAKASSSRSSRRFGSRRISPQVSSGNYEVGQVSYKYNLLKSRGPRRMNCTLECPSAQETWENSLKTKFRRPLGPTTLRNKAPRWHEQLQCWCLNFHGRVTVASVKNFQLVTAAGPSDPTSNVDEETVLLQFGKVDDDIFTMDYRQPLSAFQAFAISLSSFGNKLACE

SEQ ID NO: 5584 - protein, 133 aa, Zea mays
  UNSURE (1)..(133): unsure at all Xaa locations
  Clone ID: PAT_MRT4577_398C.1.pep
  unsure (1)..(133): unsure at all Xaa locations
ANLGGYXKQQQFFPFNQLSALNFGFYLQQQQVPFRQVPGAYPQQFFPFNQLAALDFPGYFQQQQLLPFSQVGGVRPGTFLKQPQVVPVYQDGGPNGGTLLQLQQMVPINQPGLTNPAGVYPQPIIGGALFSFL

SEQ ID NO: 5585 - protein, 98 aa, Zea mays
  UNSURE (1)..(98): unsure at all Xaa locations
  Clone ID: PAT_MRT4577_40046C.1.pep
  unsure (1)..(98): unsure at all Xaa locations
PFSQLCGAYPQQFVPFNQRAAWSSPVYFEQQLLLTFSQLAGVSPGTLLTQHRWLQFYQHMERNHGTLLQLHQLVPFNQLXLTNPTAFYQQPVIGGALF

SEQ ID NO: 5586 - protein, 491 aa, Zea mays
  UNSURE (1)..(491): unsure at all Xaa locations
  Clone ID: PAT_MRT4577_40235C.1.pep
  unsure (1)..(491): unsure at all Xaa locations
MVLSKAVSESDMSVHSTFASRYVRSSLPRYRMPENSIPKEAAYQIINDELMLDGNPRLNLASFVTTWMEPECDKLIMAAINKNYVDMDEYPVTTELQNRCVNMIAHLFNAPLGESETAVGVGTVGSSEAIMLAGLAFKRRWQNKRRAEGKPFDKPNIVTGANVQVCWEKFARYFEVELREVKLRDGYYVMDPEKAVEMVDENTICVAAILGSTLNGEFEDVKLLNDLLQAKNRETRWETPIHVDAASGGFIAPFLYPDLEWDFRLPLVKSINVSGHKYGLVYAGIGWCIWRSKEDLPEELIFHINYLGADQPTFTLNFSKGSSQVIAQYYQLIRHGFEGYRNIMENCHENAMVLKEGLEKTGRFDIVSKDEGVPLVAFSLKDRSRHDEFEISDMLRRFGWIVPAYTMPPDAQHVTVLRVVIREEFSRTLAERLVLDIEKVMYQLDALPSRLXAPSPGGAAAQEKDXELETQRSVTEAWKKFVLAKKTNGVC

SEQ ID NO: 5587 - protein, 905 aa, Zea mays
  Clone ID: PAT_MRT4577_40273C.1.pep
HELCSSSPVHPAGAGRALSTWRSPTVTAAARVFAGPFSTSSLHPSSATSTHQQNQLDRLIHLSIEGSRFYRKAYNGWFSRLSTEHYPAASINMPQYMRSGWHLFLMLHSRSPELVKDPVSCIHGLVGVLAILLINVPAKLRSFTIEGSSHLIKQTEKGVDLIASLCHNYHTSEERLKEMLHKSHNAIEDIFHMKALSASECKPENLDKIDTDDLMYFKGLIDMECFQSNLEKMEKLCNSNSCKGELDFKSILINNDYIPYDENSTGDSTNLGHSKCAFETLASPTKTIKNMLTVPSSPLSPATGGSVKIVQMTPVTSAMTTAKWLREVISSLPDKPSSKLQQFLSSCDRDLTNAVTERVSIVLEAIFPTKSSANRGVSLGLNCANAFDIPWAEARKVEASKLYYRVLEAICRAELQNSNVNNLTPLLSNERFHRCLIACSADLVLATHKTVIMMFPAVLESTGLTAFDLSKIIENFVRHEETLPRELKRHLNSLEEQLLESMAWEKGSSLYNSLIVARPSVASEINRLGLLAEPMPSLDDLVSRQNVRIEGLPATPSKKRAAGPDDNADPRSPKRSCNESRNTVVERNLQTPPPKQSHMVSTSLKAKCHPLQSTFASPTVCNPVGGNEKCADVTIHIFFSKILKLAAIRIRNLCERVQCVEQTERVYNVFKQILEQQTTLFFNRHIDQLILCCLYGVAKVCQLELTFREILNNYKREAQCKPEVFSSIYIGSTNRNGVLVSRHVGIITFYNEVFVPAAKPFLVSLISSGTHPEDKKNASGQIPGSPKPSPFPNLPDMSPKKVSASHNVYVSPLRQTKLDLLLSPSSRSFYACIGEGTHAYQSPSKDLAAINSRLNYNGRKVNSRLNFDMVSDSVVAGSLGQINGGSTSDPAAAFSPLSKKRETDT

SEQ ID NO: 5588 - protein, 436 aa, Zea mays
  UNSURE (1)..(436): unsure at all Xaa locations
  Clone ID: PAT_MRT4577_40303C.1.pep
  unsure (1)..(436): unsure at all Xaa locations
MSLKSIVRELKEMRDGIGSMSRRGGSGSDGRVGHGRSGSRHSWPSLWAEQQQSHXGPGPWVPGPEGPHHQHQGRWANLPPELLLDVIQRVESSEATWPARRQVVACAAICRSWREVTKEVVKTLEECGRITFPISLKQPGPREMPVQCFVRRERATSTYLLYLGLSPSMNVEKDKLLLAARKVRRATRTYFVISLVSDDFSHSSSTYVGKLKPNFLGTKFTIFDSQPPPDAVVLPNNKTSKRQSKQVSPRLPLGNYNVATVTYELTVLRNRGPRRMQCTMHSIPAECIQEGGKAPTPTGAIQSLDEPVSSTLPSAKGKEVAVEFSSTSLSADLSGPACVNGTPLVLKNKAPRWHEQLQCWCLNFRGRVTVASVKNFQLVASVDPSLNIPAAEQEKVILQFGKIGKDIFTMDYRYPLSAFQAFAICLTSFDTKPACE

SEQ ID NO: 5589 - protein, 66 aa, Zea mays
  UNSURE (1)..(66): unsure at all Xaa locations
  Clone ID: PAT_MRT4577_40351C.1.pep
  unsure (1)..(66): unsure at all Xaa locations
ATRGALWTLRYLKLLRLVRHENVIAVKDVMMPIHTRSSKDVYXRYELMDTDLHHIIKSPQGLSNDH

SEQ ID NO: 5590 - protein, 494 aa, Zea mays
  Clone ID: PAT_MRT4577_4043C.1.pep
MPSGSAFSGSVNLKHVKLGYQYLVNHFLTLLLVPVMAATALELARLGPGELLSLWRSLELDLVHILCSAFLVVFVGTVYVMSRPRPVYLVDYACYKPPASCRVPFATFMEHTRLISDDDKSVRFQTRILERSGLGEDTCLPPANHYIPPNPSMEASRAEAQLVIFSAIDDLVRRTGLKPKDIDILVVNCSLFSPTPSLSAMIINKYKLRSNIRSFNLSGMGCSAGLISIDLARDMLQVHPNSNALVVSTEIITPNFYQGSRRDMLLPNCLFRMGAAAILLSNRRREARRAKYRLVHVVRTHKGSDDRAYRCVYEEEDEQGFSGISLSKELMAIAGDALKSNITTIGPLVLPMSEQLLFFFRLVGRKLVNKGWRPYIPDFKLAFEHFCIHAGGRAVIDELQKNLQLSPRHVEASRMTLHRFGNTSSSSLWYELAYIEAKGRMRRGDRVWQIGFGSGFKCNSAVWKCLRSIKTPTNGPWDDCIHRYPVDVPEVVKL

SEQ ID NO: 5591 - protein, 101 aa, Zea mays
  Clone ID: PAT_MRT4577_40513C.1.pep
MVSKVFCLHMLLELSTGADTATIFPKCSQAPIATIIAPYLSPPLSSACENLILQPYRIQQAITVGVLPLSPLFLQQSSALLHQLPLVHLMAQNIKAQQLQQ

SEQ ID NO: 5592 - protein, 493 aa, Zea mays
  UNSURE (1)..(493): unsure at all Xaa locations
  Clone ID: PAT_MRT4577_40527C.1.pep
  unsure (1)..(493): unsure at all Xaa locations
MDFFSEYGGASQYQIQEVIGKGSYGVVAAAIDSHTGERVAIKKINDIFGNVSDAARILREIKLLRLLRHPNIVQIKHIMLPPTRRDLKPXTYYVVFELMESDLHQVIKANDNLTPEHHRFFLYQLICALKYMHSAHVFHRDLKPRNILANSDSKLKICDFGLARASFNDSLSAIYWTDYVATRWYRAPELCGSFFSSYTPAIDIWSIGCIFAEVLTGTPLFPGRNVVHQLDLITDLLGTPSFRSLSQIHSDKAREYLLGMPRKRPIPFSHKFRNADPLALRLLERLLAFDPKDRPTAEEALADPYFSGLSKLELEPSAQPISKVDFEFEGRKLTKAGVREMIYREILEYHPQMLQEYIEGGDQIHFLYPSGVDRFQRQFAHLEENYRRGVASTPPRRQPTSLPRERVCSSEDGHSQDSDSEEQRAASYVARTTISPPRSQEEGGKLQPAYQSAAAAADSCAKSYLKGAASISSASRRTIKGDNGRKEKESPRL

SEQ ID NO: 5593 - protein, 41 aa, Zea mays
  Clone ID: PAT_MRT4577_40589C.1.pep
HHGLRNLSASINHPSQTCSSISITLPPKRQGGHRNARAIRG

SEQ ID NO: 5594 - protein, 115 aa, Zea mays
  Clone ID: PAT_MRT4577_40836C.1.pep
SLVTLWKREDRGAAYLRMASATRFHPRLAMVAQTGVLSFTAADEAELLVMRGDLAASSRCGGGSAGDGGRYRGVPVSILVREMNGTCRGLRLDGGHRSGSVALSIANNTTHYREL

SEQ ID NO: 5595 - protein, 476 aa, Zea mays
  UNSURE (1)..(476): unsure at all Xaa locations
  Clone ID: PAT_MRT4577_40856C.1.pep
  unsure (1)..(476): unsure at all Xaa locations
MAGGFRVLHLVRPFLAFLPEVQSADRKIPFREKVIYTVISLFIFLVCSQLPLYGIHSTTGADPFYWMRVILASNRGTVMELGITPXIVTSGMVMQLLVGSKIIEVDNSVREDRALLNGAQKLLGILIAIGEAVAYVLSGMYGSVSQLGTGNAILIILQLFFAGIIVICLDELLQKGYGLGSGISLFIATNICENIIWKAFSPTTINSGRGAEFEGAVIALFHLLITRSDKVRALREAFYRQNLPNGDHLLATVLVFLIVIYFQGFRVVLPVRSKNARGQQGSYPIKLFYTSNMPIILHSALITNLYFISQLLYRKYSGNFLVNLLGIWKESEYSGHSIPVGGLAYYVTAPSSMADILANPFHALFYVVFMLSACALFSKTWIEVSGSSAKDVAKQLKEQQMVMPGHRESNLQKELNRYIPTAAAFGGVCIGALTVLADFMGAIGSGTGILLAVTIIYQYFETFEKERATELGFFGF

SEQ ID NO: 5596 - protein, 102 aa, Zea mays
  UNSURE (1)..(102): unsure at all Xaa locations
  Clone ID: PAT_MRT4577_4090C.1.pep
  unsure (1)..(102): unsure at all Xaa locations
MASKVFXLLMLLGIFVSAATATNFAHCLQALIAFLLTSYLSPAVSLVSENSILKPYKMQQAIASDIXNIXPLILQQSYDLLQLLPMERLLAQNIRAHQLLRL

SEQ ID NO: 5597 - protein, 105 aa, Zea mays
  UNSURE (1)..(105): unsure at all Xaa locations
  Clone ID: PAT_MRT4577_40967C.1.pep
  unsure (1)..(105): unsure at all Xaa locations
MAASDXVECRWFLGGLTWATDDHSLHNSLSTYGEVLXSKIMLDRETQRSPGFSFVTFYTEEAMRNTIKVMNRNELDGRNMTDNEAHSLGGRGGGGGGYGGSRGGG

SEQ ID NO: 5598 - protein, 237 aa, Zea mays
  Clone ID: PAT_MRT4577_40999C.1.pep
MAAAVVDDAGMDAVQKRLMFEDECILVDEQDNVVGHESKYNCHLMEKIDSENLLHRAFSVFLFNSKYELLLQQRSATKVTFPLVWTNTCCSHPLYRESELIQENYLGVRNAAQRKLLDELGIPAEDAPVDQFTPLGRMLYKAPSDGKWGEHELDYLLFIVRDVKVQPNPDEVADVKYVNRDELKELIRKADAGEDGVKISPWFRLVVDNFLMGWWDHVEKGTLGEAVDMETIHKLKE

SEQ ID NO: 5599 - protein, 150 aa, Zea mays
  Clone ID: PAT_MRT4577_41025C.1.pep
MAAPVVDAEYLRQVDRARRALRALIASKGCAPIMLRLAWHDAGTYDVNTRTGGANGSIRYEEEYTHGSNAGLKIAIDLLEPIKAKHPKITYADLYQLAGVVAVEVTGGPTVEFIPGRRDSSVCPREGRLPDAKKGAPHLRDIFYRMGLTD

SEQ ID NO: 5600 - protein, 829 aa, Zea mays
  UNSURE (1)..(829): unsure at all Xaa locations
  Clone ID: PAT_MRT4577_41083C.1.pep
  unsure (1)..(829): unsure at all Xaa locations
PRVRARLPLSRIVPISPNELNLYRIVIVLRLIILCFFFQYRITHPVEDAYGLWLVSVICEVWFALSWLLDQFPKWYPINRETYLDRLALRYDREGEPSQLXAPIDVFVSTVDPLKEPPLITGNTVLSILAVDYPVDKVSCYVSDDGSAMLTFEALSETAEFARKWVPFCKKHNIEPRAPEFYFARKIDYLKDKIQPSFVKERRAMKRECEEFKVRIDALVAKAQKIPEEGWTMADGTPWPGNNPRDHXGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDLHDRYANRNIVFFDINMKGLDGIQGPVYVGTGCCFNRQALYGYDPVLTEADLEPNIIIKSCCGGRKKKDKSYIDSKNRDMKRTESSAPIFNMEDIEEGFEGYEDERSLLMSQKSLEKRFGQSPIFIASTFMTQGGIPPSTNPGSLLKEAIHVISCGYEDKTEWGKEIGWIYGSVTEDILTGFKMHARGWISIYCMPLRPCFKGSAPINLSDRLNQVLRWALGSVEILLSRHCPIWYGYNGRLKLLERLAYINTIVYPITSIPLVAYCVLPAICLLTNKFIIPAISNYAGAFFILLFASIFATGILELRWSGVGIEDWWRNEQFWVIGGTSAHLFAVFQGLLKVLAGIDTNFTVTSKATDDDGDFAELYVFKWTTLLIPPTTVLVINLVGIVAGVSYAINSGYQSWGPLFGKLFFAIWVILHLYPFLKGLMGKQNRTPTIVIVWSVLLASIFSLLWVKIDPFISPTQKALSRGQCGVNC

SEQ ID NO: 5601 - protein, 229 aa, Zea mays
  Clone ID: PAT_MRT4577_41105C.1.pep
AARAGGRVFFASPDHYLKHQTVYNANELADLVEKKKKMRNWLDYYQNKLERKSKRPTTKTGFLGCFGSEVDAIDHCKSEIEKIGKEEAEERKKVMKDPKSIMPAAFVSFRSRWGAAVCAQTQQTSNPTLWLTEWAPEPRDVYWSNLSIPFVSLTVRRLIIGVAFFFLNFFYVIPIAFVQTLANLEGIEKALPFLKPLIESPPIKSFIQGFLPGLAPKIFLIVLPTILMY

SEQ ID NO: 5602 - protein, 78 aa, Zea mays
  UNSURE (1)..(78): unsure at all Xaa locations
  Clone ID: PAT_MRT4577_41116C.1.pep
  unsure (1)..(78): unsure at all Xaa locations
MACATELKFFFLPKKSEWGATRQAGAPRPTTGFMVERAFVYADELGKTVKTIAFSGRSILATDXSXNATCGKRMAIIV

SEQ ID NO: 5603 - protein, 200 aa, Zea mays
  UNSURE (1)..(200): unsure at all Xaa locations
  Clone ID: PAT_MRT4577_41145C.1.pep
  unsure (1)..(200): unsure at all Xaa locations
RTRHQPEASGCENPMLXAYRIHQAXAAGILPLSPLLLQQSSALLQQPPVDACIVXRNIRAQHLPQLALAYRAVYSQQQQFLPFNRLAALNCASYLQQHQLPFSQLPGAYPQXFVTFNQLXVLNSPAYLQQQQLLPFSQLAGVSPGTFLTQPQSMPIYQRXAPNAGTXLLQLQQLLPFNQRALTNLAVIYQQPIIGXGALF

SEQ ID NO: 5604 - protein, 31 aa, Zea mays
  Clone ID: PAT_MRT4577_41162C.1.pep
VFKDCKILVCPQCYVLRSLKDKYMRFMACGA

SEQ ID NO: 5605 - protein, 156 aa, Zea mays
  UNSURE (1)..(156): unsure at all Xaa locations
  Clone ID: PAT_MRT4577_4155C.1.pep
  unsure (1)..(156): unsure at all Xaa locations
MSEEKHHHFFNHHKKDEEQPAGEYGYSETEVVTATGEGEYERYKKEEKEHKHKQHLGEGGAIGAGAFALYYKHXANKDPEHAHRHRITEEDNAAEGDGAGEYIFHGHHXEKKKDHKERQGRIADEKKHHPLFGMTEGPRGSITQLASSGARNHAPV

SEQ ID NO: 5606 - protein, 65 aa, Zea mays
  Clone ID: PAT_MRT4577_41589C.1.pep
VIVCWGLGNRAWAGRGGAEAGHVVGDGEEGGALRSGGQAVSACFILVIRPEQRQHPPPCIDPDAW

SEQ ID NO: 5607 - protein, 78 aa, Zea mays
  Clone ID: PAT_MRT4577_42217C.1.pep
VVLTRVRTPRDSHQEYTVSRDSRHASRIQADRRRDTHLQDGGRRLHRMHGFRQLQRSPAQEQHQAPSDQLYAWGVGSR

SEQ ID NO: 5608 - protein, 40 aa, Zea mays
  Clone ID: PAT_MRT4577_42224C.1.pep
HEIVGNILHCSSLIRSRFWMILRASTLITVVQTCHTSNRY

SEQ ID NO: 5609 - protein, 205 aa, Zea mays
  UNSURE (1)..(205): unsure at all Xaa locations
  Clone ID: PAT_MRT4577_42323C.1.pep
  unsure (1)..(205): unsure at all Xaa locations
RLALSVENTSSGREYKVKDLSQADFGRLEIELAEVEMPGLMACWGEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKVEEDYEKTGKIPDPESTDNAEFKIVLTIIRDGLKGDXQEYRKMNDRLVGVSE

SEQ ID NO: 5610 - protein, 461 aa, Zea mays
  Clone ID: PAT_MRT4577_42325C.1.pep
TDVAAVPPVVALAADGQAGAEEIVLQPIKEISGTVKLPGSKSLSNRILLLAALSEGTTVVDNLLNSEDVHYMLGALRTLGLSVEADKAAKRAVVVGCGGKFPVEDAKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVTIRDPGCTRKTFPDYFDVLSTFVKN

SEQ ID NO: 5611 - protein, 84 aa, Zea mays
  Clone ID: PAT_MRT4577_42338C.1.pep
PRVRPRVRARDNKKTRIIPRHVLLAIRNDEELGKLLAGVTIAHGGVLPNINPVLLPKKVAEKAASGGSKEAKSPKKAAKSPKKA

SEQ ID NO: 5612 - protein, 131 aa, Zea mays
  UNSURE (1)..(131): unsure at all Xaa locations
  Clone ID: PAT_MRT4577_42475C.1.pep
  unsure (1)..(131): unsure at all Xaa locations
MAYGIALKFSFLSKKTEWGATRQVAEPRPTTVFMVVRASGYPDELVKTVKTIASAGRDILSMDESNATCGKRLASIVLENTEANRQAYRTLLVTAPDLGXYISGAILFEETLHQSDVDGRMIVYMLVEQGI

SEQ ID NO: 5613 - protein, 181 aa, Zea mays
  Clone ID: PAT_MRT4577_42487C.1.pep
MSTTEDERSGAAAEAGGGEEERRERSVGLMAGLVDRAKGFVVEKVAQIPKPEAALDRVSFQSISREGVELHSHVDVSNPYSHRIPICEITYTFKSAGKVIASGMMPDPGWIAASGSTKLELPVKVPYDFILTLMKDLGGDWDIDYLLEVGLTIDLPVIGAFTIPLTTEGEIKLPTFRDLLF

SEQ ID NO: 5614 - protein, 143 aa, Zea mays
  UNSURE (1)..(143): unsure at all Xaa locations
  Clone ID: PAT_MRT4577_42542C.1.pep
  unsure (1)..(143): unsure at all Xaa locations
SSFHYPCSISSCLLHLFHLKKDEEQLAVGGYAXSSEYSXATLTELVSSAENEYYQYKKQXKEHKHNQHLGESGAIAAGAFALYXKHEANKDPQHAHHRKIEEEVPSSSSVGSVGFAFYERHQKKKDHKQSKQAVGEKKHHFFG

SEQ ID NO: 5615 - protein, 509 aa, Zea mays
  Clone ID: PAT_MRT4577_42559C.1.pep
MSTIAASRRSSSSSSSATAKRPAIADGPGGPKATAAQAKKRVALGNITNVAARGGRASVGGSLGNVMAPTSSAKLNPTVPLKKPSLATSARSVSSSIRGSADKPASIKPAPPVARHGSATQRHNNVPPPKVPTIADVPSRAPALVSCTGLVSPGRSGDSVSSDETMSTCDSMKSPDFEYVDNQDTSMLASLQRRTSEHLRISEDRDVEENKRKKNAVAPMEIDRICDVDSEYEDPQLCATLASDIYMHLREAETKKRPSTDFMETIQKDVNPSMRAILIDWLVEVAEEYRLVPDTLYLTVNYIDRYLSGNEISRQRLQLLGVACMLIAAKYEEICAPQVEEFCYITDNTYFRDEVLDMEASVLNYLKFEMTAPTAKCFLRRFARAAQACDEDPALHLEFLANYIAELSLLEYSLLSYPPSLIAASAIFLARFILQPTKYPWNSTLAHYTQYKPSKLSECVKALHRLCSVGSGSNLPAIREKYSQHKYKFVAKKQCPPQIPTEFFRDATC

SEQ ID NO: 5616 - protein, 251 aa, Zea mays
  Clone ID: PAT_MRT4577_42575C.1.pep
MDSRVVDGAGGGADASLPADPPSPVPDPAAGGMDARLPSDLLRAVLQRLPPIDLARSACVCRAWRAVASDRAVVEAAFCAPWGVRRVVGEPATGAFWRAASLGRFALSHAIRRGDTVPGVALKYSVQVTDIKRFNNMMSDHGIYSRERLLVPISNPEILLGSTCYIEMDHNAKREVAIFYPEGRPGGKTDSVASIVSAERRNKRILESVRRSLHVDDGTAAYYLSVTEGDPRAAMTEYSEDLRWEQQRAGR

SEQ ID NO: 5617 - protein, 97 aa, Zea mays
  UNSURE (1)..(97): unsure at all Xaa locations
  Clone ID: PAT_MRT4577_42576C.1.pep
  unsure (1)..(97): unsure at all Xaa locations
RARVRSSPSIPDRVRVRKGRQGSVSWVSGSRWRRHDVEYRCFIGGLAXATDDHSIHNAYSTXGEDLESKIIHDRQTHRSLSFCYVTFSTEVAMRNAI

SEQ ID NO: 5618 - protein, 455 aa, Zea mays
  Clone ID: PAT_MRT4577_42605C.1.pep
METQAPEKENYLPEKDARSAREKAIDEWLPITSSRNAKWWYSAFHNVTAMVGAGVLSLPYALSELGWGPGIAVLVVSWVITLYTLWQMVEMHEMVPGKRFDRYHELGQHAFGEKLGLWIVVPQQLVVEVGVNIVYMVTGGRSLKKFHDVLVCGDGGASCEGKDNIKTTYFIMIFASVHFVLSQLPNFNSISGVSLAAAVMSLSYSTIAWGASVDKGRMAGVDYHLRATTTPGKVFGFFGALGDVAFAYAGHNVVLEIQATIPSTPEKPSKKPMWKGVVVAYVVVALCYFPVALIGYWAFGNSVQDNILITLSRPRWLIALANMMVVIHVIGSYQIYAMPVFDMIETVLVKKLRFPPGLTLRLISRTAYVAFTMFIAITFPFFGGLLGFFGGFAFAPTTYFLPCVMWLAIYKPKRFSLSWFTNWICIILGVILMILSPIGGLRQIIMDAKTYQFYS

SEQ ID NO: 5619 - protein, 182 aa, Zea mays
  UNSURE (1)..(182): unsure at all Xaa locations
  Clone ID: PAT_MRT4577_42655C.1.pep
  unsure (1)..(182): unsure at all Xaa locations
ASPSAPLSISLLRLLLDPAKPGIRDSEEHHFESKADAGXSKTXPQQAGTXRXNGFIVIKNRPPXVXEXSTSKTXKHGHAKXHCVXIXIFNGKKXEEIVPSSHNXXXPHXNRTEYQXSXKXXDGFXSLLTSEGNTKDDLRLXTXETLVAHIKEGFXSCKDXVVTFQSXIGEEQNXXPKDVGPX

SEQ ID NO: 5620 - protein, 987 aa, Zea mays
  Clone ID: PAT_MRT4577_42664C.1.pep
MMESAAAQSCAACGDDARAACRACSYALCRACLDEDAAEGRTTCARCGGDYAAINPARASEGTEAEEEVVENHHTAGGLRERVTMGSHLNDRQDEVSHARTMSSLSGIGSELNDESGKPIWKNRVESWKEKKNEKKASAKKTAAKAQPPPVEEQIMDEKDLTDAYEPLSRVIPISKNKLTPYRAVIIMRLIVLGLFFHYRITNPVNSAFGLWMTSVICEIWFGFSWILDQFPKWYPINRETYVDRLIARYGDGEESGLAPVDFFVSTVDPLKEPPLITANTVLSILAVDYPVEKISCYVSDDGSAMLTFESLAETAEYARKWVPFCKKYAIEPRAPEFYFSQKIDYLKDKIHPSFVKERRAMKRDYEEYKVRINALVAKAQKTPDEGWIMQDGTPWPGNNPRDHPGMIQVFLGETGARDFDGNELPRLVYVSREKRPGYQHHKKAGAMNALVRVSAVLTNAPYILNLDCDHYVNNSKAVREAMCFMMDPTVGRDVCYVQFPQRFDGIDRSDRYANRNVVFFDVNMKGLDGLQGPVYVGTGCCFNRQALYGYGPPSLPALPKSSICSWCCCCCPKKKVERSEREINRDSRREDLESAIFNLREIDSCFSDYDEYERSMLISQMSFEKSFGLSSVFIESTLMENGGVPESANPSTLIKEAIHVISCGYEEKTEWGKEIGWIYGSVTEDILTGFKMHCRGWRSIYCMPVRPAFKGSAPINLSDRLHQVLRWALGSVEIFFSRHCPLWYGYGGGRLKWLQRLSYINTIVYPFTSLPLVAYCCLPAICLLTGKFIIPTLSNAATIWFLGLFMSIIVTSVLELRWSGIGIEDWWRNEQFWVIGGVSAHLFAVFQGILKMIAGLDTNFTVTAKATDDTEFGELYLFKWTTVLIPPTSILVLNLVGVVAGFSAALNSGYESWGPLFGKVFFAMWVIMHLYPFLKGLMGRQNRTPTIVVLWSVLLASVFSLLWVKIDPFVGGTETVNTNNCNTIIC

SEQ ID NO: 5621 - protein, 232 aa, Zea mays
  Clone ID: PAT_MRT4577_42708C.1.pep
MAPSLLGGFTKSLAMTVLSEIGDKTFFAAAILAMRHPRKLVLAGCLTALIVMTALSASLGWVAPNLISRKWTHHLTTLLFFLFGIWSLWEGFKEDGDSEELAEVEAELDAAFKSNKGESKNKFKANDDMKKQQRPFLMQFFSPIFLKAFSITFFGEWGDKSQIATIGLAADENPFGVVLGGIIAQALCTTAAVLGGKSLASQISEKMVELSSGVLFLLFGIMSLLSGPEGEL

SEQ ID NO: 5622 - protein, 219 aa, Zea mays
  Clone ID: PAT_MRT4577_42710C.1.pep
MVLGACVQGFTKSLAMTVLSEVGDKTFFAAAILAMRHPRKLVLAGCLTALIVMTALSASLGWVAPNLISRKWTHHVTTLLFFVFGIWSLWEGFKEDGDSEELAEVEAELDAVFKSNKGESKTKFKANDDMKKQQRPFLMQFFSPIFLKAFSITFFGEWGDKSQIATIGLAADENPFGVVLGGIIAQALCTTAAVLGGKSLASQISEKMVGTRLIFFALL

SEQ ID NO: 5623 - protein, 231 aa, Zea mays
  Clone ID: PAT_MRT4577_42713C.1.pep
MAPSLLGGFTKSLAMTVLSEVGDKTFFAAAILAMRHPRKLVLAGCLTALIVMTALSASLGWVAPNLISRKWTHHVTTLLFFVFGIWSLWEGFKEDGDSEELAEVEAELDDVFKSNKGESKNKTKANDDTKKQQRPFLMQFFSPIFIKAFSITFFGEWGDKSQIATIGLAADENPFGVVLGGIIAQALCTTAAVLGGKSLASQISEKMVELSSGVLFLLFGIMSLLSGPGEL

SEQ ID NO: 5624 - protein, 234 aa, Zea mays
  Clone ID: PAT_MRT4577_42714C.1.pep
MAPSLLGGFTKSLAMTVLSEIGDKTFFAAAILAMRHPRKLVLAGCLTALIVMTALSASLGWVAPNLISRKWTHHLTTLLFFLFGIWSLWEGFKEDGYRDSEELAEVEAELDAAFKSNKGESKNKFKANDDMKKQQRPFLMQFFSPIFLKAFSITFFGEWGDKSQIATIGLAADENPFGVVLGGIIAQALCTTAAVLGGKSLASQISEKMVELSSEVLFLLFGIMSLLSGPEGEL

SEQ ID NO: 5625 - protein, 111 aa, Zea mays
  UNSURE (1)..(111): unsure at all Xaa locations
  Clone ID: PAT_MRT4577_42811C.1.pep
  unsure (1)..(111): unsure at all Xaa locations
QLFLFCNNGRSLLLVPTAAGRGRGGPGSGAAAAGSEGAGTASAAASCRQATSSVAPCLGYAMGSAAXPSAACCIEVRSLNRRASSAADRQATCNWLTSMTGQFGCGISMDN

SEQ ID NO: 5626 - protein, 116 aa, Zea mays
  UNSURE (1)..(116): unsure at all Xaa locations
  Clone ID: PAT_MRT4577_42956C.1.pep
  unsure (1)..(116): unsure at all Xaa locations
GPLTHAWDMQQQQRARSQLPEADPQQDLPVSQLAPLNSRANLPQQQQLPLSQLDGVSPGTLLTQPQLSPFPQHVAREGGTLXQLQQPPPPHQLALTNPAVFYQQPIIGGALLLDLL

SEQ ID NO: 5627 - protein, 357 aa, Zea mays
  Clone ID: PAT_MRT4577_43021C.1.pep
MEALHEEMPFDLDFHPSSPLVVTSIITGELCLFRYGPESQPERLLLLKAHKESCRAVRFVDSGKVILSGSADCSVLASDVESGKAIARLEDAHENAINRLVCLTESTIATGDDEGCIKVWDTRERSCCNSFEVHDDYISDMTYVAETNQILATSGDGTLSVNNLRRNKVRSRSEFSEDELLSLVLMKHGKKVVCGTPSGALLLYSWGYFNDCSDRFIGHTQSVDTMLKLDEDTLVSGSSDGVIRLVGILPNRIKQPLAEHSEYPIEALALSNDKKYLGSISHDKMLKLWDLEELLSGPQVANGDEPAEAGSDDSDDDSDDDVMDVDMAATSSKGSRSKKAGKGQSSSRPASDFFADL

SEQ ID NO: 5628 - protein, 208 aa, Zea mays
  Clone ID: PAT_MRT4577_43023C.1.pep
MGFPVGYSESEMLLPRVLLQVLLLLGHFHRFLLWAFHAVGLGDLIDLGCNYPPPPPSASTAHEMMEHQHQHQGRDDVASPLQHQRPEFRPVAAALIEEALPVVRFDELGGAPCGGGDCAVCLSGIGGGDEVRRLGNCRHAFHRACLDRWMAHDQRTCPLCRAPLIPWAADADADAADYDMSYPSPLPPTPLRRPHELLLLLTGLGGFQ

SEQ ID NO: 5629 - protein, 137 aa, Zea mays
  UNSURE (1)..(137): unsure at all Xaa locations
  Clone ID: PAT_MRT4577_43051C.1.pep
  unsure (1)..(137): unsure at all Xaa locations
ATKNKSLEKAFASLGEILDSKVISDRETGRSPGLGFVTFSSENSMLDAIENMNGKELDGRNITVNQAQSRVGGGDSGGYIGGRGGGGYGGGPRDGGXGGGGGFGGRPKGGGGGYEGGGGYAGRRKGGGGGXGGGGGG

SEQ ID NO: 5630 - protein, 102 aa, Zea mays
  UNSURE (1)..(102): unsure at all Xaa locations
  Clone ID: PAT_MRT4577_43129C.1.pep
  unsure (1)..(102): unsure at all Xaa locations
ITHCSDLILCIATQVKATNGDTFLGGEDFDNTLLEFLVSDFKKTEGIDLSKDRLALQRLREAAXKAKVELFVTFXTEINLPFITADASWAKHLNITLARSKF

SEQ ID NO: 5631 - protein, 492 aa, Zea mays
  Clone ID: PAT_MRT4577_43220C.1.pep
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFGVNTYSLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAISVPGIHYSDDKLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHHTIWISYWSQCDAALGQKLASRLNLKPNM

SEQ ID NO: 5632 - protein, 493 aa, Zea mays
  UNSURE (1)..(493): unsure at all Xaa locations
  Clone ID: PAT_MRT4577_43221C.1.pep
  unsure (1)..(493): unsure at all Xaa locations
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFGVNTYTLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAIIVPGIHYSDDKLLQTRIFSYADTQRHRLGPNYLMLPVNAPKCAXHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLASRLNLKPSM

SEQ ID NO: 5633 - protein, 110 aa, Zea mays
  UNSURE (1)..(110): unsure at all Xaa locations
  Clone ID: PAT_MRT4577_43251C.1.pep
  unsure (1)..(110): unsure at all Xaa locations
LKSNTGGWGAPNQLFGAQGNWVRLFPGEGQTSPFXNQPKPXAGPVPPFHPKIALRRGVLSAQCSKIMPPFFPLRRKKKPQSPPQGPPHGPPHPVKFFSKMPPMFGPIFCL

SEQ ID NO: 5634 - protein, 69 aa, Zea mays
  UNSURE (1)..(69): unsure at all Xaa locations
  Clone ID: PAT_MRT4577_43692C.1.pep
  unsure (1)..(69): unsure at all Xaa locations
GSPXFGFVAQRIEIAASDVEYRXFVGRLSWATDDHYLHNAFSTYGEVLESKIILDHQTQSSHMFCFITF

SEQ ID NO: 5635 - protein, 209 aa, Zea mays
  UNSURE (1)..(209): unsure at all Xaa locations
  Clone ID: PAT_MRT4577_43716C.1.pep
  unsure (1)..(209): unsure at all Xaa locations
MGGFGKTHKSTAYLKRFQIKINRRRAAKTDYTARIRLFNHDTDMYNTPKYRFGGRFTNKDITAHMIFDSIAGDMVLACAYSHELPRYGLEGGLTNYASAYCTGLMMHPRVLKTRCLHTEYQGNVXAIGEDFSVEPTDEMTPSQALLDVSLIRTTTWNRAFCALKGSLDGGLNIPHSEKRFAGFKNDDKQLXDADIHRKYIYGGQCDDYM

SEQ ID NO: 5636 - protein, 51 aa, Zea mays
  Clone ID: PAT_MRT4577_43883C.1.pep
PASSACGVVAVTVIGHAVSHFDGHVAEHARHLGRSASCDDRIHIIRLTIEC

SEQ ID NO: 5637 - protein, 63 aa, Zea mays
  UNSURE (1)..(63): unsure at all Xaa locations
  Clone ID: PAT_MRT4577_43927C.1.pep
  unsure (1)..(63): unsure at all Xaa locations
GERSLNSCASTAADRHATWNCLKSMTGXSASGVSMANAGNIHSKCSVSVGVPISRTVDCTKIN

SEQ ID NO: 5638 - protein, 149 aa, Zea mays
  UNSURE (1)..(149): unsure at all Xaa locations
  Clone ID: PAT_MRT4577_43992C.1.pep
  unsure (1)..(149): unsure at all Xaa locations
FVGVLAXATSNESLENAFVSYGEIVDSKVITDRXTERSRGFRFVTFSCENYMLDAIENMNGWELDCRNITGNQAQSRGGGGVGGDYGVVRGGGGGYDGGRRDGGYGGGGGYGGRREGGSVGYRGGGGYSGRREGGGGGYGVGGGVGWRD

SEQ ID NO: 5639 - protein, 524 aa, Zea mays
  Clone ID: PAT_MRT4577_43995C.1.pep
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYIAVRFLIGFSLATFVSCQYWMSTMFSSKIIGTVNGLAAGWGNMGGGATQLIMPLVYDVIRKCGATPFTAWRLAYFVPGLMHVVMGVLVLTLGQDLPDGNLRSLQKKGNVNKDSFSKVMWYAVINYRTWIFVLLYGYCMGVELTTDNVIAEYMYDRFDLDLRVAGTIAACFGMANIVARPMGGIMSDMGARYWGMRARLWNIWILQTAGGAFCLWLGRASTLPVSVVAMVLFSFCGQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHV

SEQ ID NO: 5640 - protein, 153 aa, Zea mays
  Clone ID: PAT_MRT4577_44045C.1.pep
MDYSNLRRQAASMKKTLFDQGYLDEQFCQVEDLQDEASPNFAEEVVTLFFKDSARLISNAEQALEKYPKDFNRWDAYMQQLKGSCSSIGASRMKSECVSFRDYCGQGNVEGCMRSFQKVKREHGALRQKLEAYFQLLRQAGPAGAATRPGCKN

SEQ ID NO: 5641 - protein, 379 aa, Zea mays
  Clone ID: PAT_MRT4577_44373C.1.pep
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDGEFKTPPMNFLNERTLKGAFFGNYKPRPDLPNVVELYIKKELEVEKFITPRVPFAEINKGFDLMAKGEGIRCIIRMEK

SEQ ID NO: 5642 - protein, 379 aa, Zea mays
  Clone ID: PAT_MRT4577_44375C.1.pep
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIGDGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFNLMAKGEGIRCIIRMEN

SEQ ID NO: 5643 - protein, 379 aa, Zea mays
  Clone ID: PAT_MRT4577_44376C.1.pep
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 5644 - protein, 377 aa, Zea mays
  Clone ID: PAT_MRT4577_44377C.1.pep
MATAGKVIKCKAAVAWEAGKPLSIEEVEVAPPQAMEVRVKILFTSLCHTDVYFWEAKTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 5645 - protein, 412 aa, Zea mays
  UNSURE (1)..(412): unsure at all Xaa locations
  Clone ID: PAT_MRT4577_44378C.1.pep
  unsure (1)..(412): unsure at all Xaa locations
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKXIAKCCSFGFLTSRAFAEKLLRIVPAILLGSAQELEVEKFITHSVPFAEINKAFDLMAKGEGIRCIIRMEN

SEQ ID NO: 5646 - protein, 166 aa, Zea mays
  Clone ID: PAT_MRT4577_44488C.1.pep
MADDGGSHEGSGGGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQVIYRTVIC

SEQ ID NO: 5647 - protein, 104 aa, Zea mays
  UNSURE (1)..(104): unsure at all Xaa locations
  Clone ID: PAT_MRT4577_44618C.1.pep
  unsure (1)..(104): unsure at all Xaa locations
PNEXKGATKQXKQAQNXQYEKPAAQLQIKKAIAVDKLPKSLTAKRQIPTTFGTPRWTKTQRQYLWQQKSRGHAEERKQPHKNSPSKRGSLPLGPPPHSQEPDDG

SEQ ID NO: 5648 - protein, 95 aa, Zea mays
  Clone ID: PAT_MRT4577_44721C.1.pep
HHFFSAHDLEKIQETARNLMDEHSKDTIVLVTEKDYDRDPEALKTLDANVWVLSSSLQIMHHSKQGEDEFMRKVNEIITVTWCAKSHAADRATGC

SEQ ID NO: 5649 - protein, 67 aa, Zea mays
  Clone ID: PAT_MRT4577_44955C.1.pep
KRPKCFLIKTGFWGPFAFKVFILNGPNFGGGVWLFCETAKPGFCYENLLSVSMLTSHVAPCWISLNK

SEQ ID NO: 5650 - protein, 483 aa, Zea mays
  UNSURE (1)..(483): unsure at all Xaa locations
  Clone ID: PAT_MRT4577_45001C.1.pep
  unsure (1)..(483): unsure at all Xaa locations
MGLLGMMGDSFGCSATGERLVSAARDGDIQEARALLELNPRLARYSTFGIRNSPLHYSAAKGHHEIVSLLIESGVNINLRNCRGQTALMQACLYGHWKVVQILVLFKANIHRRDCFSGATAIHFAALKGHTRCIRLLVADYVPSLSEFWTIMRGKSTDEMKKGAFDAASLQRLVNGKSDGGVTPLHLAALHGHAESVQLLLDLGASVSEVTXMMVQQLTSLVRGAHPSITRRVVEVLFAAXLIAAGANMGAQNVNGLTPLLVARSWHKTSIEGILSKQPENRMRILPSPYLCLPLMSIVKIARECGWRKTSASSTCQDPCVICLEVECTVAAEGCGHEFCTKCALYLCSTTSSSTSTRGVPGSISCPLCRHAIVSFMRLTSTTPIKELPWTSASLALCAAGSNTGRPEHGGSLHRRPDLRRLRSISVQLGCSSFRSIGSGKLSSMKLNCTGAEEAVPCLVSCLRPDVQRSSSYRGRIRRYSEF

SEQ ID NO: 5651 - protein, 230 aa, Zea mays
  Clone ID: PAT_MRT4577_45018C.1.pep
SVEGGFSVAFDPLDGSSIVDTNFTVGTIFGVWPGDKLTGVTGGDQVAAAMGIYGPRTTYIVALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLMEKAGGYSSDGKQSVLPGGINELDERTQVAYGSKNEIIRFEETLYGSSRLAASATATARALI

SEQ ID NO: 5652 - protein, 386 aa, Zea mays
  UNSURE (1)..(386): unsure at all Xaa locations
  Clone ID: PAT_MRT4577_45021C.1.pep
  unsure (1)..(386): unsure at all Xaa locations
MEIVATRSPACCAAVSFSQSYRPKASRPPTTFYGESVRVNTARPLSARRQSKAASRAALSARCEIGDSLEEFLTKATPDKNLIRLLICMGEAMRTIAFKVRTASCGGTACVNSFGDEQLAVDMLANKLLFEALEYSHVCKYACSEEVPELQDMGGPVEGGFSVAFDPLDGSSIVDTNFTVGTIFXGVWPGDKLTGVTGGDQVAAAMGIYGPRTTYIVALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLMEKAGGYSSDGKQSVLDRVINELDERTQVAYGSKNEIIRFEETLYGSSRLAASATATARALI

SEQ ID NO: 5653 - protein, 170 aa, Zea mays
  UNSURE (1)..(170): unsure at all Xaa locations
  Clone ID: PAT_MRT4577_45643C.1.pep
  unsure (1)..(170): unsure at all Xaa locations
MASSTXMALSSTAXAVKAANLPSSSAFGEARMSMLNTAFKVXSADASGSPCYCPDRVLYLGPLSGEPPSYLTVXFPGDYGWNTAGLWAYPETFCRYXEVNVIHCRWTLMSAFGCVFPQLTRRLRVKXLGRAVLEXGSQIFNMEGVXYLGNPRLLYAQSMLYYLGDATACS

SEQ ID NO: 5654 - protein, 458 aa, Zea mays
  Clone ID: PAT_MRT4577_4573C.1.pep
MVGSVHVNGSVHGGNGTATEERLDELRRLLGKSEGDLLKIVSVGAGAWGSVFAALLQDAYGHFRDKVQIRIWRRPGRTVDRSTAEHLFEVINSREDVLRRLIRRCAYLKYVEARLGDRTLYADEILKDGFCLNMIETPLCPLKVVTNLQEAVWDADIVVNGVPSTETREVFDEISEYWKERISVPVIISLAKGIEASLDPIPRIITPTQMISSATGVPTENILYLGGPNIASEIYNKEYANARICGSNKWRKPLAKFLRQPHFIVWDNSDLVTHEVMGGLKNVYAIGAGMVAALTNESATSKSVYFAHCTSEMIFITHLLTEQPEKLAGPLLADTYVTLLKGRNAWYGQMLAKGELSPDMGDSIKGKGMIQGISAVGAFFELLSQPSLSVQHPEENKQVAPAELCPILKRLYRILIKRELPARDILQALRDETMNDPRERIEMAQSHAFYRPSLLGKP

SEQ ID NO: 5655 - protein, 246 aa, Zea mays
  Clone ID: PAT_MRT4577_4576C.1.pep
MAARKKKPLLIACQATSARITRSQAAANSTRSGLAPSVPVPLKTEHNHAAKKKMKREASDENASADAGASAPLPKRRTVLKNVTNISCAKISKRCTAVTGLKLGPSQKAGQSINKQCTNKISMLLPLAVGGSSLVDDSNNAEETQMVDLLAQKEKQIVLLKEAQPLQNTEQNKGGACDEASVEERNAMNVHETAALKAGVSNGLNIVDIDKNNGDPQMCVTYVAEIYRNLMASEVCYLFLVKNRIF

SEQ ID NO: 5656 - protein, 70 aa, Zea mays
  UNSURE (1)..(70): unsure at all Xaa locations
  Clone ID: PAT_MRT4577_45936C.1.pep
  unsure (1)..(70): unsure at all Xaa locations
QQQQGPFSQLXAGVNPSTFLTQPQLLPFXQHVAPNAGPLLQLQQFQPFNQLALTNPAVFYQQPIIGGALF

SEQ ID NO: 5657 - protein, 146 aa, Zea mays
  UNSURE (1)..(146): unsure at all Xaa locations
  Clone ID: PAT_MRT4577_46026C.1.pep
  unsure (1)..(146): unsure at all Xaa locations
GASGAQAGRPMKXSGTRPERPACSKPXGRLWLYLKXGRSAQCVGTGAPVYLXADLEYLAFXVLELARNAGRXDNKKTPMMPRHVLLAIRNDEELEKLLVGETIEHGGVLANIHSVLLPKKAAEKAASGSSKETKSTKKGAKSPKKA

SEQ ID NO: 5658 - protein, 93 aa, Zea mays
  UNSURE (1)..(93): unsure at all Xaa locations
  Clone ID: PAT_MRT4577_46128C.1.pep
  unsure (1)..(93): unsure at all Xaa locations
PAREEHKRGGFIXAGGGSNSSSTDDDGMGGRRKKGIKEKIKEKLPGCHKDDQHATATTGGAYGQQGHTGGAYRQQGHTGCAYSTGADGTGEKK

SEQ ID NO: 5659 - protein, 166 aa, Zea mays
  Clone ID: PAT_MRT4577_46237C.1.pep
IGYLEAGRDYQSGLLPPGGLWPDDRDGHFTGDPILHDADPRRYKAFFYCNATAFMASVVIVILLLNSTISKYRRSLLPMKTAMVLDLLALLGAYAAGSCRKLKTSVYVFALVVAVFMYIVVHILLSFDKMARVMKRTGEQWVPCLKKMWALIEIEPPNHQPSSEEP

SEQ ID NO: 5660 - protein, 147 aa, Zea mays
  UNSURE (1)..(147): unsure at all Xaa locations
  Clone ID: PAT_MRT4577_462C.1.pep
  unsure (1)..(147): unsure at all Xaa locations
GLGNLAGYSXKQRLITFNQLAALSSASYLXQQQLPLSQLPAGYPQKLLTFSQLAALYSTAYLQQQQLLPFSQLAEVSPATXLIQPQLVALYQHAERNAGTLLQLQQLLPFKQLALTNTGEEYQQPMIERSTSFRFLMSYRSIIKDSG

SEQ ID NO: 5661 - protein, 124 aa, Zea mays
  UNSURE (1)..(124): unsure at all Xaa locations
  Clone ID: PAT_MRT4577_46345C.1.pep
  unsure (1)..(124): unsure at all Xaa locations
MRSVTPLEYDMKGAKSKGAAKAEAKLEVKSKGXEKTAKGRKGKDGKDPNKPKRAPSAFFEIMEEFRKGFKEKNPKNKTVAAVAKAAGDRRKSXLSEXSTKLPYAAKATQXKLQYHKALAAYQQG

SEQ ID NO: 5662 - protein, 73 aa, Zea mays
  UNSURE (1)..(73): unsure at all Xaa locations
  Clone ID: PAT_MRT4577_4657C.1.pep
  unsure (1)..(73): unsure at all Xaa locations
ECSGGKQVIHKXQNXLSKSLTNDNQISRANKTKLYLATHIALPQPTTPLFFSKSKQVLSSPFSSSDNHKKTCY

SEQ ID NO: 5663 - protein, 176 aa, Zea mays
  Clone ID: PAT_MRT4577_46737C.1.pep
STQRPDPLVVGNVVGDIVDPFITTASLRVFYNNKEMTNGSDLKPSQVMNEPRVHVGGRDMRTLYTLVMVDPDAPSPSNPTKRENLHWLVTDIPETTDASFGNEIVPYESPRPIAGIHRFAFVLFRQSVRQTTYAPGWRSNFNTRDFAAIYGLGSPVAAVYFNCQRENGCGGRRYIR

SEQ ID NO: 5664 - protein, 177 aa, Zea mays
  Clone ID: PAT_MRT4577_46740C.1.pep
MFNMSRDPLVVGNVVGDIVDPFITTASLRVFYNNKEMTNGSELKPSQVMNEPRVHVGGRDMRTLYTLVMVDPDAPSPSNPTKRENLHWLVTDIPETTDASFGNEIVPYESPRPIAGIHRFAFVLFRQSVRQTTYAPGWRSNFNTRDFAAIYGLGSPVAAVYFNCQRENGCGGRRYIR

SEQ ID NO: 5665 - protein, 72 aa, Zea mays
  Clone ID: PAT_MRT4577_46795C.1.pep
MAMAFTYAPGGGAGALAQGRCRVLGPAGLGFLGPSKGGGLPRPLALALARGMSSPVSVGARLRCAASFVPAG

SEQ ID NO: 5666 - protein, 268 aa, Zea mays
  UNSURE (1)..(268): unsure at all Xaa locations
  Clone ID: PAT_MRT4577_46815C.1.pep
  unsure (1)..(268): unsure at all Xaa locations
MATSSTGCLVLLCLASPLLLLPSAVVLGHPWGGGGGLSPQFYDHSCPMAEKIVQSVVAQAVAKETRMAASLVRLHFHDCFVKGCDASVLLDNSSSIVSEKGSNPNRNSIRGFEVVDQIKAALEAACPGTVSCADILALAARDSTALVGGPYWDVALGRRDSLGASIQDSNNDIPAPNNTLPTIITKFKRQGLNVADVVALSGGHTIGMSRCTSFRQRLYNQTGNGMADSTLDVSYAARLRQSCPRSGADSTLFPXLDVVAPAKFDNFY

SEQ ID NO: 5667 - protein, 263 aa, Zea mays
  Clone ID: PAT_MRT4577_47013C.1.pep
MAPGGSGERWSLAGATALVTGGSKGIGQAVVEELARLGARVHTCARSAADLEECRRRWAEKGLRVTVSVCDVAVRADRERLVLDTVSAAFDGKLDILVNNAALLLLKPAAEWAAEDYARIMATNLESCLHISQLAHPLLLNASVAGGASIVNVSSIASVLGFPQEVMYSVTKGGLNQMTRSLAVEWACDRIRVNCVAPGVIMTDMGKELPAALVEQERSRIPLRRTGEPEEVASLVSFLCMPAASYVTGQVIFVDGGRTISGA

SEQ ID NO: 5668 - protein, 193 aa, Zea mays
  UNSURE (1)..(193): unsure at all Xaa locations
  Clone ID: PAT_MRT4577_47014C.1.pep
  unsure (1)..(193): unsure at all Xaa locations
MAPGGSGERWSLAGATALVTGGKLDILVNNAALLLLKPAAEWAAXDYARIMATNLESRLHISQLAHPLLLNASVAGGASIVNVSSIASVLGFPQEVMYSVTKGGLNQMTRSLAVEWACDRIRVNCVAPGVIMTDMGKELPAALVEQERSRIPLRRTGEPEEVASLVSFLCMPAASYVTGQVIFVDGGRTISGA

SEQ ID NO: 5669 - protein, 263 aa, Zea mays
  Clone ID: PAT_MRT4577_47015C.1.pep
MAPGGSGERWSLAGATALVTGGSKGIGQAVVEELARLGARVHTCARSAADLEECRRRWAEKGLRVTVSVCDVAVRADRERLVLDTVSGAFDGKLDILVNNAALLLLKPAAEWAAEDYARIMATNLESCLHISQLAHPLLLNASVAGGASIVNVSSIASVLGFPQEVMYSVTKGGLNQMTRSLAVEWACDRIRVNCVAPGVIMTDMGKELPAALVEQERSRIPLRRTGEPEEVASLVSFLCMPAASYVTGQVIFVDGGRTISGA

SEQ ID NO: 5670 - protein, 754 aa, Zea mays
  UNSURE (1)..(754): unsure at all Xaa locations
  Clone ID: PAT_MRT4577_47028C.1.pep
  unsure (1)..(754): unsure at all Xaa locations
MDSSGEELLKKIRELEVGQAQLKQEMSKLIPGAGERRRSQSVSPRRGVPVPPPPPAKAKAGAPGRRLSGGFEGGQRAWARGSASFPHSSPLQREGRATGAGDASTSARLPERQYSRVLQSMGQSVHILDLDGRIIYWNQSAENLFGYPASEALGQDALMLLVDSHDHNAVNNIFQRISMGESWTGKFPVKNKQGHRFSVVATNTPFYDEDGSLMGFICVSSDSRQLEQIFCKPPTSARSQSESSMTSXVMGVAATLVTESIXVNRSSFDSNLPLQSTLASKITNLATKVTNKVRSRVRTDENDDGGSGESHCLDRGAKEEPTSSGTSTPRGDAPHGPFATEENSPGKSTNPNSDESEGKVGLHKILGSKAEALLNKKGISWPWKGRENEGPDERNHVILPWLHGGQENGVNHQKVSDSSISPDAQGAEHNQPSKNEASGSWSSFNNNSTGSASSTGSTNSSALYKVDHEADCLDYEILWEDLVIGEQIGQGSCGTVYHALWYGSDVAVKVFSKQEYSEEVILTFRQEVSLMKKLRHPNILLFMGAVMSPQRLCIVSEFLPRGSLFRLLQRSATKLDVRRRVHMALDIVRGMNYLHHSSPPIIHRDLKSSNLLVDKNWIVKVADFGLSRLKXETFLTTQXGKGTPQWMAPEVLRNEPSDEKSDVYSYGVILWELVTQKIPWENLNSMQVIGAVGFMNQRLDIPSEVDPQWKSIILSCWESDPQQRPSFQELLERLRELQRHYAIQHRNTKNSIEE

SEQ ID NO: 5671 - protein, 70 aa, Zea mays
  Clone ID: PAT_MRT4577_4741C.1.pep
TKYLGEGIVYIPGRIYCSKSLQRTRTAYYLSVFFSPFAFANRRWLAQFSPPKKKRFSTNRQMISRTIEGT

SEQ ID NO: 5672 - protein, 110 aa, Zea mays
  UNSURE (1)..(110): unsure at all Xaa locations
  Clone ID: PAT_MRT4577_47512C.1.pep
  unsure (1)..(110): unsure at all Xaa locations
MAVKIFWFLMLLGLTASAVTATIIQQXSQAPIAIFFAPYLSPAXSXVCENPIVQPYRIQHAIVARMLPLSPLILQQAEALLQQLPLVHIVAQNINVEQLRQLVLGNLDDY

SEQ ID NO: 5673 - protein, 75 aa, Zea mays
  UNSURE (1)..(75): unsure at all Xaa locations
  Clone ID: PAT_MRT4577_47534C.1.pep
  unsure (1)..(75): unsure at all Xaa locations
RGGGXPCSPSPRASQGSSCCQSSPRAASGPSPWEEGTDDHNFRMHGPPPFTILLPLGVGRPGVCSQGRFRGLNHF

SEQ ID NO: 5674 - protein, 124 aa, Zea mays
  UNSURE (1)..(124): unsure at all Xaa locations
  Clone ID: PAT_MRT4577_47692C.1.pep
  unsure (1)..(124): unsure at all Xaa locations
MDYGQQEQRGHGATAHVXDQYGNSVGGVEHGSVGMRHGSGTTGGMGQLGEHGGSGMGGGQLQSAREEHKTGEMLHRSGSSSSSSSEDDVMGGRRKKGIKEKIKEKLSGGHKDDQHATATTGGAY

SEQ ID NO: 5675 - protein, 130 aa, Zea mays
  UNSURE (1)..(130): unsure at all Xaa locations
  Clone ID: PAT_MRT4577_47706C.1.pep
  unsure (1)..(130): unsure at all Xaa locations
ANLDADYQHQQCLPFTHLVAMNSACDLHQHQLPFTQVPAACPQQYLPFXRQPALNSPAYLQQQQLLPFSQLAGVSPATFLIXPQWMPFYQHGAPNAGTLLQVQQSLPFNQLALTNPAAFYRQPIIGGALF

SEQ ID NO: 5676 - protein, 226 aa, Zea mays
  UNSURE (1)..(226): unsure at all Xaa locations
  Clone ID: PAT_MRT4577_47708C.1.pep
  unsure (1)..(226): unsure at all Xaa locations
RVAAPRYSTLGSVEISCLLMLLDLSCSAATETILPHCSQXAPIASIVAPYLSPTGSNGCENPILLXYTIQQAIASGILPLSPLFLQQSSALLQQLPLVHLLAQNIRAQQLQQLVLANLAAYSQQQQILPFNQLAALNSATYLRQQQLPFSQLSAAYPQRFLAFNQLTALNSPAYVQQQQLLPFNQLAGVSHCTLFTQPQLMTLYXQNAAPNAGTLLQLQHMLTFNQ

SEQ ID NO: 5677 - protein, 163 aa, Zea mays
  UNSURE (1)..(163): unsure at all Xaa locations
  Clone ID: PAT_MRT4577_47712C.1.pep
  unsure (1)..(163): unsure at all Xaa locations
MAAKIFCFLMLLGLSASAATATIFPQCSQAPIASFLPPYLSPAVSSRGENPILQPYRIQQAIAAGILPLSPWFLQQPXALLQQVPLGHLLAQNIKAQHLQQPGLXNLASYSQQHEFLPFNQLAALNSTAYSAQQLPFQHLVAAYXPQQFFAFNQLGSFEPLLP

SEQ ID NO: 5678 - protein, 117 aa, Zea mays
  UNSURE (1)..(117): unsure at all Xaa locations
  Clone ID: PAT_MRT4577_47714C.1.pep
  unsure (1)..(117): unsure at all Xaa locations
MAAKIFCLLMLLGLSASAATATIFPKCSKAPIASLLPPYLSPAXSFVCENPGVQPYRIQQAIAGGILPLLPLVLQQSSALLQQLPLMHLLGHNIRVQQLQQLVLAXLAVYFQHQHFL

SEQ ID NO: 5679 - protein, 204 aa, Zea mays
  UNSURE (1)..(204): unsure at all Xaa locations
  Clone ID: PAT_MRT4577_47715C.1.pep
  unsure (1)..(204): unsure at all Xaa locations
MAAKIXCLLMLLGISASAATGXTLFPQCSQAPIGSLLPPYLIPAVSSVCENRGLQPYRIQQAMAGGILPLSPLLLQQSSALLQQXPLVHLLAQNXRAQQLQQLVLANLAAYSQQQQFLPFNQLAALNSAFYFEQQQLPFSQVPVAYPQEFLPFNQLAALNSSAYLQEQQLLPFSQLSXGAPATFLTQPQLLAXYQHACXNAGHP

SEQ ID NO: 5680 - protein, 166 aa, Zea mays
  UNSURE (1)..(166): unsure at all Xaa locations
  Clone ID: PAT_MRT4577_47716C.1.pep
  unsure (1)..(166): unsure at all Xaa locations
LSPAASLVCXENPILEPYRIQQAITGGILPXSPLILQQSXALLHQLPLVHSLAQNIMAQHLQQLELANLAAYSQQQQVLRFNQLAALNSAFYLQQQQLPFIQLPAAYPQQFLSLNQLAALYSAAYXQQQPLLPFTQLAGVSPLTLLIRAQVVPFYQNAAPNAGTLL

SEQ ID NO: 5681 - protein, 175 aa, Zea mays
  UNSURE (1)..(175): unsure at all Xaa locations
  Clone ID: PAT_MRT4577_47717C.1.pep
  unsure (1)..(175): unsure at all Xaa locations
VIAAGILPLSPLFLXQSSALLQQLPLVHLLVXSIRSQQLQQLVLAXLAAYYQQQQFLPFSLLAALNCASYLQQQQVPFSXLSAAYPQQFIPFNLLTALNYPAYLQQQHLLPFSQLAGVSLATFLTQXPQLLPFYQHAAPNAGTLLQVQQLLPFKQLALTNSTAFFQQPIIGGALF

SEQ ID NO: 5682 - protein, 90 aa, Zea mays
  UNSURE (1)..(90): unsure at all Xaa locations
  Clone ID: PAT_MRT4577_47838C.1.pep
  unsure (1)..(90): unsure at all Xaa locations
RRHAPDQLPAAPCRPPSSISSVCSDSPAPMAALSAAGAPPASAIXFEGYEKRLAIXTSFEAPVFADPHGTGPRALSRSQSDSVLDLVRRT

SEQ ID NO: 5683 - protein, 128 aa, Zea mays
  UNSURE (1)..(128): unsure at all Xaa locations
  Clone ID: PAT_MRT4577_47967C.1.pep
  unsure (1)..(128): unsure at all Xaa locations
MALSEEKTSSAREYKVXSLSADFGRLDIDVAEVEMPGLMECRAEFGPSKPFTGARISCSLHMTIQTDGLIDTLTALGADVRWXCFCKIFSTQDHAAXVISRESVAVLACKGETLHQYCACAPHHCLDW

SEQ ID NO: 5684 - protein, 104 aa, Zea mays
  Clone ID: PAT_MRT4577_47978C.1.pep
TDLTQMTFGSSRNNVEKFIPVYLAQGILHHDPLEFLDQREVGKLVNLAPERARKVRLNLKVGICEEHGEEPSFVAFFAKVGLDYVSCSPFRVPIVRLVAVQVLV

SEQ ID NO: 5685 - protein, 103 aa, Zea mays
  UNSURE (1)..(103): unsure at all Xaa locations
  Clone ID: PAT_MRT4577_4804C.1.pep
  unsure (1)..(103): unsure at all Xaa locations
QHLKHNSAPAVAAKISCLLMLLALSACAATATIFPQCSQAPIATLLTPHLSPTVTSRCXENPVVQPYRIQQAISRGMLPLXTLLLQQSSALYHRTFLSMHSLQ

SEQ ID NO: 5686 - protein, 115 aa, Zea mays
  UNSURE (1)..(115): unsure at all Xaa locations
  Clone ID: PAT_MRT4577_4816C.1.pep
  unsure (1)..(115): unsure at all Xaa locations
MAAKIGRLLMLLGLSASAATATILPQCSHATIASLLPPYLSPAEHSVCENPILQTYTIQQGITASILPLSPSILQPSXALLHQLPSAHLLAQNIMAQQLQQLELXANLAAYSQQQ

SEQ ID NO: 5687 - protein, 98 aa, Zea mays
  Clone ID: PAT_MRT4577_48206C.1.pep
MPRATSDAKLLIQSLGKAYAATPTNLKVAYMGLVGSFPFNSFLSGVLSCIGTAVLAVCLRIQVNKDNKEFKDLPPERAFADFVLCNLVLHLVIMNFLG

SEQ ID NO: 5688 - protein, 114 aa, Zea mays
  UNSURE (1)..(114): unsure at all Xaa locations
  Clone ID: PAT_MRT4577_48208C.1.pep
  unsure (1)..(114): unsure at all Xaa locations
MPRXTSDAKLLIQSLGKAYAATPTNLKIIDLYVGFAVATALIQVAYMGLVGSFPFNSFLSGVLSCIGTAVLAVCLRIQVNKDNKEFKDLPPERAFADFVLCNLVLHLVIMNFLG

SEQ ID NO: 5689 - protein, 135 aa, Zea mays
  Clone ID: PAT_MRT4577_48209C.1.pep
MTCSFLVISSPHVEKTRGDSKMPRATSDAKLLIQSLGKAYAATPTNLKIIDLYVGFAVATALIQVAYMGLVGSFPFNSFLSGVLSCIGTAVLAVCLRIQVNKDNKEFKDLPPERAFADFVLCNLVLHLVIMNFLG

SEQ ID NO: 5690 - protein, 224 aa, Zea mays
  Clone ID: PAT_MRT4577_48210C.1.pep
MIRRYRHNVSYALALSTVHSYSVCNSSQPPVTTQQSTCKSQLYLAVGNLIAWMLWHHSYHCNFCKPYVLQWLIGYINLLAVIFSKKSKNSLSSIMVLRLRTSYLCALVLSTEHYYLSCFCNISSNRPWMLVETKHLQRLTGMLFIVENKTLRGFCGCPCPSAAEAKQPLAAARPRRLLPRSSPATSTPPDERGFQDAEGHQRREAPDPVPRQGVRCHTNKSQDY

SEQ ID NO: 5691 - protein, 106 aa, Zea mays
  UNSURE (1)..(106): unsure at all Xaa locations
  Clone ID: PAT_MRT4577_48218C.1.pep
  unsure (1)..(106): unsure at all Xaa locations
QLAAAYPQLFLSFNQLAALNSAAYLQQQQLPPFSQLADVSPVAFLTQQHLLPLYLHADPNAITLLXLQQLLPFNLLALTDPTLFYHQLITGGTLFYIAHDAYTDFE

SEQ ID NO: 5692 - protein, 103 aa, Zea mays
  Clone ID: PAT_MRT4577_48232C.1.pep
CTLYAQFLHCLFQYTESINHRLGFSLHPYFIVGGSTHPPWSLISLIKALLAPFKAMAHLTTGFANHKGRSFRERLRRIRNGHDPSLLGHLTIQPIIANETPAI

SEQ ID NO: 5693 - protein, 230 aa, Zea mays
  UNSURE (1)..(230): unsure at all Xaa locations
  Clone ID: PAT_MRT4577_48321C.1.pep
  unsure (1)..(230): unsure at all Xaa locations
MTSMTMDLSSTAFAGDGEDVSYVSAFREARVTMRKTGEKVKPSAASGSPXWYGPDRVLYLGPLSVETXSYLTSEFPGDYGWDTVALSEDPETYXSMNRELDVXIHSRWAMLCALVCVFPELLARNGVXKFGEVEWYXKVASHIFIEGGLYYLGNPSLIHAQSILAIWACQVVLMCAVEGYRIAGGPLGEVVYPLYPGGSFYPLGLVDDPEAFTELKVKELKNVRLAMFSM

SEQ ID NO: 5694 - protein, 333 aa, Zea mays
  Clone ID: PAT_MRT4577_48555C.1.pep
MERERQAVARNRKVVLRGYIDRAPREEDMELVDGGAVELRVPEGGGGPAVLVKNLYLSCDPYMRGRMRDFRNSYIPPFKPGSPIEGFGVGRVVDSTHPGFSAGDVVSGMTGWEDYSLITKPEQLRKIQQSDIPLSYHLGLLGMPGFTAYVGFYEICSPKKGEFVFVSAASGAVGQIVGQLAKLHGCYVVGSAGTDQKVELLKEKFGFDAAFNYEEEPDLTAALKRHFPEGIDIYFENVGGPMLDAVLLNMRVHGRIAVCGMVSQHGVTAPAGIHNLFSLISKRIEMKGFIQSDYVKIVYVEDMSVGLESGPASFVGLFSGKNVGKQVVCVSRD

SEQ ID NO: 5695 - protein, 350 aa, Zea mays
  Clone ID: PAT_MRT4577_48559C.1.pep
MERERQAVARNRKVVLRGYIDRAPREEDMELVDGGAVELRVPEGGGGPAVLVKNLYLSCDPYMRGRMRDFRNSYIPPFKPGSPIEGFGVGRVVDSTHPGFSAGDVVSGMTGWEDYSLITNPEQLRKIQQSDIPLSYHLGLLGMPGFTAYVGFYEICSPKKGEFVFVSAASGAVGQIVGQLAKLHGCYVVGSAGTDQKVELLKEKFGFDAAFNYKEEPDLTAALKRHFPEGIDIYFENVGGPMLDAVLLNMRVHGRIAVCGMVSQHGVTAPAGIHNLFSLISKRIEMKGFIQSDYVHLFPQFVDDITRHYRDGKIVYVEDMSVGLESGPASFVGLFSGKNVGKQVVCVSRD

SEQ ID NO: 5696 - protein, 131 aa, Zea mays
  UNSURE (1)..(131): unsure at all Xaa locations
  Clone ID: PAT_MRT4577_48688C.1.pep
  unsure (1)..(131): unsure at all Xaa locations
RIQSSLCRLTWKCFSWQGGSSLPSFFMLSLAFVVMLCLDTQNFQILVLIANLLKDPXLALSSLSACMTMSGRMFMISNAFNAATSGRVSNELNPSNPRSAAFSVTVVTLLFLVLSVLVFPLILLCLNYIIY

SEQ ID NO: 5697 - protein, 104 aa, Zea mays
  UNSURE (1)..(104): unsure at all Xaa locations
  Clone ID: PAT_MRT4577_48719C.1.pep
  unsure (1)..(104): unsure at all Xaa locations
MESTFIMIKPDGVQRGLIGEIISRFEKKGFYLKALKLVNVERFFAEMHYFHLVFKPFFQGLXVDYIIFVPVVAMVXRSRAVIXTGRTIIAATNSLAFEPVTNPC

SEQ ID NO: 5698 - protein, 104 aa, Zea mays
  Clone ID: PAT_MRT4577_48854C.1.pep
MSGAGGMECSGSGGTVAPFVAKTFAMVDDPATDAVVRWGPPSNSFVVADPFAFSHALLPAHFKHANFSSFVRQLNTYGFRKVDPDRWEFAHASFLRGQTHLLPR

SEQ ID NO: 5699 - protein, 131 aa, Zea mays
  UNSURE (1)..(131): unsure at all Xaa locations
  Clone ID: PAT_MRT4577_49002C.1.pep
  unsure (1)..(131): unsure at all Xaa locations
QGSRSHHKQFLPWXQLAALNIASSVQQQQLPFSQLLAAGAQQFLPFNQVAALNYHAYCQQQQLVPISQLAGVSRGTFLIQPQLLPFCQHAAPSAGTLLQRQQWQPFNQRALTNPAAFYQQPIIGGASFRFK

SEQ ID NO: 5700 - protein, 115 aa, Zea mays
  UNSURE (1)..(115): unsure at all Xaa locations
  Clone ID: PAT_MRT4577_49004C.1.pep
  unsure (1)..(115): unsure at all Xaa locations
AADRQQFLPFNQLAAVNYHAYXQQQQLVPISQLAGVSRGTFLIQXQLWRFYQHAAPSAGTLSQGQQWQPFNQRALTNPAAFYQQPIIGGASVKISMRDSSIIKSFVVMWVRLPRN

SEQ ID NO: 5701 - protein, 613 aa, Zea mays
  Clone ID: PAT_MRT4577_49018C.1.pep
GKLVLCASWTLLHHLPSLELLLRCQTKNQTLWPNTVMAQACKKRRGVYISSESGDSDTDSDVEGSKHSQKSGVTSISTCEHQSSYNLKAASMKSSRMIRLCGNIVRKLIDHKCGWLFKEPVDPDLYGIPDYFDVIRSPMDLGTIKNKLTKKKYVSIEEFAADVRLTFSNAMKYNPPGNDVHIFAKELNEMFDSEWESVERKFRGRNLGQDQQTMKAIKVRAMMDSKSTVARGPVACSNPKTLVARGPVACSNSIAKKTLTDALSSKVKIKFSVRSSAHTSSKDILVQAAGSKEGSLNHSVPTGNKEASSNCTLPIAKEAKISRAREIERCSGSIGKQSWSCNDTSTSPLASSVQGEESYLHDEPLSPSRALRAAMLRSRFAGTIVKAQQKALLDHGKNIDPVKLQLEKERLEKRQQEEKARIEAQVKAAEAAAQQKFEEEMRMKRKQEREAARLALRMMKKTVDIDNSDFLKELENFSKTWQANPPGKLIVDFISGDLPPGLGSPLERLGLFMKEDFEDEVEQEMEDRVSPSMDVDIRKDFQEDLGHEMQDSASPVTVIGTKNDVQGVAGHEMEDSGSPATVIDTKKEETEHEMVDSVSPLMDVDTEEGEISC

SEQ ID NO: 5702 - protein, 137 aa, Zea mays
  UNSURE (1)..(137): unsure at all Xaa locations
  Clone ID: PAT_MRT4577_49027C.1.pep
  unsure (1)..(137): unsure at all Xaa locations
MADKIFCLLMLLGLSASAGTETIFPQCSQAPIADLLAPYLSPAECSVCENXILEPYRIQQAIGGGILPLXPVFLQQXSALLQKGPLEHXLGQNIRAQQLQQLELANLDGYSEEQQGVPFNQLGGWNCGCYLEQQQLP

SEQ ID NO: 5703 - protein, 70 aa, Zea mays
  UNSURE (1)..(70): unsure at all Xaa locations
  Clone ID: PAT_MRT4577_49100C.1.pep
  unsure (1)..(70): unsure at all Xaa locations
KKATNSLIPKLNRSPIKRARGLKFKHPQGRPNGRFSNSLEIKPLLRELRDDLIPHPNPQFRGFRLELXKR

SEQ ID NO: 5704 - protein, 400 aa, Zea mays
  Clone ID: PAT_MRT4577_49162C.1.pep
MTLCPCVLTHISLLVCTQELVLSGYHIQATLLVHLILCLTLIARQWLHPLFLSSNFEALQSLSDNTPETHTKAAWFTSSMDVSPLNTDNIAASDVNQIHSIRPAMTSDESATQNDWWADIMNDDWKDILDATATDSHSKAMIQISNSATSLPAVNQSASSHSREICPVASPPNSSNASVAKQRMRWTPELHECFVDAVNQLGGSEKATPKGVLKLMKVDGLTIYHVKSHLQKYRTARYKPDLSEGTSEKRTATEELVLDLKTSMDLTEALRLQMEVQKRLHEQLEIQRKLQLRIEEQGKYLQMMFEKQSQSSTEKVQDPSSRDTTAKPSSNQSQSTNKDSGATMDPNGTGDIARTAELGERSSELGVKQKLVEIEESGTEVATGDRSKISQEKRRKLQDS

SEQ ID NO: 5705 - protein, 112 aa, Zea mays
  UNSURE (1)..(112): unsure at all Xaa locations
  Clone ID: PAT_MRT4577_49219C.1.pep
  unsure (1)..(112): unsure at all Xaa locations
MAAKICCLXLMLLDLSARAATATIFPQCSQAPIACLFPPNLSPAEYLVCENPILQPYRIQQAIAAGILPLSPLFLQQSXGLLQQLPLLHLLAQNMTAQQLQQLVLANLAGYY

SEQ ID NO: 5706 - protein, 546 aa, Zea mays
  UNSURE (1)..(546): unsure at all Xaa locations
  Clone ID: PAT_MRT4577_49229C.1.pep
  unsure (1)..(546): unsure at all Xaa locations
MGLGAAMALALGDPPADYASIAAVGLFVALMCVCIVVGHLLEENRWMNESITALFIGLGTGAVILFASSGKHSRVLVFSEDLFFIYLLPPIIFNAGFQVKKKQFFRNFITITLFGAVGTLISFTVISLGALGLISRLNIGALELGDYLALGAIFSATDSVCTLQVLSQDETPFLYSLVFGEGVVNDATSVVLFNAIQNFDPGNISSAKLLNFIGSFLYLFGSSTILGVASGLLSAYTIKKLYFGRHSTDREVSIMMLMAYLSYMLAELLDLSGILTVFFCGIVMSHYTWHNVTESSRVTTKHAFATLSFISETFLFLYVGMDALDIEKWKIVGQTYSPVKSIALSSTILALVLVSRAAFVFPLSFVSNLTKKXPNGKISFRQQVIVWWAGLMRGAVSIALAYNKFTRSGHTQQPSNAIMITSTISVVLFSTIVFGLLTKPLIRLLIPSRHLSREPSALSEPSSPKSFFEQLAANSPGHPDLENGISLRRPASLRFLLVSPARSVHHYWRKFDDSFMRPVFGGRGFVPFVPGSPTESSLPLLPGNEN

SEQ ID NO: 5707 - protein, 127 aa, Zea mays
  Clone ID: PAT_MRT4577_49279C.1.pep
PDTQECSTTCSGAYFIFASVYAVLVQVTWHCVGIFLASSSTILYIMILMSRKCLSHMPQYLMLNKVFRHSWNNIHLRSCQILYWPIVFQDASLSSTVNVEYAHKAAIRKHALWSSIIVDLLMGFVLG

SEQ ID NO: 5708 - protein, 124 aa, Zea mays
  UNSURE (1)..(124): unsure at all Xaa locations
  Clone ID: PAT_MRT4577_49351C.1.pep
  unsure (1)..(124): unsure at all Xaa locations
WVGFSSPSGSVSDSRGSSGLGFLNERIEMPAXDVEYRCFIGGLAWATDDHYIHNAFSTYGEDLESKIILDRETHRSSGFGYVTFSTEEAMRNAIEGMNRKELDGRNITSNEAQSQCCRRSSGRG

SEQ ID NO: 5709 - protein, 207 aa, Zea mays
  Clone ID: PAT_MRT4577_49427C.1.pep
MGRGKIEIKRIENSTNRQVTFSKRRNGILKKAREISVLCDAEVGVVVFSSAGKLYDYCSPKTSCVPFPTPWLSKILEKYQTNSGKILWGEKHKSLSAEIDRIKKENDTMQIELRHLKGEDLNSLQPKDLIMIEEALDNGLTNLNEKLTKMMEDENKLLAFKLHQQDIALSGSMRELELGYHPDRDLAAQMPITFRVQPSHPNLQENN

SEQ ID NO: 5710 - protein, 209 aa, Zea mays
  Clone ID: PAT_MRT4577_49429C.1.pep
MGRGKIEIKRIENSTNRQVTFSKRRNGILKKAREISVLCDAEVGVVVFSSAGKLYDYCSPKTSLSKILEKYQTNSGKILWGEKHKSLSAEIDRIKKENDTMQIELRHLKGEDLNSLQPKDLIMIEEALDNGLTNLNEKLMEHWERRVTNTKMMEDENKLLAFKLHQQDIALSGSMRELELGYHPDRDLAAQMPITFRVQPSHPNLQENN

SEQ ID NO: 5711 - protein, 45 aa, Zea mays
  Clone ID: PAT_MRT4577_49460C.1.pep
YCVHPRLQQTHASTSMNCGSMDDVTPVRICSKLILRKKWSFLVLQ

SEQ ID NO: 5712 - protein, 223 aa, Zea mays
  Clone ID: PAT_MRT4577_49736C.1.pep
MATPAVKVYGWAISPFVSRALLALEEAGVDYELVPMSRQDGDHRRPEHLARNPFGKVPVLEDGDLTLFESRAIARHVLRKHKPELLGGGRLEQTAMVDVWLEVEAHQLSPPAIAIVVECVFAPFLGRERNQAVVDENVEKLKKVLEVYEARLATCTYLAGDFLSLADLSPFTIMHCLMATEYAALVHALPHVSAWWQGLAARPAANKVAQFMPVGAGAPKEQE

SEQ ID NO: 5713 - protein, 461 aa, Zea mays
  Clone ID: PAT_MRT4577_49800C.1.pep
MTSSIPKLLLLLFFLSHRSPIARAGDDGSYKVLSMGSPRTDSVCSQSKAVPSSSAGAATVPLHHRHGPCSPLPTKKMPTLEETLHRDQLRAAYIQRKFSGGGGAGGDVQRSDATVPTALGTSLNTLEYLITVGLGSPATSQTMLIDTGSDVSWVQCKPCSQCHSQADPLFDPSSSSTYSPFSCGSADCAQLGQEGNGCSSSSQCQYIVTYGDGSSTTGTYSSDTLALGSSAVRSFQFGCSNVESGFNDQTDGLMGLGGGAQSLVSQTAGTLGRAFSYCLPPTPSSSGFLTLGAAGGSGTSGFVKTPMLRSSQVPTFYGVRLQAIRVGGRQLSIPASVFSAGTVMDSGTVITRLPPTAYSALSSAFKAGMKQYPPAQPSGILDTCFDFSGQSSVSIPSVALVFSGGAVVSLDASGIILSNCLAFAGNSDDSSLGIIGNVQQRTFEVLYDVGRGVVGFRAGAC

SEQ ID NO: 5714 - protein, 606 aa, Zea mays
  Clone ID: PAT_MRT4577_4996C.1.pep
NDLSGGIPAQLARCANLTLLNLAYNRLAGEVPDVLGELRSLQELIVSGNGLGGEFPRSILRCRNLSKLDLSYNAFRGDLPENICNGSRLQFLVLDHNEFSGGIPAGIGGCTRLLELQLGSNNLSGEIPAEIGKVKSLQIALNLSSNHFTGPLPRELGRLDKLVVLDLSRNEISGQIPGDMRGMLSLIEVNLSNNRLAGAIPVFGPFQKSAASSFSGNAELCGDPLTVDCGSSIYGSSYGTETDHRGISYRVALAVVGSCVLIFSLVSLLVALFMWRERQEKEEEEAKKKAAEVAVAAAAPQVVASAVFVESLQQAIDFQSCVKATFKDENEVGDGTFSTTYRAVMPSGTVVSVKKLKSVDRAVVQQRTKVVRELERLAHIGHENLVRPIGYVLYDDVALLLHQHLANGTLLQLLHDNGERRKADWPRLLSIAVDVAQGLAFLHQVATVHLDVCSGNVFLDSRYNALLGEVEISRLLDPTKGTASISAVAGSFGYIPPEYAYTMRVTVPGNVYSFGVVLLEILTSKLPAVDEAFGEGVDLVKWVHAAPARGETPEQIMDPRLSAVSFAWRRQMLAVLRVAMLCTERAPAKRPRMKKVVEMLQEARDS

SEQ ID NO: 5715 - protein, 312 aa, Zea mays
  Clone ID: PAT_MRT4577_49992C.1.pep
MVSSDTIRTAIGVIGNGTALVLFLSPVPTFIRIWKKGSVEQYSPIPYVATLLNCMMWVLYGLPLVHPHSMLVITINGTGMLIQLTYVALFLVYSAGAARRKVSLLLAAEVAFVGAVAALVLALAHTHERRSMVVGILCVLFGTGMYAAPLSVMKMVIQTKSVEYMPLFLSLASLVNGICWTAYALIRFDLYITIPNGLGVLFALAQLVLYAIYYKSTQEIIEARKRKADQIAMTGVVVDGGKTNNQAGAGQYAQARSQRQINYVAAGFYVFCDSICTLAACPSRPMEKKGGRKNVCRYMCSRRITLAHSWWG

SEQ ID NO: 5716 - protein, 243 aa, Zea mays
  Clone ID: PAT_MRT4577_49995C.1.pep
PKDVLYNVRTYVRTCRPTFIRIWKKGSVEQYSPIPYVATLLNCMMWVLYGLPLVHPHSMLVITINGTGMLIQLTYVALFLVYSAGAARRKVSLLLAAEVAFVGAVAALVLALAHTHERRSMVVGILCVLFGTGMYAAPLSVMKMVIQTKSVEYMPLFLSLASLVNGICWTAYALIRFDLYITIPNGLGVLFALAQLVLYAIYYKNTQKIVEARKRKAGQVAMTEVVVDGSRASNNNNGGSGTY

SEQ ID NO: 5717 - protein, 252 aa, Zea mays
  Clone ID: PAT_MRT4577_49998C.1.pep
MISPDTIRTAIGVIGNGTALVLFLSPVPTFIRIWKKGSVEQYSPIPYVATLLNCMMWVLYGLPAVHPHSMLVITINGTGMAIQLTYVALFLLYSAGAARRKVVLLLAAEVGFVGAVAALVLSLAHTHERRSMVVGILCVLFGTGMYAAPLSVMKMVIQTKSVEYMPLFLSLASLVNGICWTAYALIRFDLYITIPNGLGVLFAVAQLVLYAIYYKSTQEIIEARKRKADQIAMTGVVVDGGKTNNQAGAGQY

SEQ ID NO: 5718 - protein, 287 aa, Zea mays
  Clone ID: PAT_MRT4577_50069C.1.pep
MVGLSEGEKHFIRGGIAQDLRTDGRRRLQFRSLSVQTGVIPQANGSARVRLGATEIIASVKAELGKPSILHPDKGKVAIFVDCSPTAEPLFEGRGSEELSAELSVSLQRCLLGGKSGAGAAIDLSSLIVVDGKVCWDLYIDGLVVSSDGNLLDALAVAIKVALSDTGIPKVNVSVSAASDEEPEVDVSDEEFLQFDTSGVPVIITLTKVGRHYIVDATSEEESQMSSAVSVSVNRHGQICGLTKRGGAGLDPSVIFDMISVAKHVSQQFISLLDSEIAAAEAEEEAQ

SEQ ID NO: 5719 - protein, 287 aa, Zea mays
  Clone ID: PAT_MRT4577_50070C.1.pep
MVGLSEGEKHFIRGGIAQDLRTDGRRRLQFRSLSVQTGVIPQANGSARVRLGATDIIASVKAELGKPSILHPDKGKVAIFVDCSPTAEPLFEGRGSEELSAELSVSLQRCLLGGKSGAGAAIDLSSLIVVDGKVCWDLYIDGLVVSSDGNLLDALAVAIKVALSDTGIPKVNVSVSAASDEEPEVDVSDEEFLQFDTSGVPVIITLTKVGRHYIVDATSEEESQMSSAVSVSVNRHGQICGLTKRGGAGLDPSVIFDMISVAKHVSQQFISLLDSEIAAAEAEEEAQ

SEQ ID NO: 5720 - protein, 121 aa, Zea mays
  Clone ID: PAT_MRT4577_50147C.1.pep
RSDVVQVDEVGYDNCDKANALSSYSKGHTYAFQLKDAKDYYFICSYGYCYNGMKLHVTAKSSSSSSSGSDSSSSSDDDTSSPSPPAKKSKAKTSAAPPPSLLAATPMAAAAAAALLLNRML

SEQ ID NO: 5721 - protein, 186 aa, Zea mays
  UNSURE (1)..(186): unsure at all Xaa locations
  Clone ID: PAT_MRT4577_50148C.1.pep
  unsure (1)..(186): unsure at all Xaa locations
NLDVDYTAWVKKHKPFYKGDWLIFEYQNGRSDVVQVDEVGYDNCDKANALSSYSKGHTYAFQLKDAKDYYFICSYGYCYNGMKLHVTAKSXPHPPPPPRRRRPDLTPPPPLTTTLPPPRRPPRSPRPRPAPRRHRHSSLPRPWLPPPPPLCSSTGCSDLIWSALLCVCSHVAPDLAWALMSYTTLH

SEQ ID NO: 5722 - protein, 258 aa, Zea mays
  Clone ID: PAT_MRT4577_50149C.1.pep
LVVTCLHCCPSVRPHSPDPGHHHQYPTPITSSDLFLQVQAPASCKLIRLCRSARGRGQRNGGDVAAGAGPPAGRLGGGVGSCRRRLVAANYTVGDEKGWNPDVDYTAWVKKHKPFYKGDWLIFEYQNGRSDVVQVDEVGYDNCDKANALSSYSKGHTYAFQLKDAKDYYFICSYDNCYNGMKLHVTAKSSSSSSSSSPSGSDSSSSSSDNDDDDSSSPSPPAKKSKAKTSAAPPPSVLAATPMATAAAAAALLLNRML

SEQ ID NO: 5723 - protein, 105 aa, Zea mays
  UNSURE (1)..(105): unsure at all Xaa locations
  Clone ID: PAT_MRT4577_50413C.1.pep
  unsure (1)..(105): unsure at all Xaa locations
MAVKIFRLRMLLGLSASAATATIFPHCSQAPIAYFHSPNLSPAWSLVCENPLLQPYMIQQAISAGILPXDPRFXQQSSCLLQQLHLAHLLAQNIMSQQLQQLELA

SEQ ID NO: 5724 - protein, 104 aa, Zea mays
  Clone ID: PAT_MRT4577_5049C.1.pep
MSGRGKSGGKGLGKGGAKRHRKILRDNIQGITKPAIRRLARRGGVKRISGLIYEETRGVLKIFLENVIRDSVTYTEHAKRKTVTSLDVVYALKRQGRTLYGFGA

SEQ ID NO: 5725 - protein, 206 aa, Zea mays
  Clone ID: PAT_MRT4577_50571C.1.pep
MAAAAVALSNGSGGDSKAEFAEIYSRLKEEMLEDPAFEFTDESLQWIDRMLDYNVLGGKCNRGLSVIDSYKTLKGVDVLRKEETFLACTLGWCIEWLQAYFLVLDDIMDNSQTRRGQPCWFRVPQVGLIAVNDGIILRNHISRILQRHFRGKPYYVDLIDLFNEVEFKTASGQLLDLITTHEGEKDLTKYNLNVHRRIVQYKTAYY

SEQ ID NO: 5726 - protein, 163 aa, Zea mays
  Clone ID: PAT_MRT4577_50591C.1.pep
MARVYVGNLDSRVTSGELEDEFRVFGVLRSVWIARKPPGFAFIDFDDRRDAEDAIRDLDGKNGWRVELSRSTSGRGGRDRHGGSESKCYECGETGHFARECRLRIGSGGLGSGRRRSRSRSRSRSPRYRRSPSYNRRSYSPRYRSPRRRTPSPARGRSYSRSP

SEQ ID NO: 5727 - protein, 163 aa, Zea mays
  Clone ID: PAT_MRT4577_50592C.1.pep
MARVYVGNLDARVTSGELEDEFRVFGVLRSVWVARKPPGFAFIDFDDRRDAEDAIRDLDGKNGWKVELSRSTNGRGSRDRHGGSESKCYECGETGHFARECRLRIGSGGLGSGRRRSRSRSRSRSPRYRRSPSYNRRSYSPRYRSPRRRTPSPARGRSYSRSP

SEQ ID NO: 5728 - protein, 141 aa, Zea mays
  Clone ID: PAT_MRT4577_50627C.1.pep
MSDSEEHHFESKADAGASKTYPQQAGTVRKNGFIVIKNRPCKVVEVSTSKTGKHGHAKCHFVAIDIFNGKKLEDIVPSSHNCDVSLLTSDGNTKDDLRLPTDETLVAQIKEGFESGKDLVVTVQSAMGEEQICALKDVGPK

SEQ ID NO: 5729 - protein, 160 aa, Zea mays
  Clone ID: PAT_MRT4577_50630C.1.pep
MSDSEEHHFESKGDDGASKTYPKEAATVRKNGFIVIKNRPCKVVEVSTSKTGKHGHAKCHCAAIDIFNGEKLEDIAPSSHFCDIPHVNRTEYQLIDISEDGFVSLLTSDGNAKDDLRLPTDETLVVQIRQGFESAKDLVVTVQSAMGEEQICALKDVAPK

SEQ ID NO: 5730 - protein, 161 aa, Zea mays
  UNSURE (1)..(161): unsure at all Xaa locations
  Clone ID: PAT_MRT4577_50631C.1.pep
  unsure (1)..(161): unsure at all Xaa locations
MTDGEEHHLXTNADAXGTSNTYHKKGATARRNGSIVMKNRTCKGAEASTXKTGKHGHAKCHFVVIDIFNGKKLEDIVPSSHNCDIPHVNRTEYQLIDILEDGFVSLLTSDGNTKDDLRLPTDETLAAQIKEGHESGKDLVATVQSAMEEEQICALKDVAPK

SEQ ID NO: 5731 - protein, 618 aa, Zea mays
  UNSURE (1)..(618): unsure at all Xaa locations
  Clone ID: PAT_MRT4577_50635C.1.pep
  unsure (1)..(618): unsure at all Xaa locations
EQINVTYKIMRRIEAEEWSLDASEIVIASTRQEIEEQWNLYDGFEVMLARKLRALVKRGANCYGRYMPRMVIIPPGVEFGQLIHDFDMYGDEDNQSPASEPSIWFEIMRFFTNPRKPMILAIARPYSEKNIATLVKAFGECHPLRELANLTLIMGNREAISKMNKISAAVLTSVLTLIDEYDLYGQVAYPKLHKHSEVPDIYRLAARTKGAFVNVAYFEQFGVTLIEAAMHGLPVIATKNGAPVEIYQVLENGLLVDPHDQHAIADALYKMLSEKQFWSRCRENGLKNIHQFSWPEHCKNYLSRISSLGPRHPAFACKEDHKVPVKCRKHISIIAVDSVNKEDLIQIIRNSVEATRTGTMSGSTGFVLSTSLTIAELQSVIVRTGMLPTDFDAFICNSGSDIYYPLQSSDVPSNSRVTFALDHNYRSHIEYRWGGEGLRKYLVKWASSVVERRGRTXEKQVIFEDSEHSSTYCLAFKVINPSHLPPLKELQKLMRIQSLRCHALYNHGATRLSVIPIHASRSQALRYLSICWGIELPDAVVIVGETGDSDYEELFGGLHKTVILKGGFNTPANRIHTVRRYPLQDVVALDSSNIIAIEGFSTGDIRSAMQQQLGIPTR

SEQ ID NO: 5732 - protein, 186 aa, Zea mays
  UNSURE (1)..(186): unsure at all Xaa locations
  Clone ID: PAT_MRT4577_50641C.1.pep
  unsure (1)..(186): unsure at all Xaa locations
SPSAPLSISLLLRLLLEPTKPGDRHVWTQEEHHFESKADAGASKTYPQQGGTGRKNGFIVIKNRPCKVVEVXSTSKTGKHGHDKCHFVAVDIFHGKWLEDIVPSSHDCDIPHVNRTEYQLIEISEDGFVSLLTSHGDTMDDLRLPTDETLVDQIEEGFESVKDLAVTVQSAMRQEHICALKDVVPK

SEQ ID NO: 5733 - protein, 198 aa, Zea mays
  Clone ID: PAT_MRT4577_50802C.1.pep
MSRHPEVKWAQRIDKVYITVQLPDAKDAKVNLDPDGVFTFSGSAGTNLYELKLDLNDKVNVEASKISVGVRSIFCIVEKAEAKWWKKLVRDDQRAPHFVKVDWDKWVDEDDDGADINMDGMDFSNFGGMGGMGGMGDMAGMGGLGGMGGMGGMGGMGMDDFEDESDEEEVSKPQAADNAVEAEETESAEAKTEAAQSS

SEQ ID NO: 5734 - protein, 163 aa, Zea mays
  Clone ID: PAT_MRT4577_50804C.1.pep
MSRHPEVKWAQRIDKVYITVQLPDAKDAKVNLEPDGVFTFSGSVGTNLYELKLDLNDKVNVEASKISVGVRSIFCIVEKAEAKWWKKLVRDDQRAPHFVKVDWDKWVDEDDDGADVNLDGMDFSNFGGMGGMGGMGGMGDMAGVGGLGGMGGMGGMGGMGMDD

SEQ ID NO: 5735 - protein, 196 aa, Zea mays
  UNSURE (1)..(196): unsure at all Xaa locations
  Clone ID: PAT_MRT4577_50808C.1.pep
  unsure (1)..(196): unsure at all Xaa locations
MSRHPEVKWAQRIDKVYITVQLPDAKDAKVNLDPDGVFTFSGSAGTNLYELKLDLNDKVNVEASKISVGXRSIFCIVEKAEAKWWKKLVRDDQRAPHFVKVDWDKWVDEDDDGADINMDGMDFSNFGGMGGMGDMGGLGGMGGMGGLGGMGGMGMDDFEDESDDEEEVSKPQAADKAVEAEETESAETKTEAAQSS

SEQ ID NO: 5736 - protein, 192 aa, Zea mays
  Clone ID: PAT_MRT4577_50812C.1.pep
MSRHPEVKWAQRIDKVYITVQLPDAKDAKVNLEPDGVFTFSGSAGTNLYELKLDLNDKVNVEASKISVGVRSIFCIVEKAEAKWWKKLVRDDQRAPHFVKVDWDKWVDEDDDGADVNLDGMDFSNFGGMGGMGGMGDMAGLGGLGGMGGMGMDDFEDDSDEEEVSKPQAAGHAAEAEKTESAEAKTESAQSS

SEQ ID NO: 5737 - protein, 211 aa, Zea mays
  Clone ID: PAT_MRT4577_50814C.1.pep
MSGIVFCSRHPEVKWAQRIDKVYITVQLPDAKDAKVNLDPDGVFTFSGSAGTNLYELKLDLNDKVNVEASKISVGVRSIFCIVEKAEAKWWKKLVRDDQRAPHFVKVDWDKWVDEDDDGADINMDGMDFSNFGGMGGMGGMGGMGDMAGMGGLGGMGGMGGLGGMGGMGMDDFEDESDDEEEVSKPQAADKAVEAEETESAETKIEAAQSS

SEQ ID NO: 5738 - protein, 131 aa, Zea mays
  Clone ID: PAT_MRT4577_50828C.1.pep
MSEEKHHHFFNHHKKDEEQPAGEYGYSETEVVTATGEGEYERYKKEEKEHKHKQHLGEAGAIAAGAFALYEKHEAKKDPEHAHRHKITEEVAAAAAVGAGGYVFHEHHEKKKDHKDAEEASGEKKHHHLFG

SEQ ID NO: 5739 - protein, 186 aa, Zea mays
  UNSURE (1)..(186): unsure at all Xaa locations
  Clone ID: PAT_MRT4577_50839C.1.pep
  unsure (1)..(186): unsure at all Xaa locations
CTNNGGQQLCLLMLLGAFARGATATILPQCWXAAIDSLLPPYLSPAVSSVYEDPIVQPYWMQQGVTAGILPLSPLFLQQSSALLQQVPSVHLLAQNIMGPQLQQLVLANHVAYCQQQEVLACYQLPALNSASYLQQQQLPFCQVPAAYPQQFLACTQLATXNTPADLQQQQLLPFMHLVGVSTATF

SEQ ID NO: 5740 - protein, 128 aa, Zea mays
  Clone ID: PAT_MRT4577_50881C.1.pep
APQARRVQIPQSSCSTPLSSSNSAAMYGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 5741 - protein, 136 aa, Zea mays
  Clone ID: PAT_MRT4577_50884C.1.pep
HWVPRGRPGQSTAAGSISQSSCSTPLSSSNSAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 5742 - protein, 128 aa, Zea mays
  Clone ID: PAT_MRT4577_50885C.1.pep
TRVIAASSIPQSSCSTPLSSSNSAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 5743 - protein, 131 aa, Zea mays
  Clone ID: PAT_MRT4577_50886C.1.pep
RPGPEASRRVQIPQSSCSTPLSSSNSAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 5744 - protein, 204 aa, Zea mays
  Clone ID: PAT_MRT4577_50888C.1.pep
MRFTPPLRASLRIAGLVMPWMLSRSTLRWRFAPPLPRPLPPLPRPDIVAAGALSFTLSSPRRKWGIFLTSSRSRAAARDLELVQISQSSCSTPLSSSNSAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 5745 - protein, 145 aa, Zea mays
  Clone ID: PAT_MRT4577_50890C.1.pep
VSSLIRHPRLYTLCFRLVCCARRVQIPQSSCSTPLSSSNSAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 5746 - protein, 107 aa, Zea mays
  Clone ID: PAT_MRT4577_51028C.1.pep
VRIPVDHAPHWHLKGPLVPTMQPKYLPLMLLAFLKGCYGTIFPKCSRLYSFPLPRTFTSGAWDGKPQFSTLRIHRQSQLASYLITLVPPPIIALLHQLPWCHYWHKT

SEQ ID NO: 5747 - protein, 105 aa, Zea mays
  Clone ID: PAT_MRT4577_51197C.1.pep
LKKKGGAFFYRMGSQIFLHTDMLIVDDPADHLQLHTYLFRLIQHVATSEETYLQTTNLHNNNPALLLHRITNRQPRNCDNFTYTTQNHSDTTSPDYSLSTPDFSS

SEQ ID NO: 5748 - protein, 83 aa, Zea mays
  UNSURE (1)..(83): unsure at all Xaa locations
  Clone ID: PAT_MRT4577_51313C.1.pep
  unsure (1)..(83): unsure at all Xaa locations
NRIEMAASDVEYRCFVCGLTWATDDHSLHNSFSTYCEVLXSKIILYLETQKSRSFCFFTFFTDDAIHNAIXGINGNELYRRNI

SEQ ID NO: 5749 - protein, 103 aa, Zea mays; identical to SEQ ID NO: 3995
  Clone ID: PAT_MRT4577_51322C.1.pep

SEQ ID NO: 5750 - protein, 54 aa, Zea mays
  Clone ID: PAT_MRT4577_51573C.1.pep
TVGPARPSYPVRDRDVYPSPEGLFSFASCLLFPICVFDCKVALCQLLVLCSSSV

SEQ ID NO: 5751 - protein, 70 aa, Zea mays
  Clone ID: PAT_MRT4577_51599C.1.pep
STCEARTYHHIKNIRPTGREHREKLLSNRQFMCIVRYPPSCTAVYLASLFVFSPWPLTLKALLLALLFSL

SEQ ID NO: 5752 - protein, 475 aa, Zea mays
  Clone ID: PAT_MRT4577_51643C.1.pep
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILIAIGEAVAYVLSGMYGSVSQLGTGNAILIILQLFFAGIIVICLDELLQKGYGLGSGISLFIATNICENIIWKAFSPTTINSGRGAEFEGAVIALFHLLITRTDKVRALHEAFYRQNLPNVTNLLATVLVFLIVIYFQGFRVVLPVRSKNARGQQGSYPIKLFYTSNMPIILHSALITNLYFISQLLYRKYSGNFLVNLLGKWKESEYSGHSVPVGGLAYYVTAPSSLADVLANPVHALFYVVFMLSACALFSKTWIEVSGSSAKDVAKQLKEQQMVMPGHRESNLQRELNRYIPTAAAFGGVCIGALTVLADFMGAIGSGTGILLAVTIIYQYFETFEKERATELGFFGF

SEQ ID NO: 5753 - protein, 120 aa, Zea mays
  UNSURE (1)..(120): unsure at all Xaa locations
  Clone ID: PAT_MRT4577_51656C.1.pep
  unsure (1)..(120): unsure at all Xaa locations
MGDXEEHHFESXAHPRASKTYPQQAGTGRKNGFIXIKNRPRRXXXVSTSKTGXHGHAKCHFGAIDIFNGKKLEDIGPSAHNCDIPDVNRTEYQVXGISXDGFGSLLTSNGNTKEDLKLPT

SEQ ID NO: 5754 - protein, 94 aa, Zea mays
  Clone ID: PAT_MRT4577_51661C.1.pep
PKDIRFPAGNQVSLAARHLIYRLFPPDPPNRLGSYEGAMGIKPPPFFCGINWALVCAPPPPKLGAPPPDPLGAPLPPPAGDGAPPHMFCSSLGP

SEQ ID NO: 5755 - protein, 220 aa, Zea mays
  Clone ID: PAT_MRT4577_51897C.1.pep
MADEIDTRPASAGSRGRPAHATEDDDREEGEIAADAPSPALPAAHPLEHSWTFWFDNPHGKNKMAAWGSSIRPIHTLSTVEDFWGLYNNIHHPSKLIGGADFHCFKNKIEPKWEDPICANGGKWTISCGRGKSDTFWLHTLLAMIGEQFDYGDEICGAVVSVRGKQERIAIWTKNAANEAAQVSIGKQWKELLDYKDSIGFIVHDDAKKMDKGLKNRYTV

SEQ ID NO: 5756 - protein, 220 aa, Zea mays
  Clone ID: PAT_MRT4577_51899C.1.pep
MADEIDTRPAPAGSRGRPAHATEDDDREEGEIATDAPSPALPAAHPLEHSWTFWFDNPHGKNKMAAWGSSIRPIHTFSTVEDFWGLYNNIHHPSKLIGGADFHCFKNKIEPKWEDPICANGGKWTISCGRGKSDTLWLHTLLAMIGEQFDYGDEICGAVVSVRSKQERIAIWTKNAANEAAQISIGKQWKEFLDYKDSIGFIVHDDAKKMDKGLKNRYTV

SEQ ID NO: 5757 - protein, 218 aa, Zea mays
  Clone ID: PAT_MRT4577_51900C.1.pep
MAEETDTRPASAGSRGRPAPEDDDREEGEITDLACAPSPPATHPLEHSWTFWFDNPQSKSKQAAWGSSIRPIHTFSTVEEFWGLYNNINHPSKLIVGADFHCFKNKIEPKWEDPICANGGKWTISCGRGKSDTFWLHTLLAMIGEQFDYGDEICGAVVSVRGKQERIAIWTKNAANEAAQVSIGKQWKELLDYKDSIGFIVHDDAKKMDKGLKNRYTV

SEQ ID NO: 5758 - protein, 68 aa, Zea mays
  UNSURE (1)..(68): unsure at all Xaa locations
  Clone ID: PAT_MRT4577_51967C.1.pep
  unsure (1)..(68): unsure at all Xaa locations
GYLRFRGRAIAAADAEYRTFVGGLAWATNNXSLENAFAFYGEILYSKVITDRETGRFRGLCFVTFSSD

SEQ ID NO: 5759 - protein, 136 aa, Zea mays
  UNSURE (1)..(136): unsure at all Xaa locations
  Clone ID: PAT_MRT4577_52020C.1.pep
  unsure (1)..(136): unsure at all Xaa locations
MGGGSWQLHRIDNKINRQGMFSKRRNGLMKKDHDISVLCNAXVLLVVFSTKGNLNEYSSQSSMEGILERYQRFXSFEDMAVLNPRMENQKNWGDEYVRIKYKLDALHKSQRLLLXQQVSSLTIEELRQLSAQLDRS

SEQ ID NO: 5760 - protein, 133 aa, Zea mays
  UNSURE (1)..(133): unsure at all Xaa locations
  Clone ID: PAT_MRT4577_52027C.1.pep
  unsure (1)..(133): unsure at all Xaa locations
NPFLQPYRIQQXXAAGILPXSPLFLXXSSALLQQLPLGRVLXQNIRAQXLQXLVXANLAAYSQHQPFLPFXQXAALXSASYLXHXLPFSPLAAACXQRFLPSHXLAAFGSPAYLRAGRLLPFGRLAGVGPAAL

SEQ ID NO: 5761 - protein, 100 aa, Zea mays
  UNSURE (1)..(100): unsure at all Xaa locations
  Clone ID: PAT_MRT4577_52063C.1.pep
  unsure (1)..(100): unsure at all Xaa locations
MAAQISRVLMLLGISASAATATIFPQCSQAPIASLIPQYLLPAVSXICENPILQPYRIQQAIAAAILPLXPLLVQHSSDLLQHLPLVHLLSQYIRAQQLQ

SEQ ID NO: 5762 - protein, 84 aa, Zea mays
  UNSURE (1)..(84): unsure at all Xaa locations
  Clone ID: PAT_MRT4577_5207C.1.pep
  unsure (1)..(84): unsure at all Xaa locations
LDCRNITFNXAQSRGGRGSVCSGRCCGGRGCRGYSGGXRRDGGCGYSGGRGYCGCCGGYGGGGGGYVHGNRGGCYGNSDGNWMN

SEQ ID NO: 5763 - protein, 115 aa, Zea mays
  UNSURE (1)..(115): unsure at all Xaa locations
  Clone ID: PAT_MRT4577_52121C.1.pep
  unsure (1)..(115): unsure at all Xaa locations
MLDWGEHHFESNADAVAFKTYPQQAGTVRTNRFILIKNRPCKAEQVSTSQTGKHGHAXCHFVSIYIFNGKKLQDIVPSTQKCDIPDVNYTEYQLIDISQDGFVSLFTLDGNTKDD

SEQ ID NO: 5764 - protein, 110 aa, Zea mays
  Clone ID: PAT_MRT4577_5234C.1.pep
MAATKLQALWNHPAGPKTIHFWAPTFKWGISIANIADFAKPPEKISYPQQVAVACTGLIWSRYSLVITPRNWNLFSVNVAMAGTGLYQLSRKIRQDYLSDEKDAASQLEA

SEQ ID NO: 5765 - protein, 110 aa, Zea mays
  Clone ID: PAT_MRT4577_5235C.1.pep
MAATKLQAFWNHPAGPKTIHFWAPTFKWGISIANIADFAKPPEKISYPQQVAVACTGIIWSRYSLVITPKNWNLFSVNVAMAGTGLYQLSRKIRQDYLSGEKDAAPQLQE

SEQ ID NO: 5766 - protein, 296 aa, Zea mays
  Clone ID: PAT_MRT4577_52373C.1.pep
MFRRKHGSDVNSDDAEQREAKISELKAALGTLSARGEKYCSEACLRRYLEARNWNVAKSRKMLEESLKWRAAYKPEDIRWPDVSVEAETGKMYRASFRDREGRTVVVMKPTKQNTSSHEGQIRFLVYTLENAIFSLPEGQEKMVWLIDFTGWTVSHASPIKTCRETANILQNHFPERLAIGFLFNPPKVFEAFYKVIKIFLDPKSVEKVNFVYEKDEESMKVMYKYIDPEVLPVEFGGKSNVVYNHEEYSELMRQDDIKTASFWAVDAKTNHANPAINGTLVPEVAPQSSLAAKAS

SEQ ID NO: 5767 - protein, 110 aa, Zea mays
  Clone ID: PAT_MRT4577_5237C.1.pep
MAATKLQALWNHPAGPKTIHFWAPTFKWGISIANIADFAKPPEKISYPQQVAVTCTGLIWSRYSLVITPRNLNLLSVNVAMAGTGLYQLSRKIRQDYFSDEKDAAPQLEA

SEQ ID NO: 5768 - protein, 110 aa, Zea mays; identical to SEQ ID NO: 5764
  Clone ID: PAT_MRT4577_5238C.1.pep

SEQ ID NO: 5769 - protein, 112 aa, Zea mays
  Clone ID: PAT_MRT4577_52399C.1.pep
SSLSCCPRTGRPRTRKDPEAEVRHGHNYVPRDEQFSEVKQLTFGATTLRSGLHALLPAIRPMLIKRELRFPHFPAIDDLYSDGIPLPAQTGLGAIRSIVPRVVKLVEDTTEH

SEQ ID NO: 5770 - protein, 110 aa, Zea mays; identical to SEQ ID NO: 5765
  Clone ID: PAT_MRT4577_5241C.1.pep

SEQ ID NO: 5771 - protein, 55 aa, Zea mays
  Clone ID: PAT_MRT4577_52442C.1.pep
ACSCRSTIDVLARCVSCIGLAHNQVVDHACTSDLLGLVSLRSMSSSSSCTLRDML

SEQ ID NO: 5772 - protein, 63 aa, Zea mays
  Clone ID: PAT_MRT4577_5249C.1.pep
AIPRSCSGSIGLWGWGSRSVIYLALAGMAECLLPSTHLHGTRTGTRRLGYTDPGRVAGLAGAG

SEQ ID NO: 5773 - protein, 75 aa, Zea mays
  UNSURE (1)..(75): unsure at all Xaa locations
  Clone ID: PAT_MRT4577_5251C.1.pep
  unsure (1)..(75): unsure at all Xaa locations
GSLGFFGGARAAADVEYRCFLGGLAWATSNEWLKNAFAFYGESLHSKVMTDRDTTRSRXSCLGTLSYENYMLDAL

SEQ ID NO: 5774 - protein, 43 aa, Zea mays
  UNSURE (1)..(43): unsure at all Xaa locations
  Clone ID: PAT_MRT4577_52526C.1.pep
  unsure (1)..(43): unsure at all Xaa locations
MAAADVEYRCFVGGLAWATNNESMENALGYYGEILDXKVITDR

SEQ ID NO: 5775 - protein, 546 aa, Zea mays
  UNSURE (1)..(546): unsure at all Xaa locations
  Clone ID: PAT_MRT4577_52559C.1.pep
  unsure (1)..(546): unsure at all Xaa locations
MALGEGGDHGAALPLIADQAKHAAAGGIVRSGSMWTAAAHVITAVIGSGVLSLAWSIAQLGWVAGPAAMLVFAAVTALQSTLFADCYRSPDPEHGPHRNRTYAKAVDRNLGXTARGCACFCSTRPCSAMASPTPSRPPSAAGKKHTWACGSLQYVSLYGCGVAYXITTATSIXAAVGRAILKANCYHEHGHDAHCDYDGNYYMLIFGGVQLLLSFIPDFHDMAWLSVVAAAMSFSYAFIGLGLGLARTIANGTIKGSITGVRMRTPMQKVWRVSQAIGDIAFAYPYSLILLEIQXVTCSRTPFFQKTLLATKHPLAVSVXGLKHSNELYLFTLRQXDTLKSPPAENKTMKRASMISILVTTFFYLCCGCLGYAAFGSDAPGNLLTGFGLYGPYWLIDFANACIILHLLGGYQVYSQPIFQFAERLLAERFPDSGFVNGGSYTVRFACLRACRVNPLRVCLRTLYVASTTAVAVALPYFNEVLALLGALSFWPLAIYFPVEMYFIQRNVRRWSARWVVLQTFSVVCLLVSAFALVGSIEGLISKKLG

SEQ ID NO: 5776 - protein, 335 aa, Zea mays
  Clone ID: PAT_MRT4577_52690C.1.pep
MGECEDGKEYRCWEELLPDALGLIFRNLPLQEVLTVLPRVCKSWGRVVAGPYCWQEIDIEEWSQQQSKPEQIGRMVELLVGRSGGSCRRISVSGLPCDPLFSFIADNARALGTLEIPRSEISDSVVEAVAPRLSNVTFLDISSCTKIGARALEAFGRHCRSLVGLRRVMHPIDLADKVCQHDEAHAIARSMPRLRHLEMGYMLVATEAVLEILGQCRELKFLDLRGCWAVDDRFLRERHPGLRVLGPRVVDDCYENSYWEECSDYYSDEDEDYDDDVVSWGLFVDDDDDYYYAVGSDDDEAIWDDAQGLENLEVRFYGGGGFGESFAGFDWPPSP

SEQ ID NO: 5777 - protein, 99 aa, Zea mays
  Clone ID: PAT_MRT4577_52894C.1.pep
RTRGQLAAVYPQQFLPFNQRAGLNSAAYLQQQQLPPFIQLADVSPVALLTHQQLLSFYLHAAPNACTLLQLEQLLAFNPIGLTNPTTFYPQPIIGGALL

SEQ ID NO: 5778 - protein, 224 aa, Zea mays
  Clone ID: PAT_MRT4577_52917C.1.pep
MVRGKTELKRIENATSRQVTFSKRRNGLLKKAFELSVLCDAEVGLVVFSPRGKLYEFASAASLQKTIDRYRTYTRENVNNKTVQQDIQQVKADAVSLASRLEALEKTKRMFLGENLEECSIEELHNLEVKLAKSLHVIRGKKTQLLEQQISKLKEKERTLLQDNKELRDKQRNLQSPPEAPPDLNRCVPPWPRSLPAPSNDMDVETELYIGLPGRERSSNRDSD

SEQ ID NO: 5779 - protein, 256 aa, Zea mays
  Clone ID: PAT_MRT4577_52946C.1.pep
MFPPGLIHHRPDATAPGDGPPRSGPGGPSLVLTADPKPRLRWTADLHERFVDAVAQLGGPEKATPKTILRTMGVKGLTLFHLKSHLQKYRLGKQSGKEGSEQSKDASYLLDAQSGMSVSPRVAAQDMKESQEVKEALRAQMEVQRRLHEQVEQVQKRVQIRMEALEKYIDSILESACKMVTEQFASSGFSISNPDLPEISPGGVMCGSTDTLGSSVLNQLSVSSIDSHSPGGKPSPSGMEGPTLLQKSPELKRRSS

SEQ ID NO: 5780 - protein, 186 aa, Zea mays
  Clone ID: PAT_MRT4577_52981C.1.pep
MAPKRSSEERAAAEQEQPRLRGVRKRPWGRYAAEIRDPVRKARVWLGTFDTPEQAARAYDAAARRLRGPRATTNYPGDVVREAPCTAPALAASASGSTESSSSSSSRDDGHPPPPMPPAPSSLGLGLGLFPATVATQPCLFLDPAPVEREEGERERSCCSRSPPSVLAGLGFDFDLNLPPPAEMVM

SEQ ID NO: 5781 - protein, 356 aa, Zea mays
  UNSURE (1)..(356): unsure at all Xaa locations
  Clone ID: PAT_MRT4577_53153C.1.pep
  unsure (1)..(356): unsure at all Xaa locations
MATVEVVVANGLGGADTKTVFKETYSKLKEEMLDDPAFEFTDESLQWIDRMLDYNVLGGKCNRGLSVIDSYRILKGVDVLSKEETFLACTLGWCIEWLQAYFLVLDDIMDNSQTRRGQPCWFRVPQVGLIAVNDGIILRNHISRILQRHFKGKPYYVDVIDLFNEVEFKTASGQMLDLITTHEGEKDLTKYNLTVRRHIVQYKTAYYSFYLPVACAXLLLAGENLDNFGDVKNILVEMGTYFQVQDDYLDCFGDPEFIGKIGTDIEDYKCSWLVVQALEHADEKQKNILFESYGKSDPACVAKVKDLYKELKLEEVFQAYERESYNKLIADIEAQPSKAVQSVLKSFLHKIYKRDK

SEQ ID NO: 5782 - protein, 355 aa, Zea mays
  Clone ID: PAT_MRT4577_53154C.1.pep
MATAEVVVANGSGGADTKTAFKEIYSKLKQEMLEDPAFEFTDESLQWIDRMLDYNVLGGKCNRGLSVVDSYKILKGVDVLSKEETFLACTLGWCIEWLQAYFLVLDDIMDNSQTRRGQPCWFRVPQVGLIAVNDGIILRNHISRILQRHFKGKPYYVDIIDLFNEVEFKTASGQMLDLITTHEGEKDLTKYNLTVHRRIVQYKTAYYSFYLPVACALLLAGENLENFVDVKNILVEMGTYFQVQDDYLDCFGDPEFIGKIGTDIEDYKCSWLVVQALERAAENQKSILFENYGKSDPACVAKVKDLYKELKLEEVFHEYERESYNKLIADIEAQPSKAVQTVLKSFLHKIYKRDK

SEQ ID NO: 5783 - protein, 160 aa, Zea mays
  Clone ID: PAT_MRT4577_531C.1.pep
MDAGAKVVKKAAAGRRGGGGPKKKPVSRSVKAGLQFPVGRIGRYLKQGRYSQRVGTGAPVYLAAVLEYLAAELLELAGNAARDNKKNRIIPRHVLLAIRNDEELGKLLAGVTIAHGGVLPNINPVLLPKKTAVAAAKEGKEKKSPKKAAAAKSPKKVAAS

SEQ ID NO: 5784 - protein, 74 aa, Zea mays
  UNSURE (1)..(74): unsure at all Xaa locations
  Clone ID: PAT_MRT4577_53252C.1.pep
  unsure (1)..(74): unsure at all Xaa locations
MVLSHASSGRNDDAVASTFASRYVRKRLPRYRMPERFIPAQASQQIISXELMLDGYPCLNLTSFVTTWMETECD

SEQ ID NO: 5785 - protein, 243 aa, Zea mays
  Clone ID: PAT_MRT4577_53460C.1.pep
MASADLLRKEEEFYSSLFDSAKGDGVKSRSQVIERKIESLEDMATKVSNRRSRRWLNDRLLIELVPRLHVEEIKGLFAPPPWGEELPLSAFCRTSVSDWEAFRSIDMDAEARLMQHMKRSSEKQRTHVDEDELIALNAWRRIGRQTREAIKKKFLPDLLQIYEEQVRAFIEGTGDSDVLVLNVQDPFQRLLLHGVCEFYNVTSMTTSSVRDGKPWKSTTIKKRHVTGLPPRITLVSFLRMRKN

SEQ ID NO: 5786 - protein, 44 aa, Zea mays
  Clone ID: PAT_MRT4577_5370C.1.pep
DPVVLAATSVSLSRMCNYTEPGFVSSHKQCCKILYVLRASVAVL

SEQ ID NO: 5787 - protein, 249 aa, Zea mays
  Clone ID: PAT_MRT4577_53779C.1.pep
MDPSGGAFLPPLQQGSSSFPRSSSNASLARSGSGGGGVGAGRGTRGRKMMRRVCRGVITFIFAIAGLFLGAVTGGLIGLATESGLFRGTGIGAITGALVSIEVVDSSIRLWQARRSGIWSILYVLNVIYSLLTGRLVREKVDPAVQRVVRSQMNAVDSSPFRESPDLFEVEATNGMPRASIDKLPESWITEEYRRDAVGDLSGCSVCLQDFQVGEKVRSLPDCWHVFHVPCIDGWLIKHGSCPLCRRKL

SEQ ID NO: 5788 - protein, 77 aa, Zea mays
  UNSURE (1)..(77): unsure at all Xaa locations
  Clone ID: PAT_MRT4577_53816C.1.pep
  unsure (1)..(77): unsure at all Xaa locations
EGPGGGARGLRGFPLPRAPREEEGPQGARGGRRQKKPPLLRLIDPPVWWSXPCATRGCKSDIKPPPCCARVRMYALV

SEQ ID NO: 5789 - protein, 71 aa, Zea mays
  UNSURE (1)..(71): unsure at all Xaa locations
  Clone ID: PAT_MRT4577_53953C.1.pep
  unsure (1)..(71): unsure at all Xaa locations
SRWRASDVEYRCFVGCLNWTTDDHSLHNSFITYXGNLXSKIILYRVTQMSLIFCFVTLSTDDALRYAFYVM

SEQ ID NO: 5790 - protein, 92 aa, Zea mays
  UNSURE (1)..(92): unsure at all Xaa locations
  Clone ID: PAT_MRT4577_54029C.1.pep
  unsure (1)..(92): unsure at all Xaa locations
LVSLGXRDRTTGXXRKXGVAISASEGAIRTTAHASIAMPRSGGGGNGGGISSRSRVMTNLPDGIRFHPTDEDLMEHYLMRQAASMTRNAPII

SEQ ID NO: 5791 - protein, 80 aa, Zea mays
  Clone ID: PAT_MRT4577_54131C.1.pep
RVRGTILKAHHTALLYHGKNIDPVRSQQEKERLEKRQHEEKARIDAHVKAAESPAQQNVEEDMRMNRTHDKDARRLALRM

SEQ ID NO: 5792 - protein, 116 aa, Zea mays
  UNSURE (1)..(116): unsure at all Xaa locations
  Clone ID: PAT_MRT4577_54283C.1.pep
  unsure (1)..(116): unsure at all Xaa locations
PRVRTVGEYFYSETYVVTASSVFDYERYNMEDNEYKHKQHLSEAVAIRRGSFSLYQKHXAKKDPXHAHSHKITDDVAASAAVCACGYVFHEHHXMKNDHNDSDEASCENNHHHLFG

SEQ ID NO: 5793 - protein, 400 aa, Zea mays
  Clone ID: PAT_MRT4577_54302C.1.pep
MEAPRPNNGRKRKPTPPAGLGALHDDLLERVLARLPPATYFRLRAVCSRWRAAAASPTFLHACARVPSRDPWFLMLSDSDSGPRPPVAFDAAGRSWNRCHAAPGAAVPVAASAGLVLYRAPATGALTVANPLTGASRALPSPPQQAARQLQAIAMYGAGGPYRVALFAGDLPDDLSMAVYDSSSNSWEGPLPLARKPGDDSCPDAPAPDDTVYFLSKSGDVVATNMQRSASKQYSSSVVVRRDGDGDAAFAYFLSYSGTVVACDTARRTFAELPRILPVYFEYSIDVVACGAAAYAVVLSEYLGTASLRVWEFAGGAWRQVAAMPPAMSHGFHGTRPDINCVGHGDRLMVCVTSAEANACFMCDVASNQWEELPKYVNADGEASEFLAAFSFEPRVEVTV

SEQ ID NO: 5794 - protein, 150 aa, Zea mays
  UNSURE (1)..(150): unsure at all Xaa locations
  Clone ID: PAT_MRT4577_54510C.1.pep
  unsure (1)..(150): unsure at all Xaa locations
GGSGFSSPSGTDSGSRGDAGLVFERERIPTAASDVEYRCFVGRLAWAXGHHSVHXAFSTYREVLESKIMLDRXTQTSRSFGLGTLCTEEAMRNAIXEGMNGKELDGRHITVIEGQTAAXRGGGGGEYRGGRGGGAYCCCRRPDACSRYGG

SEQ ID NO: 5795 - protein, 147 aa, Zea mays
  UNSURE (1)..(147): unsure at all Xaa locations
  Clone ID: PAT_MRT4577_54533C.1.pep
  unsure (1)..(147): unsure at all Xaa locations
MSSETETFAFHAEINQLLSLIINSFYSNKEIFLRELISNSSDVLDEIRLVSLTXKSKLDAQSELIIHLVPDKATNTLSIIDSGVGVTKSDLVNNLGTIARSGTKEFMEALAAGADVSMIGQFGVGFYSAYLVAERVVVTTKHNDDEQ

SEQ ID NO: 5796 - protein, 130 aa, Zea mays
  UNSURE (1)..(130): unsure at all Xaa locations
  Clone ID: PAT_MRT4577_54762C.1.pep
  unsure (1)..(130): unsure at all Xaa locations
NAFSTYGEVLESKIILDRETHRSRGFGLPTFSTEEAMRNAIEGMNXKELDGRNITVNEAHPRRSRGGGGSRHSGGRGGGRYGGGRRRDGGRXYCGGSSYGGGRGYCGGGGGYRSGNRGCCYDNSCRNWQN

SEQ ID NO: 5797 - protein, 433 aa, Zea mays
  Clone ID: PAT_MRT4577_54782C.1.pep
MGVGAEPKDQAATAAGVPAEQDEAGGKEDKAAAVSCSICLDAVLAASGERSTARLHCGHEFHLDCIGSAFNAKGVMQCPNCRKIEKGNWLYANGSRSAHDVSMDEWAHDEDLYDVSYSDMPFRFHWCPFGRLTQLPSLFEEGESSPPVTFHDFMGQHVFTEQVAVSAAAGTTNPCPYVAYLHPLTPLTSLSSSHVPDRTTDRPAYHDHWNPMAGPSDVRSMQTMQPADFHHSHWAHVPHSYGQPNSNNEQPGIPFGARAVRVDGDSQRRASVVSPSYFSNGSGSRSRPPNVPPLMPQFMRAHGSISEQYQQNSSSSLFAGAHRSGGMRPAPTPLPENPTFTLFPPGSSGHSSMETDDAGGSRFYAWEGDRFAPYPLMPVDCETSWRTSQQQSHQSTSEPTSAPRRLFGQWLAVGRPSPSPEGSSYRQLHSPRM

SEQ ID NO: 5798 - protein, 82 aa, Zea mays
  Clone ID: PAT_MRT4577_55015C.1.pep
FNPFARCPFFSKKYPDLEETSTAVQATVVLGVAPEKKAAPEFFKAAADSCKAAHACGCGSGLKCDPCNCCYIDRRPWLWILS

SEQ ID NO: 5799 - protein, 154 aa, Zea mays
  UNSURE (1)..(154): unsure at all Xaa locations
  Clone ID: PAT_MRT4577_55137C.1.pep
  unsure (1)..(154): unsure at all Xaa locations
LPLVHLXAQNIRAQQLHHLVLATLVAYYQQQQFLPFTXYAALTSACYLQRHHLPFSQLPAAYPHQFLPFNQLAALSSHAYXQQQQLLPFSQLAGVSLATFLRQPQLLPLCQHCAPNDGSLLHLQQLLPFNQLTFSNPAAFYQQPIIGGAFFSFL

SEQ ID NO: 5800 - protein, 206 aa, Zea mays
  Clone ID: PAT_MRT4577_55297C.1.pep
MASHQDKASYQAGETKARTEEKTGQAVGATKDTAQHAKDRAADAAGKGQDAKEATKQKASDTGSYLGKKTDEAKHKAGETTEAAKHKAGETTEAAKQKAGETTEAAKQKAGETTEAAKQKAADAMEAAKQKAAEAGQYAKDTAVSGKDKSGGVIQQATEQVKSAAAGAKDAVMSTLGMGGDNKQGDANTNTNTNTNKDSSTITRDH

SEQ ID NO: 5801 - protein, 195 aa, Zea mays
  Clone ID: PAT_MRT4577_55302C.1.pep
MASHQDKASYQAGETKARTEEKTGQAVGATKDTAQHAKDRAADAAGHAAGKGQDAKEATKQKASDTGSYLGKKTDEAKHKAGETTEATKQKAGETTEATKQKAGETTEAARQKAADAMEAAKQKAAEAGQYAKDTAVSGKDKSGGVIQQATEQVKSAAAGAKDAVMSTLGMGGDDKQGDANTNTNKDSSTITRDH

SEQ ID NO: 5802 - protein, 182 aa, Zea mays
  Clone ID: PAT_MRT4577_55304C.1.pep
MASHQDKASYQAGETKARTEEKTGQAVGATKDTAQHAKDRAADAAGHAAGKGQDAKEATKQKASDTGSYLGKKTDEAKHKAGETTEATKQKAGETTEAAKQKAADAMEAAKQKAAEAGQYAKDTAVSGKDKSGGVIQQATEQVKSAAAGAKDAVMSTLGMGGDDKQGDANTNKDSSTITRDH

SEQ ID NO: 5803 - protein, 76 aa, Zea mays
  Clone ID: PAT_MRT4577_55326C.1.pep
MCCNCGSSCDCCSSCKCGKKYPNLEETSTAEQATAVLVLAREKKAEPEFVKAVAVSGKGPHACFCGSSCKCYPCNC

SEQ ID NO: 5804 - protein, 115 aa, Zea mays
  UNSURE (1)..(115): unsure at all Xaa locations
  Clone ID: PAT_MRT4577_55853C.1.pep
  unsure (1)..(115): unsure at all Xaa locations
MAEDDVEYRCXGGGLXWDTSSESLENASVYYGEILDSKVMTDRKTARSRGYXFGTFYYENSMLDXAIENMNGRELDGRNISRNQAQSRGGGSGGGGYGGGRGSGGYGGGRTXGGY

SEQ ID NO: 5805 - protein, 103 aa, Zea mays
  UNSURE (1)..(103): unsure at all Xaa locations
  Clone ID: PAT_MRT4577_55898C.1.pep
  unsure (1)..(103): unsure at all Xaa locations
PLECDMKGDKFKGAAKADAKLAAKSKRAEKPDKDTKGKAGMDPNKPKRAPSAFYRSMAELHKEHKDKNPKNKLXAAEEKAAGDRWKYLSESNNDRYVAKANKL

SEQ ID NO: 5806 - protein, 44 aa, Zea mays
  Clone ID: PAT_MRT4577_55906C.1.pep
LTLLPTVRHSTLLPCNQLAALSSECYVEQEQLPYIQLPACYRQD

SEQ ID NO: 5807 - protein, 294 aa, Zea mays
  Clone ID: PAT_MRT4577_55970C.1.pep
MGDVAKDLTAGTVGGAANLIVGHPFDTIKVKLQSQPTPAPGQLPKYAGAIDAVKQTVAAEGPRGLYKGMGAPLATVAAFNAVLFSVRGQMEAFLRSEPGVPLTVKQQVVAGAGAGIAVSFLACPTELIKCRLQAQSSLAEAATASGVALPKGPIDVAKHVVRDAGAKGLFKGLVPTMGREVPGNALMFGVYEATKQYLAGGPDTSGLGRGSQVLAGGLAGAAFWLSVYPTDVVKSVIQVDDYKKPKYSGSLDALRKIVAADGVKGLYKGFGPHPPAPGAVLCPRGRRASSAQPL

SEQ ID NO: 5808 - protein, 105 aa, Zea mays
  Clone ID: PAT_MRT4577_55983C.1.pep
VVVTTEKEVATVATDTATQTGNGGNERWGPHGQVILLATVLFTLVQSVYNSSSRVCCCPYVFLIEGRSVTEVSNVFIIGSSRPMHQQAWNADRWVMLPQSGFILS

SEQ ID NO: 5809 - protein, 382 aa, Zea mays
  UNSURE (1)..(382): unsure at all Xaa locations
  Clone ID: PAT_MRT4577_56004C.1.pep
  unsure (1)..(382): unsure at all Xaa locations
MASVTDETAKIEGLTSAAAFVEGGIQDACDDACSICLEAFCESDPSALTGCKHEFHLQCILEWCQRSSQCPMCWQPITMKDPTSQELLEAVERERNIRTNQTRNTTIFHHPALGDFELQHLPVGNDAELEERILQHLAAAAAMGRAHHLGRREGHRGRSGSHGRPHFLVFSTQPNSPSAGTISSSSAHMEGENDSNXLPHLELASHLHEXRIGEVGNQSPGMLTYDAEQDAVVSSGNSTPVSSPRFFNRRHSTGQSTPDRAGPSDIQSFSDSLKSRLNAVSMKYKESITKSTRGWKERLFSRNSSVADLGSEVRREVNAGIASVSRMMERLETRGNSRTSDSPAASTSEVPPATESSNERVTESNSAAAAVWWWYYHYGYQR

SEQ ID NO: 5810 - protein, 396 aa, Zea mays
  UNSURE (1)..(396): unsure at all Xaa locations
  Clone ID: PAT_MRT4577_56005C.1.pep
  unsure (1)..(396): unsure at all Xaa locations
MASVTDETAKIEGLTSAAAFVEGGIQDACDDACSICLEAFCESDPSALTGCKHEFHLQCILEWCQRSSQCPMCWQPITMKDPTSQELLEAVERERNIRTNQTRNTTIFHHPALGDFELQHLPVGNDAELEERILQHLAAAAAMGRAHHLGRREGHRGRSGSHGRPHFLVFSTQPNSPSAGTISSSSAHMEGENDSNXLPHLELASHLHEXRIGEVGNQSPGMLTYDAEQDAVVSSGNSTPVSSPRFFNRRHSTGQSTPDRAGPSDIQSFSDSLKSRLNAVSMKYKESITKSTRGWKERLFSRNSSVADLGSEVRREVNAGIASVSRMMERLETRGNSRTSDSPAASTSEVPPATESSNERVTESNSAAAAGGGGTTTTGTSASNASAPCVATSGSN

SEQ ID NO: 5811 - protein, 111 aa, Zea mays
  UNSURE (1)..(111): unsure at all Xaa locations
  Clone ID: PAT_MRT4577_56006C.1.pep
  unsure (1)..(111): unsure at all Xaa locations
NEGFSSPSGSGSVSTSPAFGLGCFQIQMAAPDVEYRCFFSSLTXATDDHSLHNAFSTYCEVLESKIILNRETHRSHNFRFITFYTDDAMRNAIEGMNGNELDGRIITVNEA

SEQ ID NO: 5812 - protein, 227 aa, Zea mays
  UNSURE (1)..(227): unsure at all Xaa locations
  Clone ID: PAT_MRT4577_56071C.1.pep
  unsure (1)..(227): unsure at all Xaa locations
VLDRDHLIRDGVQDDCQNDRKMNERLVGVSEDTTTGVKRLYXMHETGALLFSAINVNDTVTNEXFDYLYGCRHSLPDGLISVTDVMIAGKXIASSCGYVDVHKGSAAALKXGGARVIETXNPPIXALQALMDVLQVLPLWEVVSETDIFMTTTVYKDILMAEHMRNMSNHAIGCNSGHFDNEIDMLGLETXPARKRITIKPQTDRWMLPXTNTDIIVLDEGRLKNLG

SEQ ID NO: 5813 - protein, 178 aa, Zea mays
  UNSURE (1)..(178): unsure at all Xaa locations
  Clone ID: PAT_MRT4577_56090C.1.pep
  unsure (1)..(178): unsure at all Xaa locations
MPDSEEHRFKSKADAGATNTYPQQVGTARKNGFIVIKNRPCKDAEVSTSXTVNHDHAKXHFVTVHIFNAKKLEDIGPSSHNCDIPHANRTEYQLIDISEDGFAILLTSHGNSKEDLRLPTDETLVAQINEGIESCKDLDVTVQSATYEEQICTLKDVGAEQLPCLWTLYPTVSPLKSG

SEQ ID NO: 5814 - protein, 746 aa, Zea mays
  Clone ID: PAT_MRT4577_5615C.1.pep
MATGVAPAPLPHVRVHHGGVGFTRSVDFAKVLSAPGAGTMRASSSRGRALVAKSSSTGSETMELEPSSEGSPLLVPRQKYCESTHQTRRRKTRTVMVGNVPLGSDHPIRIQTMTTSDTKDVAKTVEEVMRIADKGADLVRITVQGRKEADACFEIKNTLVQKNYNIPLVADIHFAPTVALRVAECFDKIRVNPGNFADRRAQFEKLEYTDDDYQKELEHIEKVFSPLVEKCKQYGRAMRIGTNHGSLSDRIMSYYGDSPRGMVESALEFARICRKLDFHNFVFSMKASNPVIMVQAYRLLVAEMYNLGWDYPLHLGVTEAGEGEDGRMKSAIGIGTLLMDGLGDTIRVSLTEPPEEEIDPCQRLANLGTQAANLQIGVAPFEEKHRRYFDFQRRSGQLPLQKEGEEVDYRNVLHRDGSVLMSVSLDQLKAPDLLYRSLAAKLVVGMPFKDLATVDSILLRELPPVEDAEARLALKRLVDISMGVLAPLSEQLTKPLPHAIVLVNLDELSSGAHKLLPEGTRLAVTLRGDESYEQLDILKDVDDITMLLHNVPYGEEKTGRVHAARRLFEYLQANGLNFPVIHHINFPETIDRDGLVIGAGANVGALLVDGLGDGVFLEAADQEFEFLRDTSFNLLQGCRMRNTKTEYVSCPSCGRTLFDLQEISAEIREKTSHLPGVSIAIMGCIVNGPGEMADADFGYVGGAPGKIDLYVGKTVVQRAIAMEGATDALIQLIKDHGRWVDPPAEE

SEQ ID NO: 5815 - protein, 142 aa, Zea mays
  Clone ID: PAT_MRT4577_56175C.1.pep
MAMRSLCLPLLLFSVSISIPPAVSANEELASLLAFKVAAISGGYGDPLASWNESSAGGGGYCSWEGVRCWGKHRQVVKLSLPSRGLTGVLSPAIGNLSSLWTLNLSNNGFHNSIPASLGRLQRLHNLDLSHNAFSGKLPANL

SEQ ID NO: 5816 - protein, 147 aa, Zea mays
  UNSURE (1)..(147): unsure at all Xaa locations
  Clone ID: PAT_MRT4577_56505C.1.pep
  unsure (1)..(147): unsure at all Xaa locations
MSCSEEDDFQCEADAGAMNTYPEEDGTARNNGFLAIQNRPCKAVEGATSKTAKCGRATCRFADLDIFDGKKLEDIVPSSHNCDIPHVNRTEYQLIDIXEDGFVSLLTSHGNTKDDLRLPTDETLVCQIKEGIESGXYLAVTVHPAMA

SEQ ID NO: 5817 - protein, 257 aa, Zea mays
  Clone ID: PAT_MRT4577_5661C.1.pep
MASAAGGGAAGEGEWLKVSQLRPMVEAQDPNAKAVDNLTLRRFLRARDHDVDKASAMFLKFLKWRREAAPGGSVPEEQVRRELSQDKLCMGGVDRAGRPILVAFAARHFSAGRDMAEFKTALNCAGFVVYFFDKICARIPRGQEKFLCIVDLKGWGYSNCDVRAYIAAIEILQNYYPERLGKALMIHVPYIFMKAWKMIYPFIDTNTRDKFVFVEDKSLQETLRREIDEGQLPEFLGGKMDVIPLKDYGVQQQPQAV

SEQ ID NO: 5818 - protein, 136 aa, Zea mays
  UNSURE (1)..(136): unsure at all Xaa locations
  Clone ID: PAT_MRT4577_56632C.1.pep
  unsure (1)..(136): unsure at all Xaa locations
MADKLFCLLMLLGLSASAATGTIXPQCSQAPIACCFAPYLSPALSXVWDNPFIQPYRIHQAIPASILPLXPLLLQQRSALLQQLPLVDMLAQNMKAHQLQQLVLXNPACYSQXQQFLSFNQLGASNSAAYLQQQLP

SEQ ID NO: 5819 - protein, 180 aa, Zea mays
  Clone ID: PAT_MRT4577_56642C.1.pep
MRGAEEERSGAATDAGGEEEKRERSVGLMAGLMDKAKGFVVEKVTQIPKPEAALDHVSFRSISREGVELHSHVDISNPYSHRIPICEITYTFKSAGKVIASGTMPDPGWIAASGSTKLDLPVKVPYDFIVSLMKDLGGDWDIDYMMEVGLTVDLPAIGAFTIPLTTEGEIKLPTFRDLLF

SEQ ID NO: 5820 - protein, 81 aa, Zea mays
  UNSURE (1)..(81): unsure at all Xaa locations
  Clone ID: PAT_MRT4577_56806C.1.pep
  unsure (1)..(81): unsure at all Xaa locations
FLGPSGPDPIGQIFQGPGVXIKITSNPTTRAYLNEPDFMQMLREVQRNPYSISMYLSDPRMMQVSILMLNVKIHIPYAFLP

SEQ ID NO: 5821 - protein, 911 aa, Zea mays
  Clone ID: PAT_MRT4577_56807C.1.pep
MAFKGLPRDSRGSLEVFNPDAPVSDRATTSPFLLPPAVASHPSLLAAGDGGDADVGRATQRAAEWGLVLQTDEHTGRPQGVVARPSGSNRTSESGNSIDERAAAAGAGRALPRVSEELRAALSAFQQTFVVSDATRPDHPILYASAGFFNMTGYSSNEVVGRNCRFLQGSGTDPVEISKIRQALAAGSNYCGRILNYKKDGTPFWNLLTVAPIKDEDGRVLKFIGMQVEVSKYTEGNKDTALRPNGLPESLIKYDARQKDHARSSVSELLLALKDPRSLSESRNNTLKRKSQESAGSALVPGKRSSETGSRRNSHSGIRNSLQKISEVPEGGNKTRKSGLRSFMGLIGMGHGNVEKNILKPREDPLLDSDDERPDSFDDDFRKKEMRKGIDLATTLERIEKNFVITDPRLPDNPIIFASDSFLRLTEYCREEILGRNCRFLQGPETDRGTVKKIRDAIDNQTEVTVQLINYTKSGKKFWNLFHLQPMRDQKGDVQYFIGVQLDGTERVREAAAKDGAILVKKTADNIDEAAKELPDANLRPEDLWANHSKPVLPKPHMKDTASWRAIQKVLENGESIDLKHFRPVRPLGSGDTGSVHLVELLGTGEYFAMKAMDKSVMLNRNKVHRATAERQILDMLDHPFLPTLYASFQTKTHICLIVDYCAGGELFMLLDRQPMKVLKEDAVRFYAAEVVTALEYLHCQGIIYRDLKPENILLHRDGHISLTDFDLSCLTSCRPQVFLPHDIDKKKKRRKSRSNPIFFAEPMRASNSFVGTEEYIAPEIITGAGHTSAVDWWALGILLYEMLYGYTPFRGKTRQRTFANILHKDIRFPASIQVSLAARQLIYRLLHRDPANRLGSYEGAMEIKQHPFFRGINWALVRAATPPELEAPLQDTLEATLPPPAADAAHTDMF

SEQ ID NO: 5822 - protein, 233 aa, Zea mays
  UNSURE (1)..(233): unsure at all Xaa locations
  Clone ID: PAT_MRT4577_56816C.1.pep
  unsure (1)..(233): unsure at all Xaa locations
MAASNLEGVLLGMGNPLLDISAVVDEAFLAKYDVKPNNAILAEDKHLPMYDELSSKENVEYIAGGATQNSIRVAQWMLQTPGATSYMGCIGKDKYGEEMKSAAKAAGVTAHYYEDEAAPTGTCAVCVVGGERSLIANLSAANCYKSEHLKKPENWALVEKAKYIYIAGFFLTVSPESIQLVAEHAAANNKVFLMNLSAPFICEFFRDAQEKVLPYADYIFGNETXARIFSKSE

SEQ ID NO: 5823 - protein, 152 aa, Zea mays
  Clone ID: PAT_MRT4577_56889C.1.pep
MSDTAGKTITCKAAVAWEAGKDLVVEDIEVLPPRAHEVRIQVYYTGVCHTDAYMLSGKDPEGAFPVIAGHEGAGIVESVGEGVTNVKVGDTVVALYTPECKECKFCKSGKTNLCGKIRATQGKGVMPDGTSRFKCKGKDLLHFMGCSTFSQY

SEQ ID NO: 5824 - protein, 64 aa, Zea mays
  UNSURE (1)..(64): unsure at all Xaa locations
  Clone ID: PAT_MRT4577_56932C.1.pep
  unsure (1)..(64): unsure at all Xaa locations
MAGRXXKAIGAGAAKKAXSRSSKAGLQFXVGRIXRFLKADKYAXXVGAGXPXXXXAVXEXLTXE

SEQ ID NO: 5825 - protein, 510 aa, Zea mays
  Clone ID: PAT_MRT4577_5697C.1.pep
MPGGAFLLNGSGGGMADYGGGLTVPVVVTCLMAASGGLIFGYDIGISGGVSEMEDFLNKFFPGLLKRTARANKDVYCIYNNQALTAFTSSLYAFGMVGTLLASRVTRRLGRQAVMLIGGGLFLAGALVNAAAANIAMLIVGRMLLGLGLGFSGQATPVYLAEVSPPRWRGGFISAFPLFISVGYLVANLINYGTSRIPGWGWRLSLGLASVPAAVMVVGAAFIPDTPSSLVLRGKHDDARAALQRVRGKGVDIGPEFADILAAAENDRRNEEGAFRRILRREYRPYLVMAVAFPVFLNLTGVAVTAFFSPILFRTVGFESDAALMGAVILGLMNIGGILASGFAMDRYGRKLLFMIGGALMFTCQVAMASIIGSHLGNGSKMPKGYAVTVLVVALIFSASFSWSWGALYWTIPGEIYPVEVRSAGQGAAVALNLGLNFLQAQFFLAMLCCFKYGTFLFYASWLVVMTAFAVAFVPETKGVPLESMAHVFARHWYWGRFVKDHQKLGEEST

SEQ ID NO: 5826 - protein, 251 aa, Zea mays
  UNSURE (1)..(251): unsure at all Xaa locations
  Clone ID: PAT_MRT4577_570C.1.pep
  unsure (1)..(251): unsure at all Xaa locations
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGAKMAGAAGIIXGVDLNPAKYEQAKKFGCTDFVNPRDHQ

SEQ ID NO: 5827 - protein, 90 aa, Zea mays
  Clone ID: PAT_MRT4577_57211C.1.pep
PADRAYVHSYFTSWRRTFHLHVICSFVQGQLLFILEAKGHQKNDASYKAYVELWFKRTAAKNFVQATRYLSGQPVVLFLRGDHALNHTNG

SEQ ID NO: 5828 - protein, 251 aa, Zea mays
  UNSURE (1)..(251): unsure at all Xaa locations
  Clone ID: PAT_MRT4577_572C.1.pep
  unsure (1)..(251): unsure at all Xaa locations
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAWASRIIGVDLNPXKYEQAKXFGCTDFVNPKDTVA

SEQ ID NO: 5829 - protein, 69 aa, Zea mays
  Clone ID: PAT_MRT4577_57400C.1.pep
ASNSSGRHWGLGPFGGAPGEDGQGPRQASYRGGMRTDYQLGERVGMTRDETGELGPGWWLRHGSSLVPK

SEQ ID NO: 5830 - protein, 138 aa, Zea mays
  UNSURE (1)..(138): unsure at all Xaa locations
  Clone ID: PAT_MRT4577_57462C.1.pep
  unsure (1)..(138): unsure at all Xaa locations
EGVQQIIRTELMLDANPRLNLGSLVPRWMEPKCDKLIMDSTTKNXVDMAEYPVPPEPQNPWVNIKAPLFNAPIKEDETAIGVGTVGSSEAIMLAGLAFKRKWQNKRKEQGKPCPPPNMVPGANVQDPGPPNNGCKCWV

SEQ ID NO: 5831 - protein, 61 aa, Zea mays
  Clone ID: PAT_MRT4577_5758C.1.pep
GQLEKQQILFINKMGSQIFLHTYMLIGGDAADHLELHTYLFRLIQHVATSEVHMLTDDKFS

SEQ ID NO: 5832 - protein, 76 aa, Zea mays
  Clone ID: PAT_MRT4577_5760C.1.pep
NNMVEQELPGGGLLVYQSFCVAENAVVTSPKFVFPCFDGENVESAPPPMKKGYKLGNFFFWEEETDPMEEKAGVLY

SEQ ID NO: 5833 - protein, 77 aa, Zea mays
  Clone ID: PAT_MRT4577_5761C.1.pep
PPPGEQHSSAGGLLVSQSFCLPQHPVATSPKSVFPCFPRENVESAPPPMKKGYQLANFLCWEEETDAMEEKAGVLYE

SEQ ID NO: 5834 - protein, 73 aa, Zea mays
  Clone ID: PAT_MRT4577_5765C.1.pep
KRTPSGLIFFAGRRKRIPWRKRRECFMSKTGFWGRFAFELFILNRRNFVVVVWLFCEAAKPGYCYENLWSVSM

SEQ ID NO: 5835 - protein, 69 aa, Zea mays
  Clone ID: PAT_MRT4577_5767C.1.pep
FIFCGFFFLVFFEKKQILFINKRGSQIFFHTYMPIGGDPVDHLELLTYLFKLIQLVATSEVHMLTDDKF

SEQ ID NO: 5836 - protein, 59 aa, Zea mays
  Clone ID: PAT_MRT4577_5768C.1.pep
TRKKQILFINKMGSQIFLHTFMPIGGDPADHLKQHTYLGGLVQPGATSEGHMLTNHKFL

SEQ ID NO: 5837 - protein, 84 aa, Zea mays
  Clone ID: PAT_MRT4577_57694C.1.pep
MKVKILQWHAVASWTWDAQDETCGICRMAFDGCCPDCKFPGDDCPLIWGVCNHAYHLHCILKWVNSQTSTPLCPMCRREWQFKG

SEQ ID NO: 5838 - protein, 84 aa, Zea mays; identical to SEQ ID NO: 5837
  Clone ID: PAT_MRT4577_57695C.1.pep

SEQ ID NO: 5839 - protein, 71 aa, Zea mays
  Clone ID: PAT_MRT4577_5769C.1.pep
TTNWLIFYAGRRKRIPWRRRRECLMSKTGFWGRFAFELFILNRRNFVVVVWLFCEAAKPSYCYENLSSVSM

SEQ ID NO: 5840 - protein, 59 aa, Zea mays
  Clone ID: PAT_MRT4577_5772C.1.pep
TRKKQILFINKMGSQIFLHTFMPIGGDPADPLKLHTYLFKLIHLGATSEGHMLTDHKFS

SEQ ID NO: 5841 - protein, 68 aa, Zea mays
  Clone ID: PAT_MRT4577_5774C.1.pep
GGGLLVDQSFCGAKDAVATSPQSVFPCFAGENVESAPPPMKKGFKLGNFFCWEEEADPMEEKAGVLYE

SEQ ID NO: 5842 - protein, 142 aa, Zea mays
  UNSURE (1)..(142): unsure at all Xaa locations
  Clone ID: PAT_MRT4577_57862C.1.pep
  unsure (1)..(142): unsure at all Xaa locations
NTHNLTLKTGLHMLRGLSSNAATATILPQCSQAPITPLHPPYLSPTSHSLCQNPILQPYMIHQAITTHIXIPLSPLFLQQSSTLLHHXPLMHLLSQNINTQQLQQLDLTNLAAYSQHQQILTINQLSTINFDSNLQQQQLPS

SEQ ID NO: 5843 - protein, 221 aa, Zea mays
  UNSURE (1)..(221): unsure at all Xaa locations
  Clone ID: PAT_MRT4577_57865C.1.pep
  unsure (1)..(221): unsure at all Xaa locations
MADAVDARRVCGMPEKAQLHVAMLALQFGYAGFHVVSRLALNMGISKLVFPVYRNIIALFLLVPFAYFLEKKDRPRLTLSFAVQFFFLALCGITANQGFYLLGLDNTSPTFASAIQNSVPAITFGMAAALRIEKVRLDRRDGVAKVLGTLACVAGASVITLYQGPTIFAPADDKPSLQQEVPFLAAVAXEGKNWTLGCVYLIGHCLSWSGWLVLQAPVLKK

SEQ ID NO: 5844 - protein, 61 aa, Zea mays
  Clone ID: PAT_MRT4577_57880C.1.pep
AHQRTFACTGLICSKYNLVITPINLNLFNVNLAMAFTGLYHLSLKIMQHYLSHDKDAASQL

SEQ ID NO: 5845 - protein, 86 aa, Zea mays
  UNSURE (1)..(86): unsure at all Xaa locations
  Clone ID: PAT_MRT4577_57930C.1.pep
  unsure (1)..(86): unsure at all Xaa locations
FQPLEELLIHSFPLXSFXXXPGYXXLYRFIEKHGXEAVXYAEAXHDIGKKDAINNXLFVLGFNAXGGXSVFXPFLXAKVXGARRAR

SEQ ID NO: 5846 - protein, 106 aa, Zea mays
  UNSURE (1)..(106): unsure at all Xaa locations
  Clone ID: PAT_MRT4577_57991C.1.pep
  unsure (1)..(106): unsure at all Xaa locations
RNAIEGMNVKELGVRNITVKEVQSRAVSEDDAGVYGGGREDGGYVGAGLRDAGGEYDGAVAVYGGXGGYGGGGEGYGGVNRGVGYGNSDGNWRNLPVGTGRPSYPV

SEQ ID NO: 5847 - protein, 65 aa, Zea mays
  Clone ID: PAT_MRT4577_58107C.1.pep
GGGYGGCRCGGGYGGGRRDCGYGGCGCYGGRCEGGGGCYRGCGGYCGWCEGGGGGYRCGGRRWRD

SEQ ID NO: 5848 - protein, 94 aa, Zea mays
  Clone ID: PAT_MRT4577_58174C.1.pep
KKKPFFVFYGGSNKIHFRGKKSPAYLSFHPPRTRSQSKQPRNLLLHYTTPPLQYVGPTVYYGPQAVGGNSNHIWTLCLFYSHAGCKVTSHRGQS

SEQ ID NO: 5849 - protein, 119 aa, Zea mays
  UNSURE (1)..(119): unsure at all Xaa locations
  Clone ID: PAT_MRT4577_58203C.1.pep
  unsure (1)..(119): unsure at all Xaa locations
RRHRKHKPAPTLSAKRSGRLMLLGLSARAATGTILPQSSQAPIGSLVSPYLSPAVSXVXDNPTLEPYTIQQAMTAGMLPLSPXLLQQSSALLHELPLVHLLAQNIKAQQLQQLVLGNLA

SEQ ID NO: 5850 - protein, 86 aa, Zea mays
  Clone ID: PAT_MRT4577_58342C.1.pep
YIRFKSRQLCVNPLIPELARLIRNRSLEFLPFATTRRSRPRNEASKTDSLRRTRPHRRSRLLSGRRPTAAARGGNSLATRSVRLPA

SEQ ID NO: 5851 - protein, 64 aa, Zea mays
  UNSURE (1)..(64): unsure at all Xaa locations
  Clone ID: PAT_MRT4577_58516C.1.pep
  unsure (1)..(64): unsure at all Xaa locations
MAGRGNAIGAGXAAKKAISRSSKAGLQFPVGRIARFLKAGKYAERVGAGAPVYIVAVIEYLTAE

SEQ ID NO: 5852 - protein, 308 aa, Zea mays
  UNSURE (1)..(308): unsure at all Xaa locations
  Clone ID: PAT_MRT4577_58620C.1.pep
  unsure (1)..(308): unsure at all Xaa locations
PPQETEIVGFVKTHKSNAYFKRFQVKFKRRRAGKTDYRARIRLINQDXXKYNTPKYRFVVRFTNKDITAQIISASIAGDMVLASAYSHELPRYGLEVGLTNYAAAYCTGLLLARRVLKTRGLDKEYEGNVEATGEDFSVEPADERRPFRALLDVGLIRTTTGNRVFGALKGALDGGLDIPHSEKRFAGFKKDDKQLDADIHRKYIYGGHVADYMRNLAEEEPEKYQSHFSEYIKKGIEADDMEALYKKVHAAIRADPSIVKSTKQPPKEHKRYNPKKLTYEQRKASLIERLNQLNSSGGADDDDEDDE

SEQ ID NO: 5853 - protein, 155 aa, Zea mays
  UNSURE (1)..(155): unsure at all Xaa locations
  Clone ID: PAT_MRT4577_58622C.1.pep
  unsure (1)..(155): unsure at all Xaa locations
MGGMVKTHKSNAYFKRXQVKFKRRRAGKTDYRARIRLINQDRNKCNTPKYRFVERFTNKDITAQIISASIAGDMVLASAYSHEVPRYGLEVGLTNYAAAYCTGLLLARRELKIRGLDQEYEGHVEATGEDFCVEPTDERRAFRALXGMWLIRTTT

SEQ ID NO: 5854 - protein, 302 aa, Zea mays
  Clone ID: PAT_MRT4577_58623C.1.pep
MGGHERTHRSNAYFKRFQVKFKRRRAVRTHYRARIRLINQDRNKYNTPKYRFVVRSTNKDITAQIISASIAGDMVLASDYSHELPRYGLEVGLTNYAAAYCTGLLLARRVLKIRGLDQEYEGNVEATGEDFSVEPADERRPFRALLDVGLIRTTTGNRVFGALKGALDGGLDIPHSEKRFAGFKKDDKQLDADTHRRYIYGGHVADYMKNLAEEEPEKYQSHFSAYIKKGVEAEEIEALYKKVHAAIRADPSVVKSTKQPPKEHKRYNPKKLTYEQRKASLIERLNQLNSSGGADDDDEDDE

SEQ ID NO: 5855 - protein, 302 aa, Zea mays
  Clone ID: PAT_MRT4577_58624C.1.pep
MGGFVKTHKSNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDQEYEGNVEATGEDFSVEPADERRPFRALLDVGLIRTTTGNRVFGALKGALDGGLDIPHSEKRFAGFKKDDKQLDADTHRRYIYGGHVADYMKNLAEEEPEKYQSHFSEYIKKGVEAEEIEALYKKVHAAIRADPSVVKSTKQPPKEHKRYNPKKLTYEQRKASLIERLNQLNSSGGADDDDEDDE

SEQ ID NO: 5856 - protein, 362 aa, Zea mays
  UNSURE (1)..(362): unsure at all Xaa locations
  Clone ID: PAT_MRT4577_58626C.1.pep
  unsure (1)..(362): unsure at all Xaa locations
QNSCSTLPVRLTICVPFGYLPRGGFVKTHKTNAYFKRFQVKFKRRRAGKTDYRARIRLINQDKNKYNTPKYRFVVRFVSFDSFIICFLCSLIIWFLLITMVLELQWHNIVPLNXLXTNKDITAQIISASIAGDMVLASAYSHELPRYGLEVGLTNYAAAYCTGLLLARRVLKTRGLDKEYEGNVEATGEDFSVEPADERRPFRALLDVGLIRTTTGNRVFGALKGALDGGLDIPHSEKRFAGFKKDDKQLDADIHRKYIYGGHVADYMRNLAEEEPEKYQSHFSEYIKKGIEADDMEALYKKVHAAIRADPSVVKSTKQPPKEHKRYNPKKLTYEQRKASLIERLNQLNSSGGADDDDEDDE

SEQ ID NO: 5857 - protein, 246 aa, Zea mays
  Clone ID: PAT_MRT4577_58629C.1.pep
TNKDITAQIISASIAGDMVLASAYSHELPRYGLEVGLTNYAAAYRTGLLLARRVLKIRGLDQEYEGNVEATGEDFSVEPADERRPFRALLDVGLIRTTTGNRVFGALKGALDGGLDIPHSEKRFAGFKKDDKQLDADTHRRYIYGGHVADYMKNLAEEEPEKYQSHFSAYIKKGVEADEIEALYKKVHAAIRADPSIVKSTKQPPKEHKRYNPKKLTYEQRKASLIERLNQLNSSGGADDDDEDDE

SEQ ID NO: 5858 - protein, 302 aa, Zea mays
  Clone ID: PAT_MRT4577_58631C.1.pep
MGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDQEYEGNVEATGEDFSVEPADERRPFRALLDVGLIRTTTGNRVFGALKGALDGGLDIPHSEKRFAGFKKDDKQLDADTHRRYIYGGHVADYMKNLAEEEPEKYQSHFSAYIKKGVEADEIEALYKKVHAAIRADPSIVKSTKQPPKEHKRYNPKKLTYEQRKASLIERLNQLNSSGGADDDDEDDE

SEQ ID NO: 5859 - protein, 133 aa, Zea mays
  Clone ID: PAT_MRT4577_58700C.1.pep
ARRLFRQRFDFPIAGVLQAYVSPSVSSLCENPILQPYTIQQAISSVILPLSPLFLQQSSALLQQQPLVHLLSHNIIAHQLQHLELAYLYTYSQQHQFFTFNQLSAYNSCSYLQQLLLPFNQLPVAYTQQFFPL

SEQ ID NO: 5860 - protein, 112 aa, Zea mays
  UNSURE (1)..(112): unsure at all Xaa locations
  Clone ID: PAT_MRT4577_58744C.1.pep
  unsure (1)..(112): unsure at all Xaa locations
MDAGSMVVKKAAAALRGGGGPKKKPVSRSVKACLQFPVGRIGRYLKHGRYCQRVCTGSPVYLAAVLXYLAAELLELSGNAARDNMKNRIMPRHLLLSIRIDEDLWKLLSGLT

SEQ ID NO: 5861 - protein, 77 aa, Zea mays
  Clone ID: PAT_MRT4577_58840C.1.pep
YNFFFFFFFFLVFFKILSGKKKQILFINKMGSQIFFHTYMLIGVDAVDHLGLHTYLFRLIQLGATLEGYMLTDDKFL

SEQ ID NO: 5862 - protein, 203 aa, Zea mays
  UNSURE (1)..(203): unsure at all Xaa locations
  Clone ID: PAT_MRT4577_58945C.1.pep
  unsure (1)..(203): unsure at all Xaa locations
FGSVLSLLXIVTTCIAQIMTNTIQKKFKVSSTQLLYQSCPYQALTLFIVGPFLDGFLTNKNVFAFAYTPQVLFFIVLSCLISVSVNFSTFLVIGKTSPVTYQVLGHLKTCLVLAFGYVLLHDPFSWRNILGILIAEVEMGLYSYFCTREAPKPTEASPQVTQVKEGESDPLIADSLNAAENGAAATTDEPLKVPMWSSKYARA

SEQ ID NO: 5863 - protein, 79 aa, Zea mays
  UNSURE (1)..(79): unsure at all Xaa locations
  Clone ID: PAT_MRT4577_59057C.1.pep
  unsure (1)..(79): unsure at all Xaa locations
CMTSSIEPCACFFITMLIARSKMHHDTTLHXSCSFITSVNTLLRPECTKENTWVHWSTQTFACCSQNLDCDNNHHVGPI

SEQ ID NO: 5864 - protein, 222 aa, Zea mays
  UNSURE (1)..(222): unsure at all Xaa locations
  Clone ID: PAT_MRT4577_59249C.1.pep
  unsure (1)..(222): unsure at all Xaa locations
MDRAGVLAVVDSRTGKRYEVKVSEDGTVRATDFKKITAGKDDKGLKTYDPGYLNTAPVRSSICYIDGDEGILRYRGYPIEEVAESSSFVEVAYLLMYGNLPSQSQLAAWGFAISQHSAVPQGLLDIIQSMPHDAHPMGVLASAMSTLSVFHPDANPALRGQDLYNSKQVRDKQIVRVLGKAPAIAAAAYLRLAGRPAVLPSKNLSYSQNXLDMLDSLGDQKY

SEQ ID NO: 5865 - protein, 144 aa, Zea mays
  UNSURE (1)..(144): unsure at all Xaa locations
  Clone ID: PAT_MRT4577_59359C.1.pep
  unsure (1)..(144): unsure at all Xaa locations
RGWLLLLLRFGFFGRGAGFGFVGERVEMAASDVEYRCFVGGLAWAPDDRSLXHAFSTCGGVLVSKXILARETRRSRGFGFVPFSAGEAXRTAXEGXNGLELDGRXISVFVAHSRGGRGGGGGGGYGGGRGGGGFCGGGRRGGGG

SEQ ID NO: 5866 - protein, 302 aa, Zea mays
  Clone ID: PAT_MRT4577_59489C.1.pep
MGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKTRGLDKEYEGNVEATGEDFSVEPADERRPFRALLDVGLIRTTTGNRVFGALKGALDGGLDIPHSEKRFAGFKKDDKQLDADIHRKYIYGGHVADYMRNLAEEEPEKYQSHFSEYIKKGIEADDMEALYKKVHAAIRADPSVVKSTKQPPKEHKRYNPKKLTYEQRKASLIERLNQLNSSGGADDDDEDDE

SEQ ID NO: 5867 - protein, 302 aa, Zea mays
  UNSURE (1)..(302): unsure at all Xaa locations
  Clone ID: PAT_MRT4577_59492C.1.pep
  unsure (1)..(302): unsure at all Xaa locations
MGGFVKTHKSNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKTRGLDKEYEGNVEATGEDFSVEPADERRPFRALLDVGLIRTTTGXRVFGALKGALDGGLDIPHSEKRFAGFKKDDKQLDADIHRKYIYGGHVADYMRNLAEEEPEKYQSHFSEYIKKGIEADDMEALYKKVHAAIRADPSVVKSTKQPPKEHKRYNPKKLTYEQRKASLIERLNQLNSSGGADDDDEDDE

SEQ ID NO: 5868 - protein, 52 aa, Zea mays
  Clone ID: PAT_MRT4577_59534C.1.pep
PTRPGKTDSVASIFFAERRNKRIGGSFRRSRHVYYGTAAFYYLLLRVIRGLP

SEQ ID NO: 5869 - protein, 99 aa, Zea mays
  Clone ID: PAT_MRT4577_59635C.1.pep
MTGRGKGGKGLGKGGAKRHRKILRDNIQGITKPAIRRLARRGGVKRISAMIYEETRGVLKSFLEGVIRDAVTYTEHAKRKTVTSLDVVYALKRQGRTLY

SEQ ID NO: 5870 - protein, 177 aa, Zea mays
  UNSURE (1)..(177): unsure at all Xaa locations
  Clone ID: PAT_MRT4577_59654C.1.pep
  unsure (1)..(177): unsure at all Xaa locations
AGRGRNGSGLMACRGQFRPSKAFAGARISGSLHMTIQTAVXLIETLSAFCAEVRWCSCNIFSTQDHGGAAIARDSDDVLAWEGETLEEHWRRTERCLDWGEAGGPHLIDDDGVRATLLIHEGVKAEEDYEKYGKIPDPESTDNAEFKIVLTIIRDGLKADPQKYRKMKERLVGVSEE

SEQ ID NO: 5871 - protein, 202 aa, Zea mays
  Clone ID: PAT_MRT4577_59729C.1.pep
TTRVGTVGEVAKNEKESKEKGKGSFALAWTMDESSEERERGVTMTVAVAYLETKKFRVVLLDSPGHKDFVPNMISGATQADAAILVVDASTGSFEAGMDGEGGKSVGQTKEHAQLVRSFGVEQLVVAVNKMDAVDYAKERFDFIKLQLGSFLRSCNFKDSAINWIPPSAVENQNLIQAPSDARLNSWYQGFCLLDAIDFLQL

SEQ ID NO: 5872 - protein, 317 aa, Zea mays
  UNSURE (1)..(317): unsure at all Xaa locations
  Clone ID: PAT_MRT4577_59850C.1.pep
  unsure (1)..(317): unsure at all Xaa locations
MGAWVSVLLGMDGAAAAGPAAVGLGDLPELCAAQVLLRLDPPEICRLAQVNHAFRGAAGADFVWEAKLPENYNYLMEFVGSGDEGKRRRRRAGKKEIYARLARPVPFGDGKKEFWLDKNKGMICMALSSKALVITGIDDRRYWQHMPTSESRFQSVAYLQQIWWFEVVGEVDFCFPVGTYSLYFRVHLGKFYRRFGRRQCTSEHVHGWDKKPVRFQLSTSDGQQALSQCYLEEPGSWVLYHAGDFVASKPDQLMKLKFSMAQIDCTHTKGGLCIDSVLIYPKGKGFHQERVVRSQKXGCRCCGGIHIRMLEQMQLAA

SEQ ID NO: 5873 - protein, 342 aa, Zea mays
  UNSURE (1)..(342): unsure at all Xaa locations
  Clone ID: PAT_MRT4577_59C.1.pep
  unsure (1)..(342): unsure at all Xaa locations
MKFGATYEEYLRAERDKFLGQCSHVEYKRLKKVLKKCRVGRSLQADXAQMVMSSRRGETXSNICECNSCTLCDEMFFTELNKEASEIAGCFRSRVQRLLHLHVPSGLQRCIWRFRQCFIDDQQIMVQEGRMLLNYVTMNAIAIRKILKKYDKIHGSVSGRDFKSKMQTEHIELLQSPWLIELAAFHLNCDDSDADEPRAGEFFKNGFFKNFSCDLSGAQPLLTMTISETLKYEYSLTCPICLDTLFNPYALSCGHLFCKACACGAASVYIFQGVKSAPPEAKCPVCRAVGVFDRAVRMTELELLLKRRDKDYFLQRLREERSVMVKQAKEYWDSQAMLSMGI

SEQ ID NO: 5874 - protein, 52 aa, Zea mays
  Clone ID: PAT_MRT4577_60029C.1.pep
KLRNYRAHIVTTDIADPVDHPAIPALGFDIPNASSSQMDVCVAILDTLTFTI

SEQ ID NO: 5875 - protein, 90 aa, Zea mays
  UNSURE (1)..(90): unsure at all Xaa locations
  Clone ID: PAT_MRT4577_60030C.1.pep
  unsure (1)..(90): unsure at all Xaa locations
RTRGQAAAGGYGLSTXYTDARVRDVASTGENEYDEYKKEEMQHMHKQDLGEVGTIAXGAFALYEKHEAKKDSEHAHRHKIEEEVLEEVVV

SEQ ID NO: 5876 - protein, 81 aa, Zea mays
  Clone ID: PAT_MRT4577_60119C.1.pep
YLPVFSLLLGVQVIILFASLYCQPHYKISSFCFFGTKHFLIDSCARKMFFIYRTMVPMRKSRPCRIFISRNPVFSQALPKS

SEQ ID NO: 5877 - protein, 49 aa, Zea mays
  UNSURE (1)..(49): unsure at all Xaa locations
  Clone ID: PAT_MRT4577_60194C.1.pep
  unsure (1)..(49): unsure at all Xaa locations
APTLPLTGTTTNRASPGSXSGXGEYGSAVLGXSHDERMGTKMGRGKIEI

SEQ ID NO: 5878 - protein, 102 aa, Zea mays
  UNSURE (1)..(102): unsure at all Xaa locations
  Clone ID: PAT_MRT4577_60373C.1.pep
  unsure (1)..(102): unsure at all Xaa locations
ETTPQPLLKDDFEFNGRKLTKAGVRQMIXRDILEYHRQMLQDYIECADHIHFLYPSGVDRVQRQIAHLDENYRRRVSSSPSRTQPTSLPRERVCSSDHGHSH

SEQ ID NO: 5879 - protein, 110 aa, Zea mays
  Clone ID: PAT_MRT4577_60466C.1.pep
ERRWCCCRQRLGTASEAASCGEVTLSEAAYLEYAMRSAASPSTRCCSGLSSLNRRASATEDRKATCNCLKSMTGRLGGGRSMTNAANIPGKCAASAGVPIRPTDDCTKIN

SEQ ID NO: 5880 - protein, 125 aa, Zea mays
  Clone ID: PAT_MRT4577_60473C.1.pep
GRKGPRVRRGLGFSTATTAGGVSQRGRQFPRVPRVRGAWFRGHYYYYYGAAHVWGVATAKKTAAALAAPAAAAATLTAFHGNGRQRRIWPTRGGGWLLVVVRAWPAKQGVSLGDTFKIKIADTPT

SEQ ID NO: 5881 - protein, 55 aa, Zea mays
  Clone ID: PAT_MRT4577_60532C.1.pep
LQGRSVTVVSVVFVRGSGEPVHQPAWLVVRWLLFVLSGFVLGPTKASSGPSWWCG

SEQ ID NO: 5882 - protein, 78 aa, Zea mays
  Clone ID: PAT_MRT4577_60548C.1.pep
WGPGAHVTMLAPVLFTQAQSVYLRSSRVRCCPSVFLMEGRSVSVVSAVFIRGPTRTRHQPACCADPWVLLPPPGFIVS

SEQ ID NO: 5883 - protein, 33 aa, Zea mays
  Clone ID: PAT_MRT4577_60573C.1.pep
HASGLMWLDLNSNRLRGEIPRRLGRQLGSTPLS

SEQ ID NO: 5884 - protein, 256 aa, Zea mays
  Clone ID: PAT_MRT4577_60636C.1.pep
MVYIKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKNRDLDEEYEGNVEATGEDFSVEPSDERRPFRALLDVGLIRTTTGNRVFGALKGALDGGLDIPHSDKRFAGFKKDEKSLDAEIHRKYIFGGHVADYMRSLADEEPEKFQTHFSEYIKRGISADDMEAVYKKVHAAIRADPTWANHQ

SEQ ID NO: 5885 - protein, 88 aa, Zea mays
  Clone ID: PAT_MRT4577_60647C.1.pep
IGFWVSPRSYIFDVADDSQLIIHSRVLLFSETCHCSGLTSFFARKASSCTGGDSRRGFPILRSTPSLAAISSLLYSTRTNAAALVTEI

SEQ ID NO: 5886 - protein, 100 aa, Zea mays
  UNSURE (1)..(100): unsure at all Xaa locations
  Clone ID: PAT_MRT4577_6075C.1.pep
  unsure (1)..(100): unsure at all Xaa locations
MAAKIFCRLMLLGLSASAATSTIFPRCSQAPIDYLLAPILSPSVSSVCENPILQPYKIQQAIASGILPLSPSVLQQSXDLLQHLPLVHLLAHYIRAQQLL

SEQ ID NO: 5887 - protein, 70 aa, Zea mays
  Clone ID: PAT_MRT4577_60822C.1.pep
TVKQRSSNALEAPVKRRDYLSLVSHTIGLREDHMKAIRMDEQSSICSPSTMQEDWKRSDSNGNSCTRSLS

SEQ ID NO: 5888 - protein, 399 aa, Zea mays
  Clone ID: PAT_MRT4577_60917C.1.pep
MDASKLRELRDFVEACKKNPSLLADPNLSFFRDYLQSLGAKIPAAAPSFESPKRSSMDDIDDDGDDDDDLDMRDPTPERDELDEEIVESDLELEGEIVQSDHDDPPQKMGNPSVEVTEENRDASQEAKGKAMEAISEGKLEDAIEHLTNAIVLNPLSAIMYGTRASVFIKMKKPAAAIRDANAALEINPDSAKGYKTRGMAYAMLGKWEEAAHDLHTASNMDYDEEINAVLKKVEPNAHKIVEHRRKYERLRKEREEKRAQRDRLRQRAEAQAAYDKAKRKEQSSSRSSGGASPRGFPGGMPGGGFPRGMPGGGFPGGGMPGGFPGGGMPGGFPGGVPGNVDMSKILNDPDLMAAFSDPEVMAALQDVMNNPANFAKHQANPKVGPIIAKMMAKFNGSQ

SEQ ID NO: 5889 - protein, 155 aa, Zea mays
  UNSURE (1)..(155): unsure at all Xaa locations
  Clone ID: PAT_MRT4577_60944C.1.pep
  unsure (1)..(155): unsure at all Xaa locations
EEXHNETKADDGAAKTNPKEAGTERKNGIIVIKNRPCKGVEGTTSKTGKNGHAKGHWAAIDIVKGKKLEEIAPSSHNGDIPHVNRTEYQLRDISEDGFESRLTSEGNTKDERRLPTEETLEAQIKEGIERGKDLDVTDQSAMGEEQICALKDGGP

SEQ ID NO: 5890 - protein, 714 aa, Zea mays
  Clone ID: PAT_MRT4577_61009C.1.pep
MLHPSWVGVSAHVSEYWSVIIATVVFAFVGAVTIYYTVNQLNKNISLSLIRAIKARAKRYKKSKDKVPAASHIWRKEVVSRSKGLKCCVCLKSVSPPQYSGGTIHQCDICGAAAHPSCSGNAHKDCKCVSMAGLGHVLHQWAVQWIDSADHSEEDSFCCHCDESCNGAFLAGSPVWYCMWCQRLVHVDCHSSLAKETGDICDLGPLKRLILSPLCVKELHWTGAGILSSITNGANELASSVRETIRIRSKRYKRGSASADSDSSGAIELPSDAEGDSQEVNSKAKVRDDHANCKLNEVHQSSESEKDKQLVPDNAATTNMSDVQRENSHVQNNQKYEIINVPSDSRPLLVFINKRSGAQSGDSLRQRLQILLNPVQVFELSKQQGPDVGLALFRKVTHFRVLVCGGDGTAGWVLDAIEKQKFETPPPVAILPAGTGNDLARVLCWGGGLGVIEKRGGLFSVLQDVEHAAVTVLDRWKITIKDNQGKLMRPPKFMNNYFGVGCDAKVALDIHNLREENPERFYSQFMNKVLYAREGAKNIMDNTFDCFPWDVKLEIDGSKIDIPQDSEGILVANIRSYMGGVDLWKNEDDVSDTYLPQSMHDKKLEVVSFTGMLHLGKLQVGLSRAKRLAQGHHIKVEVSTTMPIQVDGEPWSQEPGTIEVSHHSQAFMLKRVSEEPLGHAASVMADILENAESSGIISALQKRTLLQEIASRLL

SEQ ID NO: 5891 - protein, 155 aa, Zea mays
  UNSURE (1)..(155): unsure at all Xaa locations
  Clone ID: PAT_MRT4577_61277C.1.pep
  unsure (1)..(155): unsure at all Xaa locations
MDASGAGSKANNGAAGRKARPPCNKSVTPSVKDGMQFPVSRIGSYLNXGRYAPRVGTAAPVYLAAVLEYLFAEVLELARNPAQDNQKTRIIPRHVLLAIRNDNDLATLLAGVXIAHGGVLPXNFHSVLLPNNASHNAAIGVSKEPKFPKEGRQVP

SEQ ID NO: 5892 - protein, 895 aa, Zea mays
  Clone ID: PAT_MRT4577_61285C.1.pep
MASSSKASDSSSQRSKRSDQGTGREAAPASVVPIHGNLTQLIRQIKSRRLLYIKEKLEANRKTLQRHSCALFDVAAAAEVASRGSDGGNALSQRAAEGQFRLAGSDLAHGIGERDVVYMQEENLASGTLVLSSSGAAAQRTVVRFVKLPLVERIPPYTTWIFLDKNQRMADDQSVVGRRRIYYDPVGNEALICSDSDEEIPEPEEEKHFFTEGEDQLIWRATQEHGLNREVVNVLCQFIDSTPSEIEERSEVLFEKNEKNSGSSDKIERQLSLDKTMDAVLDSFDNLFCRRCLVFDCRLHGCSQNLVFPTEKQPYSFEPDENKKPCGRQCYLRWRGGFQEIHDVGLSGCATYNMESGTVSHKVDVSIMSESEDSNREKGNIRSMTLVGTSGSKIISSVSAEESTTPPSADTSETENASSDMPPSSLRKYKISKRGPRYRERSPGKRQKVFTYDISFASNILNKLSIPEIRDTRLESREPGGDKLQILDESTKKTSSKDICGESPITTTENVGRESKKVSSTKNFLEHTLSCWSALERDLYLKGIEIFGKNSCLIARNLLSGMKTCMEVANYMYNNGAAMAKRPLLNKSISGDFAETEQDYMEQDMVARTRIYRRRGRNRKLKYTWKSAGHPTVRKRIGDGKQWYTQYNPCVCQQMCGKDCPCVENGTCCEKYCGCSKSCKNKFRGCHCAKSQCRSRQCPCFAASRECDPDVCRNCWVSCGDGSLGEPPARGDGYQCGNMKLLLKQQQRILLGRSDVAGWGAFIKNPVNKNDYLGEYTGELISHKEADKRGKIYDRANSSFLFDLNDQYVLDAYRKGDKLKFANHSSNPNCYAKVMLVAGDHRVGIYAKEHIEASEELFYDYRYGPDQAPAWARRPEGSKKDEASVSHHRAHKVAR

SEQ ID NO: 5893 - protein, 894 aa, Zea mays
  UNSURE (1)..(894): unsure at all Xaa locations
  Clone ID: PAT_MRT4577_61287C.1.pep
  unsure (1)..(894): unsure at all Xaa locations
MASSSKASDSSQRSKRSDQGMGKDAAAASVVPIHANLTQLIRQVQSGRLAYIKEKLEVNRKTLQRHSCSLFDVAAAAEVASRGTDGGNALSQRAAERQCGSDLANGIGERDVVSVQEENLATGTLALSSSGATAQRTIVRFVKLPLVEKIPPYTTWIFLDKNQRMADDQSVVGRRRIYYDTVGNEALICSDSDEEIPEPEEEKHFFTKGEDHLIWRATQDHGLNQEVVNVLCXFIGATPSEIEERSEVLFEKNEKHSGSSDKIESRLSLDKTMDAVLDSFDNLFCRRCLVFDCRLHGCSQNLVFPCEKQPYSFDPDENKKPCGHLCYLRFPQWREGFKEMHDDGLAGGATYTMESGTASQRVDVNVMYESEDSNRQKGNIRSMTLVGTSGSKIISSVSAEESTTTPSADISETENVSSDLPPSSLRKHKISKHGPRYREHSPGKRQKVFTSDISFEGNIMNKLSIPEIRDTRLESRESGGDKLRILDESTKKTSRKDMCGESPATTMENVGRQSNKVSSTKNFLESTLSCWSALERDLYLKGIEIFGKNSCLIARNLLSGLKTCIEVANYMYNNGAAMAKRPLLNKSISGDFAENEQDYMEQDMAARTRIYRRRGRNRKLKYTWKSAGHPTVRKRTDDGKQCYTQYSPCACQQMCGKDCPCADKGTCCEKYCGCSKSCKNKFRGCHCAKSQCRSRQCPCFAASRECDPDVCRNCWVSCGDGSLGEPLARGDGYQCGNMKLLLKQKQRILLGRSDVAGWGAFIKNPVNKNDYLGEYTGELISHKEADKRGKIYDRANSSFLFDLNDQYVLDAYRKGDKLKFANHSSNPNCYAKVMLVAGDHRVGIYAKEHIEASEELFYDYRYGPDQAPAWARRPEGSKKDEASVSHRRAHKVAR

SEQ ID NO: 5894 - protein, 162 aa, Zea mays
  UNSURE (1)..(162): unsure at all Xaa locations
  Clone ID: PAT_MRT4577_61348C.1.pep
  unsure (1)..(162): unsure at all Xaa locations
LRRPYVPQCSQAPIASLLPPYLLPAXDAECENPILQPYMIQQAITGGILPLSPLFLQQSSPLLHQLPLEHQSPQNITAQQPQQLELANLAGYSTKQQXLTFNQLHGLNYACYXQHQQLPFIHVPDAYPQKYLTFNQLXASNSPAXLXQREQLLPFNQLAGVS

SEQ ID NO: 5895 - protein, 63 aa, Zea mays
  UNSURE (1)..(63): unsure at all Xaa locations
  Clone ID: PAT_MRT4577_61382C.1.pep
  unsure (1)..(63): unsure at all Xaa locations
MAAADVEYRCFVGWLAWATSIESLENAFGSYCEILDSKVISDRXTWMSRGFGIAIFSSLRSML

SEQ ID NO: 5896 - protein, 123 aa, Zea mays
  UNSURE (1)..(123): unsure at all Xaa locations
  Clone ID: PAT_MRT4577_61462C.1.pep
  unsure (1)..(123): unsure at all Xaa locations
MVLYVEKTSTGREYKVKDLSQADFXRLEIALAMVEMPGLMACRAEIGPYKPFSGARISGPFHMTIQTVRLIETLTALGAQVRWCSCNIFSTQDHARCGIVRDWYDAFAWKVETLVEYCGCTER

SEQ ID NO: 5897 - protein, 370 aa, Zea mays
  UNSURE (1)..(370): unsure at all Xaa locations
  Clone ID: PAT_MRT4577_61799C.1.pep
  unsure (1)..(370): unsure at all Xaa locations
MDEGQGVRYWCHMCQEVIDPMPEMKCPGCEGGFVEEMDSEDFEPAANARSDRSVSLLAPLLLGMMGGSSRRSRLRREAMVEADADQDDEEDDSDHELELSRRRRRRRRSSALFSVLEAMRDRDEVRGXMTPTVIQRETWREGEGRGWRGRGRXRQIERVSARGRERTESLILINSNNEAIILQGTFGSDDNQEDSSNTSSGVSLGDYFLGPALDTLLQRLAESDLSRSGTPPAKKEAVAALPTVNIEEALGCSVCLEDFEMGGEAKQMPCQHKFHSHCILPWLELHSSCPICRFQLPTEETKNNPCESASTAGTVNGGGDNAAASGSDTESTNHNEDDHSDSPIFSALSTLFSDPFSSDDDESVPHSYEN

SEQ ID NO: 5898 - protein, 145 aa, Zea mays
  UNSURE (1)..(145): unsure at all Xaa locations
  Clone ID: PAT_MRT4577_61820C.1.pep
  unsure (1)..(145): unsure at all Xaa locations
GAAGRKAGGPRNXSVTRSVKAGLHFPVGRIVRYLKKGRYAQRVGTGAPVYLSDVLEYLAADVLDLAWNSAIDNKKTRIIPRHVLLAIRNVXELVKLLSGVTISHGGVLPIIHSVLLPNKAEDKAAICLSNEPKSPKKVANSPKKA

SEQ ID NO: 5899 - protein, 116 aa, Zea mays
  UNSURE (1)..(116): unsure at all Xaa locations
  Clone ID: PAT_MRT4577_61834C.1.pep
  unsure (1)..(116): unsure at all Xaa locations
LVPAKNKESPGGLYXTVGGLTPIDPTRHDRTDTIRKALVLGVNDNMITADQLAIVTETARRLGMSTNMYPSYALIGQNKDATLEPLSVDELIDKAYGLAALFPEHKYEIVQRLHEK

SEQ ID NO: 5900 - protein, 124 aa, Zea mays
  UNSURE (1)..(124): unsure at all Xaa locations
  Clone ID: PAT_MRT4577_61892C.1.pep
  unsure (1)..(124): unsure at all Xaa locations
MAGKICWFPMLLGLSASAATVTIFPQCSQAPIAFFLARYLSPALSSVCENPTLQPYRIHQAIATGILPLSPLFIQQPIALLQQLPMKHFMAPNIKAHHLQQLGLXNLAAYSQXPPSLSFNQLAA

SEQ ID NO: 5901 - protein, 108 aa, Zea mays
  Clone ID: PAT_MRT4577_61933C.1.pep
MDAQYNPRTVEEVFRDYKGRRNGLARALTTDVEEFFRQCDPEKENLCLYGFPNEHWEVNLPAEEVPPELPEPALGINFARDGMQEKDWLSMVAAHSDAWLLSVAFYFG

SEQ ID NO: 5902 - protein, 258 aa, Zea mays
  Clone ID: PAT_MRT4577_62309C.1.pep
IRRALNLGVSVKMITGDQLAIGKETGRRLGMGTNMYPSSALLGQNKDESIAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWEFDFPPFMVLIIAILNDGTIMTISKDRVKPSPLPDSWKLAEIFTTGIVLGGYLAVMTVIFFWAAYKTNFFPRIFHVESLEKTAQDDY

SEQ ID NO: 5903 - protein, 356 aa, Zea mays
  Clone ID: PAT_MRT4577_62540C.1.pep
MLVEMGSRAAFVVAFLLRAIYAGTQILTKAAFDEGMNTSVFVFYRHLTGILFLVPIAFVLERKTAPPLSFRVSLKLFFHALYGISGAINIYGLGLSYSSATSSSAIFNLLPAVAFFLAVLLGMETLNLKRFHGIAKAAGVLFSTAGVTVLAFYQGPAFRSFIHHTAFSHHNVHAGVVTAAHPKSVWILGIFLTTLSTASWALWTVLQGPMLEAYPSKLLNTTLQMIFATVQCFFIALAAERDLSRWKLALDIRLYAVIYSGILVSGVAYYMQVWVIEKSGPVFLAMTMPITLLVTIILSLFLGEPVTLGSILGGLIMVGGLYSVLWAKRSEQVHASKQQMAAPTPPPAGDTSVGRA

SEQ ID NO: 5904 - protein, 377 aa, Zea mays
  Clone ID: PAT_MRT4577_62558C.1.pep
MANSRIGRYKMSTLSDPSKEDTSPEGSGTTQRNGAWSNTLNTLLQQASVYGVAAGYCLSASLLSIINKWAIMKFPYPGALTALQYFTSVAGVLLCGQLKLIEHDGLNLRTMWKFLPAAVMFYISIFTNSELLLHANVDTFIVFRSAVPIFVAIGETLYLHQPWPSLKTWLSLSTILGGSVIYVFTDNQFTVTAYTWAVAYLASMSIDFVYIKHVVMTIGLNTWGLVLYNNLEALMLFPLELLIMGEFDQMKVDSSKVSNWLSFDVVLPVALSCLFGLSISFFGFSCRRAISATGFTVLGIVNKLLTVVINLLIWDKHASFVGTIGLLICMSGGVLYQQSTMKPKAPKVEPKEENDNDEEQQKLLQMQGVQESNPTQK

SEQ ID NO: 5905 - protein, 384 aa, Zea mays
  UNSURE (1)..(384): unsure at all Xaa locations
  Clone ID: PAT_MRT4577_62559C.1.pep
  unsure (1)..(384): unsure at all Xaa locations
MANSRTGRYKMSNLSHTSKEDTSPEGSGTTERTGAWSNMLNTLMQQASIYGVAAGYCLSASLLSIINKWAIMKFPYPGALTALQYFTSVAGVLLCGQLKLIEHDGLNLRTMWKFLPAAVMFYISIFTNSELLLHANVDTFIVFRSAVPIFVAIGETLYLHQPWPSLKTWLSLSTILGGSVIYVFTDNQFTVTAYTWAVAYLASMSIDFVYIKHVVMTIGLNTWGLVLYNNLEALMLFPLELLVMGEFDQMKVDSSKVSNWLSFDVVLPVALSCLFGLSISFFGFSCRRAISATGFTVLGIVNKLLTVVINLLIWDKHASFVGTIGLLICMSGGVLYQQSTXRKPXAPRLSRKKKTTKKQQKLLPDAREVPRKVHKPLQKKTTTK

SEQ ID NO: 5906 - protein, 378 aa, Zea mays
  UNSURE (1)..(378): unsure at all Xaa locations
  Clone ID: PAT_MRT4577_62561C.1.pep
  unsure (1)..(378): unsure at all Xaa locations
MANSRIGRYKMSTLSDPSKEDTSPEGSGTTQRNGAWSNTLNTLLQQASVYGVAAGYCLSASLLSIINKWAIMKFPYPGALTALQYFTSVAGVLLCGQLKLIEHDGLNLRTMWKFLPAAVMFYISIFTNSELLLHANVDTFIVFRSAVPIFVAIGETLYLHQPWPSLKTWLSLSTILGGSVIYVFTDNQFTVTAYTXKVAYLASMSIDFVYIKHVVMTIGLNTWGLVLYNNLEALMLFPIELLVMGEFSQMKVDSSKMTNWLSFDMILPVALSCLFGLAISFFGFSCRRAISATGFTVLGIVNKLLTVVINLLIWDKHSSLVGTIGLLICMSGGVLYQQSTTKPKAPNFEPKEENDEEEQKLLEMQQGRDISSTVEHSS

SEQ ID NO: 5907 - protein, 361 aa, Zea mays
  Clone ID: PAT_MRT4577_62565C.1.pep
MSNLSHTSKEDTSPEGSGTTERTGAWSNMLNTLMQQASIYGVAAGYCLSASLLSIINKWAIMKFPYPGALTALQYFTSVAGVLLCGQLKLIEHDGLNLRTMWKFLPAAVMFYISIFTNSELLLHANVDTFIVFRSAVPIFVAIGETLYLHQPWPSLKTWLSLSTILGGSVIYVFTDNQFTVTAYTWAVAYLASMSIDFVYIKHVVMTIGLNTWGLVLYNNLEALMLFPLELLVMGEFDQMKVDSSKVSNWLSFDVVLPVALSCLFGLSISFFGFSCRRAISATGFTVLGIVNKLLTVVINLLIWDKHASFVGTIGLLICMSGGVLYQQSTTKPKAPKVEPKEENDEEQQKLLQMQGVQESS

SEQ ID NO: 5908 - protein, 155 aa, Zea mays
  Clone ID: PAT_MRT4577_62747C.1.pep
MSLVRRSSVFDPFSVDLFDPFDSMFRSIVPSSSSAAAAASETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISG

SEQ ID NO: 5909 - protein, 154 aa, Zea mays
  Clone ID: PAT_MRT4577_62749C.1.pep
MSLVRRSSVFDPFSVDLFDPFDSMFRSIVPPSLSSSAASETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISG

SEQ ID NO: 5910 - protein, 154 aa, Zea mays
  Clone ID: PAT_MRT4577_62752C.1.pep
MSLVRRSSVFDPFSVDLFDPFDSMFRSIVPSSPSSAAASETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISG

SEQ ID NO: 5911 - protein, 154 aa, Zea mays
  Clone ID: PAT_MRT4577_62754C.1.pep
MSLVRRGSVFDPFSVDLFDPFDSVFRSIVPSSSSAAAASETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISG

SEQ ID NO: 5912 - protein, 154 aa, Zea mays
  Clone ID: PAT_MRT4577_62755C.1.pep
MSLVRRSSVFDPFSMDLFDPFDSMFRSIVPSSSSAAAASETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISG

SEQ ID NO: 5913 - protein, 154 aa, Zea mays; identical to SEQ ID NO: 5909
  Clone ID: PAT_MRT4577_62757C.1.pep

SEQ ID NO: 5914 - protein, 152 aa, Zea mays
  Clone ID: PAT_MRT4577_62758C.1.pep
MSLVRRSSVFDPFSVDLFDPFDSMFRSIVPSSSSSGSETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISG

SEQ ID NO: 5915 - protein, 154 aa, Zea mays; identical to SEQ ID NO: 5911
  Clone ID: PAT_MRT4577_62761C.1.pep

SEQ ID NO: 5916 - protein, 34 aa, Zea mays
  Clone ID: PAT_MRT4577_62928C.1.pep
ELQTGTAPCTVRRAVADGRSHHAGIRTSSLGSDC

SEQ ID NO: 5917 - protein, 46 aa, Zea mays
  Clone ID: PAT_MRT4577_62955C.1.pep
GGVVLANPPLIPWPSGLFFWPSDSGSHFAIIVPFSATCYWCWCVSI

SEQ ID NO: 5918 - protein, 122 aa, Zea mays
  UNSURE (1)..(122): unsure at all Xaa locations
  Clone ID: PAT_MRT4577_63094C.1.pep
  unsure (1)..(122): unsure at all Xaa locations
FGENPIVQPYMIQQAIATCILPLSPVCVGQPSALLQQLPLVHLVAQNIRAQQLLHLVLANLAAYSQQHQFLPFNQLAALNSAAYLQQQLPFSQLVAAYPQRLXAFNQLATFDSAGYLQGATT

SEQ ID NO: 5919 - protein, 58 aa, Zea mays
  Clone ID: PAT_MRT4577_63141C.1.pep
SGTDLTNFSHFTTTRCSRPRAEIRSTDSLPSTRLVHRSGYLSGILAAAAAARGRNYVA

SEQ ID NO: 5920 - protein, 158 aa, Zea mays
  UNSURE (1)..(158): unsure at all Xaa locations
  Clone ID: PAT_MRT4577_63173C.1.pep
  unsure (1)..(158): unsure at all Xaa locations
MAAADVEYRCFVGGLAWATSNESLENAFPSXGETSIQVIRDRGRXXSLCFXFXTFSSENSMLHAIENMNGKELHGRNITVNQAQSLGGGGGGGGYGGGLGGGGCYGGGRPDCGYGGGGGYCGPRXGGGGGYXGGDGYCGPREGGGGGYRGGGGGGLKD

SEQ ID NO: 5921 - protein, 219 aa, Zea mays
  UNSURE (1)..(219): unsure at all Xaa locations
  Clone ID: PAT_MRT4577_63185C.1.pep
  unsure (1)..(219): unsure at all Xaa locations
MYGNDNWINSYLDAILDAGKGAGPARGRGGGGGDRPSLLLRERGHFSPARYFVEEVITGYDETDLYKTWLRANAMRSPQEKNTRLENMTWRIWNLARKKKEFEKEEANRLSKRRLEAEKPQNDATADMSEDLFEGVKGEDVGDPSVAYGDSTAGNTPRISSFDKLYIVVFSLHGLIRGENMELGRDSDTGGQVKYVVGLAKXLRSCPGVYXVDLLAGQS

SEQ ID NO: 5922 - protein, 199 aa, Zea mays
  UNSURE (1)..(199): unsure at all Xaa locations
  Clone ID: PAT_MRT4577_63188C.1.pep
  unsure (1)..(199): unsure at all Xaa locations
MYGNDNWINSYLDAILDAGKGVAAAAAGAARGRGGGWGGDRPSLLLRERGHFSPARYFVEEVITGYDETDLYKTWLRANAMRSPQEKNTRLENMTWRIWNLARKKKEFEKEEAIRLSKHRLETKKPRNDATAEMSEDLFEGVKGEDAGDPSVAYGDSTTGNTPRTSLFDKLYIVXLISLHGLVRGENMELGRXCDPGGQ

SEQ ID NO: 5923 - protein, 140 aa, Zea mays
  UNSURE (1)..(140): unsure at all Xaa locations
  Clone ID: PAT_MRT4577_63251C.1.pep
  unsure (1)..(140): unsure at all Xaa locations
KGCGGLPVDVTGTLFHKAMKARMLLGAAGDHIIXTDTRASGIAXSDLLASYLDDREALTDSQIADNLIGVICGDRDTTHRVLTWMVKLLGHHPAVHKAHIVEQQENLRSKGSSGELLTWADTRRMRTTSRVIQETMQVAS

SEQ ID NO: 5924 - protein, 122 aa, Zea mays
  Clone ID: PAT_MRT4577_63260C.1.pep
MSAMETDINAPPPAPAGEGSSVVGPSSSSRKPNKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 5925 - protein, 123 aa, Zea mays
  Clone ID: PAT_MRT4577_63263C.1.pep
MSAMETDINAPPPAPAGEGSSVVGPSSSSSRKPNKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 5926 - protein, 97 aa, Zea mays
  UNSURE (1)..(97): unsure at all Xaa locations
  Clone ID: PAT_MRT4577_63267C.1.pep
  unsure (1)..(97): unsure at all Xaa locations
MAAYILWRVMLLGISSSAATATIFTHCPQAPIASLLSPXLLPSMSSXCENPILQPYRIQQAITTGILPFLPMXLQQSLSLFHQLPLVHLLDQIIMAQ

SEQ ID NO: 5927 - protein, 64 aa, Zea mays
  Clone ID: PAT_MRT4577_63382C.1.pep
SRGFIFVACGVCCCPICVFDSQGRYCVQLLVMCSSLGFQQTHAHTSMDCGSMEAVNPIQIYYKL

SEQ ID NO: 5928 - protein, 88 aa, Zea mays
  Clone ID: PAT_MRT4577_63385C.1.pep
FVMDSPITVFCHGDWSVFSIVLPVSSVLQSLRPLRWTVVVVEQYQVQIIPSIKLIMPTLVLHHTMLRVHLHGPLAALGYSWTQMHQCK

SEQ ID NO: 5929 - protein, 34 aa, Zea mays
  Clone ID: PAT_MRT4577_63436C.1.pep
MRPLRRGWIQIGRSYILAEIGLHGDFLSLITCEC

SEQ ID NO: 5930 - protein, 608 aa, Zea mays
  UNSURE (1)..(608): unsure at all Xaa locations
  Clone ID: PAT_MRT4577_63582C.1.pep
  unsure (1)..(608): unsure at all Xaa locations
MEWDSDSDGGDDEEEEEVRPGGGDAGPGFSLAIEGVLGACGMVVSDALEPDFPIIYVNRGFESSTGYSAEEVLGRNCRFLQCRGPFAQRRHPLVDAAVVTRIRRCLDEGTEFHGDLLNFRKDCSPYMARLQLTPIYGDDEVITHYMGIQFFNDSNVDLGPSSGSVTKEXQDLHGLHLATLTHQLXVGKGXCGXSSLFLLSDEVICQKILSKLSPRDIASVNSVCKRLHHMTRNEDLWRMVCQNAWGTEATRALETVAGSRSLAWGRLARELTTLEAVAWRKLTVGGAVEPSRCNFSACAVGNRVVLFGGEGVNMQPMNDTFVLDLSASKPEWRHINVSAAPPGRWGHTLSCLNGSRLILFGGCGGQGLLNDVFILDLDAQHPTWREIPGLAPPVPRSWHSSCTVDGTKLVVSGGCADSGVLLSDTYLLDVTMERPVWREIPASWSPPSRLGHSLSVYDGRKILMFGGLAKSGPLRLRSSDVFTLDLSEDKPCWRCITGSRMPGAGNPAGVGPPPRLDHVVVSLPGGRVLIFGGSVAGLHSASKLYLLDPTEDKPTWRLLNVPGHPPRFAWGHSTCVVGGTKAIVLGGQTGEEWTLTEIHELSLASSLV

SEQ ID NO: 5931 - protein, 132 aa, Zea mays
  UNSURE (1)..(132): unsure at all Xaa locations
  Clone ID: PAT_MRT4577_63852C.1.pep
  unsure (1)..(132): unsure at all Xaa locations
NIHEQYLLRHLLCNHCGYCEQQQLPLVHLXAQNITAQQLQQLVLANLDDYSNQQQILSFNQLAALNSAAYSHQQQLLPFSQLAAAYPRQFLTFNXLAALNSHAYVQXQQLLPFSQLAAASTVAFLTQQHLMS

SEQ ID NO: 5932 - protein, 176 aa, Zea mays
  UNSURE (1)..(176): unsure at all Xaa locations
  Clone ID: PAT_MRT4577_63854C.1.pep
  unsure (1)..(176): unsure at all Xaa locations
QPIAFGISHLSPLFLLQSSXAILQQLPLRLLLARNIRALRLQQLVLANLVAYYKQHQFLPFNHQDALNFASYLQQQQLPFNQLAAAYPQQFLPFNQLAALNSPAYLQQQQLLPFSQLAGVSPAAFLTXPQLLPFYQHAAPNAGTLLQLQQLLPFSQLALTNPAVLYXQPIIGGALF

SEQ ID NO: 5933 - protein, 93 aa, Zea mays
  Clone ID: PAT_MRT4577_63857C.1.pep
MAAKIFCLLMLRGLSASAATATIFPQCSQAPIASLLPPSLSPPVSSVCETPILKPSRIPQAIAACHLTFITLVLQPLLTLLQQLPFVHLLAQN

SEQ ID NO: 5934 - protein, 150 aa, Zea mays
  Clone ID: PAT_MRT4577_63860C.1.pep
ENPLLQPYRIQQAMTAGILPLSALVLLQSSGLLHHIPLVHLLAQNIRAQQLQQLALANLDAYYQEQKFVTLNQLAWLNSASYLQQQQLPFRQLPAAYPQQFLPFNQLAALNSPAYLQQQQLLPFSQLAGASPATFLIQPQLLPIYQHAAP

SEQ ID NO: 5935 - protein, 129 aa, Zea mays
  UNSURE (1)..(129): unsure at all Xaa locations
  Clone ID: PAT_MRT4577_63862C.1.pep
  unsure (1)..(129): unsure at all Xaa locations
MAAKIFCLLMLRGLSASAATATIFPQCSQAPIACLLPPYLSPAESYVCENPILQPYRIQQAIAAGILPLSPLLLQQSSGLLQQLPLVHLLAPNIKAQQLPQLVLTNLGGYCXQQQVPSFDPLGSLNSAS

SEQ ID NO: 5936 - protein, 156 aa, Zea mays
  UNSURE (1)..(156): unsure at all Xaa locations
  Clone ID: PAT_MRT4577_63865C.1.pep
  unsure (1)..(156): unsure at all Xaa locations
MAAKIFCLLMLLGLSASAATVTIFPQCSQAPIASLLPPYLSPALSSVCXENPILQPYRIQQEIADGILPLSPLYLQQSSPLLQKLPSEHLLXAQNICVLPLQQLVPAYLAAYSQQQQLLQFNQLPAWNSASYLRLQRTTNQPNYAAAYPQEISFNS

SEQ ID NO: 5937 - protein, 138 aa, Zea mays
  UNSURE (1)..(138): unsure at all Xaa locations
  Clone ID: PAT_MRT4577_63866C.1.pep
  unsure (1)..(138): unsure at all Xaa locations
MAAKIFCLLMLLGLSASAATATIFPQCSQAPIASLLPPYLSPTVSSVCENPILQPYRIQQAIAAGILPLSPLFLHXNXALLQQLPWGHXLAQKIRAHHFQQLGLANLVAYFXQQQVFSFNPLTGLDSASYLEQQQLPF

SEQ ID NO: 5938 - protein, 142 aa, Zea mays
  UNSURE (1)..(142): unsure at all Xaa locations
  Clone ID: PAT_MRT4577_63868C.1.pep
  unsure (1)..(142): unsure at all Xaa locations
MAAGVCVHLMLPDISTRAATVTIFPQCSQAPIAILVAPYLSPAASSVCENPIHQPYMIQQAIAAGILPLSHLVLQQSXPLLQHVPLVHLLAQNMMAQQLQQLALSNLAAYSXQQQFLTFNQLTALNSASYLQEQQLPFRQLP

SEQ ID NO: 5939 - protein, 131 aa, Zea mays
  UNSURE (1)..(131): unsure at all Xaa locations
  Clone ID: PAT_MRT4577_63888C.1.pep
  unsure (1)..(131): unsure at all Xaa locations
RGRVGATIFPQCSHAPSAYFLSPYLLPAGSSVCENPILQPYRIQQAVAEGILPLXPLLLQQPADLLQPLPLVHLLAQNIKGQQLQQLVLGNLAAYSQXQEFLAFNQLAALNSAAYLQQQLPFSQLAAAYPQ

SEQ ID NO: 5940 - protein, 362 aa, Zea mays
  Clone ID: PAT_MRT4577_6388C.1.pep
MDVEARKSDAPPARGKAMHRFLVALNCGMLAVGAIGGPLLSRLYFSKGGHRQWLSAWLETGGWPLLVIPVAASFVARRARDRGAPVLLAPPRILLAAAGLGVATGADDFIYAFGLAYLPVSTSAILISTQLAFTVFFAFLVVRQRLTAASVNAVALLTVGAVVLGLHVSSDRPPGVTRGQYWLGFVLTLGAAALYGLVLPLVELAYRRAAGAGRAVTYALVVEMQLVMGFFATAFCTVGMVVNKDFQAIPREARQYELGEARYYMVLAWAAVLWQCFFLGAVGVIFCVHTLLAGILIAVFIPVTEVAAVIFLHEKFSSEKGVALALSLWGLASYSYGEWSQAKAKKEKKSEEDDGEVAQAVP

SEQ ID NO: 5941 - protein, 244 aa, Zea mays
  UNSURE (1)..(244): unsure at all Xaa locations
  Clone ID: PAT_MRT4577_63892C.1.pep
  unsure (1)..(244): unsure at all Xaa locations
CTNIWQYNILRLLMLLGLSGSAATATILPQCXQAPIXSLLPRXLSPTGFSVXENPILQPYRIQQAIAGGVLPLSPLFLQQSSALLQQVPLVHLLAQNIRAQQLQQLVLANLAAYSQQQQFLPFNQLAALNSASYLQQQQLPFSQLSAAYPQQFLPFNQLTAXLNSPAYLQQQQLLPFSQLAGVSPATFLTHPXQLLPFXYQHVAPXNLGPFLQLXQLLPFQPTLLLPNPAXAFYXNPIIGGALF

SEQ ID NO: 5942 - protein, 198 aa, Zea mays
  UNSURE (1)..(198): unsure at all Xaa locations
  Clone ID: PAT_MRT4577_63894C.1.pep
  unsure (1)..(198): unsure at all Xaa locations
MLPWSFLQVAAYRRHIFPKCSQAPIASLFPPYLXPAVSWVWEXNPILQPYRIQQAITAGILPLSPLFLQQSSALLHQLPLVHLLAQNIRAQQLQQLVLANLAAYSQQQQFLPFNQLAALNSASYLQQHQLPFSLLPAACPQSFLPFIPLAALNSPAFLQPLQLLPFSLLSGVCPAAFLXHPQXLLPXFRLAAPPPGSP

SEQ ID NO: 5943 - protein, 235 aa, Zea mays
  UNSURE (1)..(235): unsure at all Xaa locations
  Clone ID: PAT_MRT4577_63895C.1.pep
  unsure (1)..(235): unsure at all Xaa locations
MAGKIFWLLMLLGLFARAGTGTIFPERLEGSIAFLFSPYLLTTGALXWENPIFXPFRIQQAITGGILPLSPLFLQQSSALLXELPLVHLLAQNIRAQQXLQQLVLANLVAYSQQQQFLPFNQIGSLNSASYLQQQQLPFSQLLAAYPQQFLPFNQLAALNSPAYLQQQQLLPFSQLAGVSPATFLTQPQLLPFYQHVAPNAGTFLQLQQLLPFNQLVLTNPAVFYQQPIIGGALF

SEQ ID NO: 5944 - protein, 235 aa, Zea mays
  UNSURE (1)..(235): unsure at all Xaa locations
  Clone ID: PAT_MRT4577_63896C.1.pep
  unsure (1)..(235): unsure at all Xaa locations
MAAKIFXLLMLLGLSATSATATIFPQGSQAXIASILPPYLSPTVCMVCENPILXPYRIQQAIAAGILPLSPLVLQQSSALLQQLPLVPLLAQNIRAQQLQQLVLANLAAYSQQHQFLPFNQLAALNSAAYLQQQXQLPFSQLPAAYPQQFLPFNQLAALNSPAYLQQQQLLPFSQLAGVSPATFLTQPQLLPFYQHAAPNAGTLLQLQQLLPFNQLALTNPTAFYQQPIIGGALF

SEQ ID NO: 5945 - protein, 246 aa, Zea mays
  UNSURE (1)..(246): unsure at all Xaa locations
  Clone ID: PAT_MRT4577_63901C.1.pep
  unsure (1)..(246): unsure at all Xaa locations
LIPNCLLKRPIVSHIALRYVPPILLAFCSAATATMFPHCSQAPIASLLTPYLSPTVSSVCENPILQPYMIQQAIAAGILPLSPLFLQQSSALLQQLPXVHLLAQNIRAQQLQQLVLANLAVYSQQQQFLPFNQLAALNSASYLQQQQLPFSQLSAAYPQQFLPFNQLTNLNSSAYLQEQQLLPFSQLAGVSPGTFLTQPQLMAVYQNAGPNACTLLQLEQLLAFNPLGLTKPTRFYQPPNIGGALF

SEQ ID NO: 5946 - protein, 229 aa, Zea mays
  UNSURE (1)..(229): unsure at all Xaa locations
  Clone ID: PAT_MRT4577_63923C.1.pep
  unsure (1)..(229): unsure at all Xaa locations
SLLMLLALSESAATATILPKCSQAPIASLLPPYLSPAVSSVCENPILQPYRIQQALTAXGILPISPLFLQQSSALLHQLPLVHLLAQNIRAQQLQQLVLANLAAYSQQQQVLPFNQLAALNSAAYLQQQQLPFSQLPAAYPQQYLPFNQVTALNSPAXYLQQQQLLPFSQIDGVSPGTFLTQPQVSPFTQHGARNAGSMYQLHPMLPFSHLALTSPAAFGQQPIIGGAL

SEQ ID NO: 5947 - protein, 221 aa, Zea mays
  UNSURE (1)..(221): unsure at all Xaa locations
  Clone ID: PAT_MRT4577_63926C.1.pep
  unsure (1)..(221): unsure at all Xaa locations
MAFKIFXLLILLGRFASPVTAPIFPHCSQAPIASFFPPYLXPAVSSVCENPILQPYRIQQAIAAGILPLSPLFLQQSSALLQQLPLVHLLAQNIRAQQLQQLVLANLAAYSQQQQFLPFNQLGSLNSASYLQQQQLPFSQVPAAYPQQFLPFNQLGELNSPAYLQQQQLLPFXQLAGVSPATFXLAQPQVVAVYQHGGPNAGTPLXQLEQIGWPFNPNVLN

SEQ ID NO: 5948 - protein, 225 aa, Zea mays
  UNSURE (1)..(225): unsure at all Xaa locations
  Clone ID: PAT_MRT4577_63927C.1.pep
  unsure (1)..(225): unsure at all Xaa locations
MLLGISASAATVTILTQCSQXPIAAVLPPYLSPAVPSVCENPILEPYRIQQAISXAYLPLSPLFLQQSSALLQQLPLVHLLAQNIRAQQLQQLVLANLAAYSQQQQFLPFNQLAALNSASYLQQQQLPFSQLPVAYPQQFLPFNQLAALNSPAYLQQQQLLPFSQLAGVSPATFLTQPQLLPFYQHAAPNAGTIKQLQQSLPFNRRALTTRAVFYQHPIVGGALF

SEQ ID NO: 5949 - protein, 233 aa, Zea mays
  UNSURE (1)..(233): unsure at all Xaa locations
  Clone ID: PAT_MRT4577_63929C.1.pep
  unsure (1)..(233): unsure at all Xaa locations
TTAAKIFSLLMLLGLSASAXTVTIFLACSQAPIGSLLTXYLSPEESSVCXENPILQPHKIQQAMAGGILPLSPLFLQQXSALLQQVPLVHLLAQNIRAQQLQQLVLTNLAAYSXQHQVLPFNQLAALNSASYLQQQQLPFNQLAAAYPQEFLPFNQLAALDSLAYLQQQQLLPFNQLTGVSPATLLIQPQXVPVYQHAAPNAGTLLQLQQLLPWNQLXALTNXAGCVLQPIMG

SEQ ID NO: 5950 - protein, 220 aa, Zea mays
  UNSURE (1)..(220): unsure at all Xaa locations
  Clone ID: PAT_MRT4577_63935C.1.pep
  unsure (1)..(220): unsure at all Xaa locations
MAAKKLRLLMLLGLSARADTATIIPNCSQAPIAPLLPPYLSPTASWVCENPILQPYRIQQAITGGILPLSPLFLQQSSGLLHQLPLVHPLAQNIRAQQLQXLVLANLAAYSQQQQFLPFNQLAALNSASYLQQQQLPFSQLPAAYPQQFLSFNQLAALNSPAYLQQQQLLTFNQLACVNPSYFFIQPQLVPFXQQPWPNACNLLTLQPLLAFNPIALTKP

SEQ ID NO: 5951 - protein, 188 aa, Zea mays
  Clone ID: PAT_MRT4577_63936C.1.pep
ALWENPIVQPYRIQQAIATGILPLSPLFLQQPSALLQQLPLVHLVAQNIRAQQLQQLVLANLAAYSQQHQFLPFNQLAALNSAAYLQQQLPFSQLVAAYPQQFLPFNQLAALNSAAYLQQQQLLPFSQLADVSPAAFLTQQQLLPFYLHAMPNAGTLLQLQQLLPFNQLALTNSTVFYQQPIIGGALF

SEQ ID NO: 5952 - protein, 198 aa, Zea mays
  UNSURE (1)..(198): unsure at all Xaa locations
  Clone ID: PAT_MRT4577_63951C.1.pep
  unsure (1)..(198): unsure at all Xaa locations
MAAKIFGCLMLLGLSASGATGTIFPQWLQASIAFLLSPYLLTTGASMGENPIXNPYRSHQASEPGILPLXPLFLQQPSALLQQLPLVHLVAQNIRAQQLQQLVLANLAAYSQQHQFLPFNQLAALNSAAYLQQQLPFSQLVAAYPQQFLPFNQLAALNSAAYLQQQQLLPFSQLTYVNPCCFLTQQPVXPSYLHAMPN

SEQ ID NO: 5953 - protein, 235 aa, Zea mays
  UNSURE (1)..(235): unsure at all Xaa locations
  Clone ID: PAT_MRT4577_63957C.1.pep
  unsure (1)..(235): unsure at all Xaa locations
MAAKIFCLLMLLGLSASAATATIFPQCSQAPIASLLPPYLSPVVSSVCENPILQPHRIQQAIAAGILPLSPLFLQQSSALLQQLPLVHLLAQNIRAQQLQQLVLANLAAYSQQHQFLPFNQLAALNSVSYLQQQQLPFNQLAAAYPQQFLXPFNQLAALNSPAYLQQQQLLPFSQLAGVSPAVFLTQPQLLPFYQHAAPNAGTLLQLQQLLPFNQLALTNPAVLYQQPIIGGALF

SEQ ID NO: 5954 - protein, 183 aa, Zea mays
  UNSURE (1)..(183): unsure at all Xaa locations
  Clone ID: PAT_MRT4577_63959C.1.pep
  unsure (1)..(183): unsure at all Xaa locations
YRIATQAIAAXGILTFINPXFLQQSSAXLLQQLPLVHXLAQNIRAQQLQQLVLANLAAYSQQQQFLPFNQLAALNSASYLQQQQLPFSQLPVAYPQQFLPFNQLAALNSPAYLQQQQLLPFSQLAGVSPATFLTQPQLLPFYQHAWPKAWTLLQLQQLVAFNQLGLTKLTMVXQQPIIGGGLF

SEQ ID NO: 5955 - protein, 216 aa, Zea mays
  UNSURE (1)..(216): unsure at all Xaa locations
  Clone ID: PAT_MRT4577_63961C.1.pep
  unsure (1)..(216): unsure at all Xaa locations
YVRPYFPKCSQAPIAHVLPMYLXPAVSSVCENPNLQPYRIQQEITAGILTISPLFLQQSSALXHQLPXAHLLAQIIRAQQLQQLVLPNLAAYCKQQQFLPFNQLTALNFGSYMQQQQLPCSQLPAGYPQQFLSFNQLAALNSSGYLQEQQLLPFNQLTGGNPGYFLIQPQVVAVXQHAGPKAGTLLQLQQLVAFNPLGLTKPTRVXQQPIIGGGLF

SEQ ID NO: 5956 - protein, 200 aa, Zea mays
  Clone ID: PAT_MRT4577_63967C.1.pep
MAAKIFCFLMLLGLSASAATATIFPQCSQAPIASFLPPYLSPAVSSVCENPILQPYRIQQAIAAGILPLSPLFLQQPSALLQQLPLVHLLAQNIKAQQLQQLVLGNLAAYSQQQQFLPFNQLAALNSAAYLQQQLPFSQLAAAYPQQFLPFNQLAALNSAAYLQQQQLPPFSQLADVSPIGLLDTAQLLPFYLHAAPKRC

SEQ ID NO: 5957 - protein, 230 aa, Zea mays
  UNSURE (1)..(230): unsure at all Xaa locations
  Clone ID: PAT_MRT4577_63970C.1.pep
  unsure (1)..(230): unsure at all Xaa locations
MADKNIRLIMIVGVSGRAVTATIFSERXKACIGSVLQAXLXPAACLACENPILQPYRIQQAITAGILPLSPLFLQQSSALLHQLPLVHLLAQNIRAQQXLQQLVLANLAAYFQQQQFFPFNQXLAALNSAFILQQQQXLPFSQLSAAYPXAFFPFNQLTALNFPAYLQQQQLLPFSQLVGXVSPATFLIQPQLMPFYQHAAPNAGTLLQLQQLLPFNQLXALTNPAAFYQ

SEQ ID NO: 5958 - protein, 514 aa, Zea mays
  Clone ID: PAT_MRT4577_63975C.1.pep
MAGGVVVNAAGGKTYPGRMTPFVFFTCLVASSGGLIFGYDIGISGGVTSMASFLKEFFPSVYAKAAANKDTNQYCKFDSQLLTLFTSSLYLAALATSFVAASVTRVFGRKWSMFCGGVTFLAGSALNGAATDVMMLIMGRILLGVGVGFANQSVPLYLSEMAPAKLRGMLNIGFQLMTTIGILAANLINFWTAGIEGGWGWRIGLGLAGVPALIITLGALVLPDTPNSLIARGFNDDAKAVLVKIRGTDDVQDEYDDMVAASEEANAIEHPWRNILERRYRPQLTVAALIPFFQQLTGINVIMFYAPVLFLTIGFGDDASLMAAVITGLVNMFATVVSIVCVDRLGRRALFLQGGTQMFVSQIVVGTLIALQFGTAGVGEMSRSNAWLLVLFICLYVAGFAWSWGPLGWLVPSEVFALEVRSAGQSIAVCVNMLLTFIIGQAFLSMLCSLKFGLFYFFAGWMFIMTTFIALFLPETKGVPIEEMNLVWSRHWFWGKYVNVDTQHGGASPRSNGV

SEQ ID NO: 5959 - protein, 239 aa, Zea mays
  UNSURE (1)..(239): unsure at all Xaa locations
  Clone ID: PAT_MRT4577_63994C.1.pep
  unsure (1)..(239): unsure at all Xaa locations
MAAKIFCLLMLLGLSASAVTGTIFPKCSQAPIAILLSPHLSPAVSSVWGIPILQPYRIQQAIAAGILPLSPLFLQQSSALLQQLPLXVHXLGQNIRAQQLQQLVLANLAAYSQQQQFLPFNQLGSLNLASYLQQQQLPFSQLPAXYPQQFFSFNQLAALNSSAYXQRQQLLPFSQLAGVSPATFLTQPQLXLPVYQXVAPNAXGALLQLRQLLAFDQLALANPAGVYQQPLIGGGLFWM

SEQ ID NO: 5960 - protein, 233 aa, Zea mays
  Clone ID: PAT_MRT4577_63998C.1.pep
MAAKIFCFLMLLGLSASAATATIFPQCSQAPIASLLPPYLSSAVSSVCENPILQPYRIQQAIAAGILPLSPLFLQQPSSLLQQLPLVHLLAQNIRAQQLQQLVLANLAAYSQQQQFLPFNQLAALNSAAYLQQQLPFSQLAAAYPQQLLPFNQLAALNSAAYLQQQQLPPFSQLADVSPAAFLTQQQLLSFYSHAAPNAGTLLQLQQLLPFNQLALTNPAAFYQQPIIGGALF

SEQ ID NO: 5961 - protein, 240 aa, Zea mays
  Clone ID: PAT_MRT4577_63999C.1.pep
STIIVPLITVKIFPFLRLLGISASAPTSTIFPQCSQAPIASFLPPYLSPPVSTVCENPILQPYTIQHAISASILPLSPLFLQQPSALLQHLPYVHLLAQNIKAQQLQQLVLGNLAAYSQQQQFLPFNQLAALNSAAYLQQQLPFSQLAAAYPQQFLPFNQLAALNSAAYLQQQQLPPFSQLADVSPIAFLTQQQLLPFYLHAAPNAGTLLQLQQLLPFNQLALTNPTAFYQQPIIGGALF

SEQ ID NO: 5962 - protein, 243 aa, Zea mays
  UNSURE (1)..(243): unsure at all Xaa locations
  Clone ID: PAT_MRT4577_64005C.1.pep
  unsure (1)..(243): unsure at all Xaa locations
MAQPKYLWPGLMLLGSCLASALLRATPFSRXARKTPIASLLPPYPLHQLVSXSVCENPILQPYRIQXQAIAAGILPLSPLFLQQSSALLQQLPLVHLLAQNIRAQQLQQLVLANLAAYSQQQQFLPFNQLGSLNSASYLQQQQLPFSQLPAAYPQQFLPFNQLAALNSPAYLQQQQLPPFRQLADVSPIAFLTQXQLLPFYLHAEPNAGTLLQLKQWCGFKQLAVTNPTGVYQQPIXGGALLL

SEQ ID NO: 5963 - protein, 234 aa, Zea mays
  Clone ID: PAT_MRT4577_64024C.1.pep
MAAKIFCLLMLLGLSASAATATIFPQCSQAPIASLLPPYLSPTVSSVCENPILQPYRIQQAIAAGILPLSPLFLQQSSALLQQLPLVHLLAQNIRAQQLQQLVLANLAAYSQQQQFLPFNQLAALNSASYLQQQQLPFSQLSAAYPQQFLPFNQLTALNSPAYLQQQQLLPFSQLAGVSPATFLTQPQLLPFYQHAAPNAGTLLQLQQLLPFNQLALTNPAAFYQQPIIGGALF

SEQ ID NO: 5964 - protein, 234 aa, Zea mays
  Clone ID: PAT_MRT4577_64025C.1.pep
MAAKIFCLLMLLGLSASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLAALNSASYLQQQQLPFSQLSAAYPQQFLPFNQLTALNSPAYLQQQQLLPFSQLAGVSPATFLTQPQLLPFYQHAAPNAGTLLQLQQLLPFNQLALTNPTAFYQQPIIGGALF

SEQ ID NO: 5965 - protein, 226 aa, Zea mays
  Clone ID: PAT_MRT4577_64028C.1.pep
ELMLLGLSASVATATIFPQCSQAPIASLLSPYLSPAVSSVCENPIVQPYRIQQAIATGILPLSPLFLQQPSALLQELPLVHLVAQNIRAQQLQQLVLANLAAYSQQHQFLPFNQLAALNSAAYLQQQLPFSQLAAAYPQQFLPFNQLAALNSAAYLQQQQLLPFSQLADVSPAAFLTQQQLLPFYLHAMPNAGTLLQLQQLLPFNQLALTNPAVFYQQPIIGGALF

SEQ ID NO: 5966 - protein, 257 aa, Zea mays
  Clone ID: PAT_MRT4577_64032C.1.pep
PGRESHILFRPTSNIESTIVYQQCAAKIFCLLMLLGISASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLAALNSASYLQQQQLPFSQLPVAYPQQFLPFNQLAALNSPAYLQQQQLLPFSQLAGVSPATFLTQPQLLPFYQHAAPNAGTLLQLQQLLPFNQLALTNLAVFYQQPIIGGALF

SEQ ID NO: 5967 - protein, 234 aa, Zea mays
  Clone ID: PAT_MRT4577_64035C.1.pep
MAAKIFCLLMLLGLSASAATATIFPQCSQAPIASLLPPYLSPAVSSVCENPILQPYRIQQAITAGILPLSPLFLQQSSALLHQLPLVHLLAQNIRAQQLQQLVLANLAAYSQQQQFLPFNQLAALNSASYLQQQQLPFSQLPAAYPQQFLPFNQLAALNSPAYLQQQQLLPFSQLAGVSPATFLIQPQLLPFYQHAAPNAGTLLQLQQLLPFNQLALTNPAAFYQQPIIGGALF

SEQ ID NO: 5968 - protein, 147 aa, Zea mays
  UNSURE (1)..(147): unsure at all Xaa locations
  Clone ID: PAT_MRT4577_64087C.1.pep
  unsure (1)..(147): unsure at all Xaa locations
PRVRLAGFNKDDKQLDADIHRKYIYGGHVANYMKNLAEXEPDKYQSHFREYIKKGIEADDMEALFKKVHAAIRADPSVDKXTKQPPKELKMLKLQKLTYEXQRKARLIERLXPINSSDGAYDDDEDDESGLDLSKKCYLMRRSLFEL

SEQ ID NO: 5969 - protein, 119 aa, Zea mays
  Clone ID: PAT_MRT4577_64111C.1.pep
MAAKIFCVLVLRGLSATAATVTILPQCSQASIAYLLPPYLSSSVSSVCENPILQPYRIQHAISSFIIPLSPLILQQPSSLLQHLPLMHLMAQNIKTQQLQQLVLSNLTAYSHNNQIIQL

SEQ ID NO: 5970 - protein, 40 aa, Zea mays
  Clone ID: PAT_MRT4577_64349C.1.pep
RGGLACPAPVTKSSSGQGSLGLCGRAMAAADVEHRWLVGR

SEQ ID NO: 5971 - protein, 67 aa, Zea mays
  Clone ID: PAT_MRT4577_64409C.1.pep
KKLSVETTVNQDPLVTKGASLVPLLGIDVWEHAYYLQYKNVRPDYLNNIWKVMNWKYAGEVYENVLA

SEQ ID NO: 5972 - protein, 70 aa, Zea mays
  Clone ID: PAT_MRT4577_64410C.1.pep
IHYFGPCTMIIHKLMHTHTYPYDRLSSHAYSCITRAHTYVRAHNTAGARYHSHTHAYALGDVRQYGRYQK

SEQ ID NO: 5973 - protein, 51 aa, Zea mays
  Clone ID: PAT_MRT4577_64472C.1.pep
GRHINSDQKLEQQVTRVSQKLRPPNGFGIPYFKRQGGIRPPDFTPKIRGNL

SEQ ID NO: 5974 - protein, 123 aa, Zea mays
  Clone ID: PAT_MRT4577_64503C.1.pep
TASGAIPWRWRCSQPNQGTRWAAAASTNQIQGGRDGGRRLASVPNGRRRVTRKTDCLGIEDEEVERRCGVAVGWSGVTDHRTSRGCMGWDASAGRKHPDLPASRVTFRSSRRLHRRPPRPAVV

SEQ ID NO: 5975 - protein, 75 aa, Zea mays
  UNSURE (1)..(75): unsure at all Xaa locations
  Clone ID: PAT_MRT4577_64568C.1.pep
  unsure (1)..(75): unsure at all Xaa locations
HVNRPEDQLINISEDGFVSLFTSDGDAKDGLRLPTYXTLVAQNKERFXNGKDLVVTVQFAKGEEQIWALKDFGPK

SEQ ID NO: 5976 - protein, 771 aa, Zea mays
  Clone ID: PAT_MRT4577_64622C.1.pep
MASSAFLPELGTQVVVPVAAVVGIAFAVLQWVLVSKVKLSPEPRRGDGSAGKSGAGAGASEYLIEEEEGLNEHNVVVKCAEIQNAISEGATSFLFTEYKYVGLFMGIFAVLIFLFLGSVESFSTKSQPCHYSKGKTCKPALANAIFSTIAFVLGAVTSLVSGFLGMKIATYANARTTLEARKGVGKAFITAFRSGAVMGFLLAASGLFVLYIAINLFGIYYGDDWEGLYEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTAVMTVGIALVSWLGLPYTFTIFNFGVQKTVYNWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAEISTVDVLTPKVFIGLIVGAMLPYWFSAMTMKSVGSAALKMVEEVRRQFNTIPGLMEGITKPDYATCVKISTDASIKEMIPPGALVMLTPLIVGIFFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGILFKWL

SEQ ID NO: 5977 - protein, 127 aa, Zea mays
  UNSURE (1)..(127): unsure at all Xaa locations
  Clone ID: PAT_MRT4577_64676C.1.pep
  unsure (1)..(127): unsure at all Xaa locations
MGRQPXCDKEGVKRGPWTAXEDKKLISFILTHGRCCWRAVPKLAGLLRCGKSCRLRWTNYLRPDLKRGLLSTAEEQLVIDLHAKLGNRWSQIAAKLPXRTDNEIKNHWNTHIKKKLVKMGVDPATHE

SEQ ID NO: 5978 - protein, 887 aa, Zea mays
  Clone ID: PAT_MRT4577_64700C.1.pep
MLELLARRERAAACRPGDGPGTAPSGAFPGRRTTDSELVRTVQSLYLRINPSTSYPFVTPQASHRITTVELEQEQAVSACPRCSISIPHLMAPALSRTLGPSSVAALRPSPSCRGLLRAALAPQGRGASARCAVGVRWEAARRRRMAGVRCDAAVAEKPAGEEETAGEKYEYQAEVTRLMDLIVHSLYSHKEVFLRELVSNASDALDKLRFLSVTDPSVLADGGELEIRIKPDLEAGTITITDTGIGMTKDELKDCLGTIAQSGTSKFLKALKENKDLGADNGLIGQFGVGFYSAFLVAERVVVSTKSPKADKQYVWEAEADSSSYVIKEENDPEKMLSRGTEITLYLRDDDKYEFADPTRIQGLVKNYSQFVSFPIYTWQEKSRTVEVEEEEESKGEEATEESKSEEATEGEKQKKKKTITEKYWDWELANETKPIWMRNPKEVEKTEYNEFYKKTFNEFLDPLAYTHFTTEGEVEFRSVLYVPGMAPLSNEEIMNPKTKNIRLYVKRVFISDDFDGELFPRYLSFVKGVVDSNDLPLNVSREILQESRIVRIMRKRLVRKTFDMIQEIAEKDGKEDYNKFWESFGKFMKLGCIEDTGNHKRLAPLLRFYSSKNETDLISLDQYVENMPENQKAIYYIATDSLQSAKTAPFLEKLVQKDIEVLYLIEPIDEVAIQNLQTYKEKKFVDISKEDLELGDEDEDKEKESKQEYTLLCDWIKQQLGDKVAKVQISKRLSSSPCVLVSGKFGWSANMERLMKAQTLGDTSSLEFMRGRRIFEINPDHPIIKDLNAACKNEPESTEAKRAAELLYEAALISSGYTPDSPAELGGKIYEMMTMALGGRWGRLETEEAEVIASIDDADSSEGATTTTEVVEPSEVRTESDPWKD

SEQ ID NO: 5979 - protein, 766 aa, Zea mays
  Clone ID: PAT_MRT4577_64728C.1.pep
MGSACQAGTDGPSRKDVLGIGNAALENGHHQAEADADEWREKEEDLANNGHSAPPPGMQQVDEHKEEQRQSIHWERFLPVKTLRVLLVENDDSTRQVVSALLRKCCYEVIPAENGLHAWRYLEDLQNNIDLVLTEVFMPCLSGIGLLSKITSHKICKDIPVIMMSTNDSMSMVFKCLSKGAVDFLVKPLRKNELKNLWQHVWRRCHSSSGSESGIQTQKCAKLNTGDEYENGSDSNHDDEENDDGDDDDFSVGLNARDGSDNGSGTQSSWTKRAVEIDSPQPISPDQLVDPPDSTCAQVIHPRSEICSNKWLPTANKRNVKKQKENKDESMGRYLGIGAPRNSSAEYQSSLNDVSVNPIEKGHENHMSKCKSKKETMAEDDCTNMPSATNAETADLISSIARNTEGQQAVQAVDAPDGPSKMANGNDKNHDSHIEVTPHELGLKRSRTNGATAEIHDERNILKRSDQSAFTRYHTSVASNQGGARYGESSSPQDNSSEAMKTDSTCKMKSNSDAAPIKQGSNGSSNNDVGSSTKNVAARPSGDRERVASPLAIKSTQHASAFHTIQNQTSPANLIGEDKADEGISNTVKMSHPTEVPQGCVQHHHHVHYYLHVMTQKQPSTDRGSSDVHCGSSNVFDPPVEGHAANYSVNGGVSVGHNGCNGQNGSSAVPNIARPNIESINGTMSQNIAGGGIVSGSGSGNDMYQNRFLQREAALNKFRLKRKDRNFGKKVRYQSRKRLAEQRPRVRGQFVRQSEQEDQTAQGSER

SEQ ID NO: 5980 - protein, 750 aa, Zea mays
  Clone ID: PAT_MRT4577_64730C.1.pep
MGSACQAGTDGPSRKDVLGIGNAALENGHHQAEADADEWREKEEDLANNGHSAPPPGMQQVDEHKEEQRQSIHWERFLPVKTLRVLLVENDDSTRQVVSALLRKCCYEVIPAENGLHAWRYLEDLQNNIDLVLTEVFMPCLSGIGLLSKITSHKICKDIPVIMMSTNDSMSMVFKCLSKGAVDFLVKPLRKNELKNLWQHVWRRCHSSSGSESGIQTQKCAKLNTGDEYENGSDSNHDDEENDDGDDDDFSVGLNARDGSDNGSGTQSSWTKRAVEIDSPQPISPDQLVDPPDSTCAQVIHPRSEICSNKWLPTANKRNVKKQKENKDESMGRYLGIGAPRNSSAEYQSSLNDVSVNPIEKGHENHMSKCKSKKETMAEDDCTNMPSATNAETADLISSIARNTEGQQAVQAVDAPDGPSKMANGNDKNHDSHIEVTPHELGLKRSRTNGATAEIHDERNILKRSDQSAFTRYHTSVASNQGGARYGESSSPQDNSSEAMKTDSTCKMKSNSDAAPIKQGSNGSSNNDVGSSTKNVAARPSGDRERVASPLAIKSTQHASAFHTIQNQTSPANLIGEDKADEGISNTVKMSHPTEVPQGCVQHHHHVHYYLHVMTQKQPSTDRGSSDVHCGSSNVFDPPVEGHAANYSVNGGVSVGHNGCNGQNGSSAVPNIARPNIESINGTMSQNIAGGGIVSGSGSGNDMYQNRFLQREAALNKFRLKRKDRNFGKKVACFQLHACCSYDLKSVIVI

SEQ ID NO: 5981 - protein, 309 aa, Zea mays
  Clone ID: PAT_MRT4577_64777C.1.pep
SARPQSESSRTSCDGSRSNTSRRINLLNRSPFDPQIPLQSTFASRITNLATKVTNKVRSRVSTDDYGIEREGGSGESHCSDRGAKEEPTSSGTNTPRGNAPHGPFSTDENSPGKSTNPSSDELEGKVGLHKFLSSKAEALLNKKGISWPWKVRENDGPDERNHVILLHGDQENVMNHQKVSDSSIAPDSQGAEHNLPSKNEASGSWSSYNNNSTSSASSTGSTNSSALYKVDHEADCLDYEILWEDLVIGEQIGQGSCGTVYHALWYGSDVAVKVFSRQEYSEDVILSFRQEVSLMKKLRHSNILLFMG

SEQ ID NO: 5982 - protein, 316 aa, Zea mays
  Clone ID: PAT_MRT4577_64810C.1.pep
MSFLFKSSNGGTTEKIPSPEEQREKINELRKELGEHSSAAIKDFLSDASLARFLRARNWNVQKASKMMKAAVKWRLAFKPENICWDDIAEEAETGKIYRADYKDKHGRTVLVLRPGLENTTSAIGQIKYLVYSLEKAIMNLTEDQEKMVWLTDFQCWTLGSTPLKVTRETVNVLQDCYPERLGLAILYNPPRIFESFWKIVKPFLDHETRKKVKFVYSNDKESQKIMAEVFDMEELDSAFGGKNPATFEYNSYAEQMQDDDKKMGSSHGSANSLLGSAGKEANGADSDASSEASFYSGTDSPTHENGEHSIAKKNG

SEQ ID NO: 5983 - protein, 125 aa, Zea mays
  Clone ID: PAT_MRT4577_64914C.1.pep
RSPMASCSSAPSSSPAPPRPWPADPSHPLPVSWSSSPRRLQRASRRWFPAPHRRGHPRAMPTTWPSLQTVAAASRAAAPIYRRDLCSSVPTWSPSRLRGSPRHPWSLWTSRPRAVVASNLNPLSR

SEQ ID NO: 5984 - protein, 58 aa, Zea mays
  Clone ID: PAT_MRT4577_64958C.1.pep
GLSWYVTFVVTHLCFECQGPFVQVVSLVFILGPSKPVHQPAWTVDPWMLLLLSGFVLS

SEQ ID NO: 5985 - protein, 97 aa, Zea mays
  UNSURE (1)..(97): unsure at all Xaa locations
  Clone ID: PAT_MRT4577_65052C.1.pep
  unsure (1)..(97): unsure at all Xaa locations
GSPSSVRGDGRDAAGDVEYRCFIGGLAWATDDHSLHNAFSTYGEVLESKIILDRETQMSRCFWFVTFYTEDAMRNAIEGMNGKELDXRIITVNEVQS

SEQ ID NO: 5986 - protein, 103 aa, Zea mays
  UNSURE (1)..(103): unsure at all Xaa locations
  Clone ID: PAT_MRT4577_65128C.1.pep
  unsure (1)..(103): unsure at all Xaa locations
QHRKHTCVLTLAAKIWRCLMLLGRAASVATATIFPQCSQAPKASLLPPYLSPAVSSMCENPIVQPYTIQQAIATGILPLSPLVLQHLVALLQQLPWVXHLVAQ

SEQ ID NO: 5987 - protein, 50 aa, Zea mays
  Clone ID: PAT_MRT4577_65136C.1.pep
KRTTDDFFWLHLHKYGSFVPLCFTSYICALCHVCESSTFSLFLSRIGPSV

SEQ ID NO: 5988 - protein, 136 aa, Zea mays
  Clone ID: PAT_MRT4577_65217C.1.pep
PEEAIRNALEGINGKELDGRNIPVKEGQFPGGRGGGGGGYGGGRGGGGYGGGGPRDGGGGYGGGGGGYGGGGGYGGGGGGYGGGNRGGGFGNSPGNWRKLTVGPARPSYPVCSRDVFPSPKGLSSFVSFGVAPLGF

SEQ ID NO: 5989 - protein, 79 aa, Zea mays
  Clone ID: PAT_MRT4577_6533C.1.pep
YIKFKSTKLCVKHMINELARLIRNRSQEFLPFTTTRRSRHRDETRKTDSIRSTRPVHRLRHLSGRRAEKAADRGGNSLA

SEQ ID NO: 5990 - protein, 434 aa, Zea mays
  Clone ID: PAT_MRT4577_65496C.1.pep
MGQKDSKPSNGYGYSSDYGGTSSGYNLRNTGSTSSSYGARYVPSSENNVQPETHARLQRKYSRIGDDYRSLSQVTEALAQAGLESSNLIVGIDFTKSNEWTGKISFNRRCLHDIGNTPNPYEQAISIIGRTLSVFDEDNLIPCFGFGDASTHDQEVFSFYPENRPCNGFEEALDRYREIVPTLRLAGPTSFAPMIETAIGIVDSTGGQYHVLLIIADGQVTRSVDTQSGQLSPQERDTIDAIVRASQFPLSIVLVGVGDGPWDMMHQFDDNIPARSFDNFQFVNFTEIMSKSIAADRKEAEFALSALMEIPTHRRQRITPRIALPPPTRTAYSRTTSFSQQSGVYSRSSSFDQQTSVYQQRSESLKQQQPAAPKGPDTYVSESALEDRILCPICMYKSKDLAFGCGHQTCYECGRDLERCPLCQQHITTRIRLY

SEQ ID NO: 5991 - protein, 448 aa, Zea mays
  UNSURE (1)..(448): unsure at all Xaa locations
  Clone ID: PAT_MRT4577_65499C.1.pep
  unsure (1)..(448): unsure at all Xaa locations
MGQKDSKPSHGYGYSSYDYGSASSGYTSRNTGNSSSSYSVRYAPSSENSVQPETHARLQRKYSKIGDDYRSLSQVTEALAQAGLESSNLIVGIDFTKSNEWTGKISFNRRCLHDIGXTPNPYEQAISIIGRTLSAFDEDNLIPCFGFGDASTHDQEVFSFYPEAHQXHRFEEALDRYREIVPTLRLAGPTSFAPMIETAIGIVDSTGGQYHVLLIIADGQVTRSVDTQSGQLSPQERDTIDAIVRASQFPLSIVLVGVGDGPWDMMHQFDDNIPARSFDNFQFVNFTEIMSKSIAADRKEAEFALSALMEIPTQYKATIDLQLLGRRQRITPRIALPPPTRTAYSRSSSFSQQSGVYSRSSSFDQQTSGASQQRSESLKQQKKPAAPKRPDTYASERALEDRILCPICMYKSKDLAFGCGHQTCYECGRNLERCPLCQQNITTRIRLY

SEQ ID NO: 5992 - protein, 174 aa, Zea mays
  Clone ID: PAT_MRT4577_65500C.1.pep
MGQKDSKPSHGYGYSSYDYGSASSGYTSRNTGNSSSSYSVRYAPSSENSVQPETHARLQRKYSKIGDDYRSLSQVTEALAQAGLESSNLIVGIDFTKSNEWTGKISFNRRCLHDIGNTPNPYEQAISIIGRTLSAFDEDNLIPCFGFGDASTHDQEVFSFYPENRPCNGFEEAL

SEQ ID NO: 5993 - protein, 448 aa, Zea mays
  Clone ID: PAT_MRT4577_65503C.1.pep
MGQKDSKPSHGYGYSSYDYGSASSGYTSRNTGNSSSSYSVRYAPSSENSVQPETHARLQRKYSKIGDDYRSLSQVTEALAQAGLESSNLIVGIDFTKSNEWTGKISFNRRCLHDIGNTPNPYEQAISIIGRTLSAFDEDNLIPCFGFGDASTHDQEVFSFYPENRPCNGFEEALDRYREIVPTLRLAGPTSFAPMIETAIGIVDSTGGQYHVLLIIADGQVTRSVDTQSGQLSPQERATIDAIVRASQFPLSIVLVGVGDGPWDMMHQFDDNIPARSFDNFQFVNFTEIMSKSIAADRKEAEFALSALMEIPTQYKATIDLQLLGRRQRITPRIALPPPTRTAYSRSSSFSQQSGVYSRSSSFDQQTSGASQQRSESLKQQKKPAATKRPDTYASERALEDRILCPICMYKSKDLAFGCGHQTCYECGRNLERCPLCQQNITTRIRLY

SEQ ID NO: 5994 - protein, 445 aa, Zea mays
  Clone ID: PAT_MRT4577_65505C.1.pep
MGQKDSKPSNGYGYSSDYGGTSSGYNLRNTGSTSSSYGARYVPSSENNVQPETHARLQRKYSRIGDDYRSLSQVTEALAQAGLESSNLIVGIDFTKSNEWTGKISFNRRCLHDIGNTPNPYEQAISIIGRTLSVFDEDNLIPCFGFGDASTHDQEVFSFYPENRPCNGFEEALDRYREIVPTLRLAGPTSFAPMIETAIGIVDSTGGQYHVLLIIADGQVTRSVDTQSGQLSPQERDTIDAIVRASQFPLSIVLVGVGDGPWDMMHQFDDNIPARSFDNFQFVNFTEIMSKSIAADRKEAEFALSALMEIPTQYKATLDLQLLGRRQRITPRIALPPPTRTAYSRTTSFSQQSGVYSRSSSFDQQTSVYQQRSESLKQQQPAAPKGPDTCASESALEDRILCPICMYKSKDLAFGCGHQTCYECGRDLERCPLCQQHITTRIRLY

SEQ ID NO: 5995 - protein, 41 aa, Zea mays
  Clone ID: PAT_MRT4577_65624C.1.pep
TRVALGSSIIDQTLYPIVLHTLAQHFIRNSADKSHLMSQSL

SEQ ID NO: 5996 - protein, 443 aa, Zea mays
  Clone ID: PAT_MRT4577_65639C.1.pep
MPPTGTPHFWLSQQRIGHIPRACTPTFGTFPSGPLSSARSKSGPAMDGGGQPPDTEMTDAGAGGGGQPPQQPLPPVGGGVMLDNIQATLSHGGRFIQYNIFGNVFEVTAKYKPPVLPIGKGAYGIVCSALNSETAEQVAIKKIANAFDNKIDAKRTLREIKLLRHMDHENIVAIRDIIPPAQRAAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEGDLDFVNENARRYIRQLPRHPRQSLPEKFPHVQPLAIDLVEKMLTFDPRQRITVEGALAHPYLASLHDISDEPGCSMPFSFDFEQHALSEEQMKDLIYQEALAFNPDYQ

SEQ ID NO: 5997 - protein, 76 aa, Zea mays
  UNSURE (1)..(76): unsure at all Xaa locations
  Clone ID: PAT_MRT4577_65653C.1.pep
  unsure (1)..(76): unsure at all Xaa locations
MSYNCQSSCCCGSSCKCGKNYPNLKETSTAAQATTILRGGPQKKASPDLFXAAEDSSEAAHGCSCGGNCKCDPCTC

SEQ ID NO: 5998 - protein, 83 aa, Zea mays
  UNSURE (1)..(83): unsure at all Xaa locations
  Clone ID: PAT_MRT4577_6566C.1.pep
  unsure (1)..(83): unsure at all Xaa locations
MMFWLSSNSVSCFFCGSSCNCGEMYPHLGAKSGGGPQASTAPIVLGXAPETKNAPQFXAGGESGEAPHGCSCCDSCKRSPCNC

SEQ ID NO: 5999 - protein, 75 aa, Zea mays
  Clone ID: PAT_MRT4577_65816C.1.pep
GVVGYEVCYTGLSVFFWRHMHFYIRSGGEGFLMVIALTKGEGRNCFLFFKKNGVIGWGKAIWVSKKSFVLLTPLI

SEQ ID NO: 6000 - protein, 359 aa, Zea mays
  UNSURE (1)..(359): unsure at all Xaa locations
  Clone ID: PAT_MRT4577_6582C.1.pep
  unsure (1)..(359): unsure at all Xaa locations
ASAQVGHPSRFSARSAAEHGAGQHRVHVLLRQHGGRRHRRRHLVPAPSPLPQILLHRRYCRRQRGRRLRPRRCRRAGSGSGFAGXSPATGVHELLECPVCTNSMYPPIHQCQNGHTLCSTCKTRVHNRCPTCRQELGDIRCLALEKVAESLELPCKYYSLGCSEVFPYYSKLKHESQCNFRPYNCPYAGSECSVVGDISFLVAHLRDDHKVDMHSGCTFNHRYVKSNPREVENATWMLTVFHCFGQYFCLHFEAFQLGMAPVYMAFLRFMGDENDARNYSYSLEVGANGRKMIWEGTPRSIRDSHRKVRDSHDGLIIQRNMALFFSGGERKELKLRVTGRIWKEQQNPDSGACIPNLFS

SEQ ID NO: 6001 - protein, 118 aa, Zea mays
  UNSURE (1)..(118): unsure at all Xaa locations
  Clone ID: PAT_MRT4577_65893C.1.pep
  unsure (1)..(118): unsure at all Xaa locations
ASRKENPTAVGVACSDGCGAILPDLATQVLIPVAAAVGIAFAGGHWVLGSKVRGTPERRSDRGPVNSAPTHYLMAEEEGLNDHIVAGQCPQIQTALSEGATXSFLFTDHKYAGLFMGI

SEQ ID NO: 6002 - protein, 120 aa, Zea mays
  UNSURE (1)..(120): unsure at all Xaa locations
  Clone ID: PAT_MRT4577_65914C.1.pep
  unsure (1)..(120): unsure at all Xaa locations
TILKPYRFQHAIAAGILPLXPLFLQQPSGVLQKLPLVHTMVHSIKGQHLQQLVLGNLAGYCKQQXFIPFNQLGALNSGAYLQQQLPCKXIAAAYHQPFLPFNPLAALHSAAYLQQHQLPP

SEQ ID NO: 6003 - protein, 114 aa, Zea mays
  Clone ID: PAT_MRT4577_65929C.1.pep
GAPGFGFMDERIEMAASDVEYRCFAGGLAWATDDHSFHNAFSTYGEVLEYKIILDRETQRTRSFGFITFFTEEAMRNAIDDMNGKELDCRNITDNEAQSRSNRRGGGRRYYQGR

SEQ ID NO: 6004 - protein, 33 aa, Zea mays
  Clone ID: PAT_MRT4577_65932C.1.pep
GYGAGAGYGGGAAGYGGGNRGGGYGNSGGNWRT

SEQ ID NO: 6005 - protein, 63 aa, Zea mays
  UNSURE (1)..(63): unsure at all Xaa locations
  Clone ID: PAT_MRT4577_65936C.1.pep
  unsure (1)..(63): unsure at all Xaa locations
AAGGYGGAREADGYGGAGLRXADDGYVGXDGYGGXDGYGGGDAGYGGGNRAGGYGNSDGNWRS

SEQ ID NO: 6006 - protein, 127 aa, Zea mays
  Clone ID: PAT_MRT4577_65937C.1.pep
PVMPPAATTLARQPQVPEQHPVVVATTRRMATVAEARATPMGTGGTERWGPPGQVILFAAVLFALVHRVYLRSCRVCCSPSVFFIARSLCVSCYCCVHPRLHQTHASNSMVCGSMDAVTPLTLYCEL

SEQ ID NO: 6007 - protein, 137 aa, Zea mays
  Clone ID: PAT_MRT4577_65975C.1.pep
SNYHHRKHIIVPTLAPKIFGLLMLLGLYASPDTATIFPQCSHAPITTLTTPYLSPTLYSVCENPLLQHYTIQQAICTGIIPLSPLLLQHSSHLLQQLPLLHTFAQNITAQHLQQLVLANLAVYSQQQQVLPFNQLPA

SEQ ID NO: 6008 - protein, 77 aa, Zea mays
  UNSURE (1)..(77): unsure at all Xaa locations
  Clone ID: PAT_MRT4577_659C.1.pep
  unsure (1)..(77): unsure at all Xaa locations
MSCNCGSSCGCGSSCKCGKKYPDLQETSTAAQATVVLGVAPAKKAAPEFVEAXASESGEAXHACGCRSRCXCDPCNC

SEQ ID NO: 6009 - protein, 129 aa, Zea mays
  Clone ID: PAT_MRT4577_66050C.1.pep
MEGDSFSGGAMANGGGGGGGGSGQVVDGKLIHTFHRSFVQVQSLLDQNRMLISEINQNHESRAPDNLTRNVGLIRELNNNIRRVVGLYADLSASFARTMDHASSEGDSSGTGNNGRAGAGAGHKRVRPA

SEQ ID NO: 6010 - protein, 123 aa, Zea mays
  Clone ID: PAT_MRT4577_66051C.1.pep
MEGDSFSGGAMANGGGGGQVVDGKLIHTFHRSFVQVQSLLDQNRMLISEINQNHESRAPDNLTRNVGLIRELNNNIRRVVGLYADLSASFARTMDHASSEGDSSGTGTGRAGAGAGHKRVRPA

SEQ ID NO: 6011 - protein, 81 aa, Zea mays
  UNSURE (1)..(81): unsure at all Xaa locations
  Clone ID: PAT_MRT4577_66070C.1.pep
  unsure (1)..(81): unsure at all Xaa locations
MGDKILCLLMLPGLSGCAGTATIFPKCSQAPIASILTSYXLSPAASSACENPIFQPYRIQQAITAGILPLSRLFLPQSSAL

SEQ ID NO: 6012 - protein, 152 aa, Zea mays
  Clone ID: PAT_MRT4577_66146C.1.pep
MSLVRRSNVFDPFSMDLWDPFDTMFRSIVPSAVSTNSETAAFASARIDWKETPEAHVFKADLPGVKKEEVKVEVEDGNVLVISGQRSREKEDKDDKWHRVERSSGQFVRRFRLPENAKVDQVKAGLENGVLTVTVPKAEEKKPEVKAIEISG

SEQ ID NO: 6013 - protein, 152 aa, Zea mays
  Clone ID: PAT_MRT4577_66149C.1.pep
MSLVRRSNVFDPFSMDLWDPFDTMFRSIVPSATSTNSETAAFASARIDWKETPEAHVFKADLPGVKKEEVKVEVEDGNVLVISGQRSREKEDKDDKWHRVERSSGQFIRRFRLPENAKVDQVKAGLENGVLTVTVPKAEEKKPEVKAIEISG

SEQ ID NO: 6014 - protein, 152 aa, Zea mays
  Clone ID: PAT_MRT4577_66150C.1.pep
MSLVRRSNVFDPFSMDLWDPFDTMFRSIVPSATSTNSETAAFASARIDWKETPEAHVFKADLPGVKKEEVKVEVEDGNVLVISGQRSREKEDKDDKWHRVERSSGQFVRRFRLPENAKVDQVKAGLENGVLTVTVPKAEEKKPEVKAIEISG

SEQ ID NO: 6015 - protein, 119 aa, Zea mays
  Clone ID: PAT_MRT4577_66168C.1.pep
GHTFIKKAPKPKGRGRFFEGFSFDNLGGAIFPWIRLHAYIHIYPHDRKTNQGNSSLISGALGHKHKQVGAKNYAMGPSRGTSKFFDWFPNFDQYTHSDAKPNKNGRVKTWAGKKARLLF

SEQ ID NO: 6016 - protein, 133 aa, Zea mays
  UNSURE (1)..(133): unsure at all Xaa locations
  Clone ID: PAT_MRT4577_66422C.1.pep
  unsure (1)..(133): unsure at all Xaa locations
VEDGNETTNTTRRVAHRFACDALTVEFFRSXISAQERPAHRHAPKRVKSTLRLDRXDNPRRKWLNXDVLILNTGHWRTPTKSFDTGRYFQAARHLKLGTCIDAGFRMALETWASRVQKKVDLNRTHVLFHTYE

SEQ ID NO: 6017 - protein, 48 aa, Zea mays
  Clone ID: PAT_MRT4577_66479C.1.pep
EHINFFIWFLFWQKILDALFLHPASREVTGFLEKNPGKNNYNTRPLHF

SEQ ID NO: 6018 - protein, 909 aa, Zea mays
  Clone ID: PAT_MRT4577_66490C.1.pep
MFTPQGKGWTGWSTPTPANQRSGGGAPAASAPLGKGKGRVAELEQELHEYQYNMGLLLIEKKEWAAKFEEISEVLTQKEEILKREQAAHLNAISEYERREENMRKALGVEKQCVADLEKALRDIRAEIAEVKFTSEKKITDAQSLEASLEEKSLEIEGKLHAADAKLAEANRKKSQADRDLEEAEARQRRLEKEKLYFETERKAREKQLKEQEESLQEWEKKLKESQNRLNELQRSINEREERANKNDQLFKIKQDELEEARRTVEAAKVTLKVKEDDINKRLNELHLQEKDADSKRSALEEQGKKLDEREAKVTNREKEGLQKLLEDHQVELESKRRDFELELERERKSFDQNMTQKQADLLKREKDVKSLEAKLSKSEQALNDKKKSMENLQNDLDAKSKALKSWDESLKNDEKRLLKEKQQMDHEREQLETYKLELEKIKSALEAEKEKISEEQNNLKLTAQERQEHSLLIAKLKKEIEEYRMRSNSLSEEMEDLRKQRQKFEEEWEQLDEKRALLVEEDKRLNIERMNLERWRDNEEKRLNDMKLKMDEEYKQQLESLERKEKALSDDMKHKQMENDEFLKGERADVQRKLQLKRHELEMEMEQKQATKEKELEEKENELNKKIDFVENKLRHAIELNESKIEKLLLEKREVQMERELLLEERKKTETDKADIRRDIESLHSLSKSLKERREAYNRDRSRLIELFEKYKACKNCGISIFEGLDSLLLKDSAEIEHPSLAVEGDDHALTTDTSGPDTGTLVNSGGRFSLLQKCSRLFKFSPRKKGEQSSEQPSERNISFGARLEEATQSDGDYVPTPVYEIAHDSFNAEDELPSDGETRENEESERHDIADNAQMESSVGVADNSIDILGTKSFDGANDMAVEATIVSVDQNGEDSVVPAEAGVEP

SEQ ID NO: 6019 - protein, 380 aa, Zea mays
  Clone ID: PAT_MRT4577_66518C.1.pep
MASVAELKEKHAAATASVNSLRERLRQRRETLLDTDVARYSKSQGRVPVSFNPTDLVCCRTLQGHSGKVYSLDWTPEKNWIVSASQDGRLIVWNALTSQKTHAIKLHCPWVMACAFAPNGQSVACGGLDSACSIFNLNSQADRDGNMPVSRILTGHKGYVSSCQYVPDQETRLITSSGDQTCVLWDVTTGQRISIFGGEFPSGHTADVQSVSINSSNTNMFVSGSCDTTVRLWDIRIASRAVRTYHGHEDDVNSVKFFPDGHRFGTGSDDGTCRLFDMRTGHQLQVYSREPDRNSNELPTVTSIAFSISGRLLFAGYSNGDCYVWDTLLAEVVLNLGNLQNSHDGRISCLGMSSDGSALCTGSWDKNLKIWAFSGHRKIV

SEQ ID NO: 6020 - protein, 331 aa, Zea mays
  Clone ID: PAT_MRT4577_66519C.1.pep
LHIFGFCGDSWKFSTSAICVYSLDWTPEKNWIVSASQDGRLIVWNALTSQKTHAIKLHCPWVMACAFAPNGQSVACGGLDSACSIFNLNSQADRDGNMPVSRILTGHKGYVSSCQYVPDQETRLITSSGDQTCVLWDVTTGQRISIFGGEFPSGHTADVQSVSINSSNTNMFVSGSCDTTVRLWDIRIASRAVRTYHGHEDDVNSVKFFPDGHRFGTGSDDGTCRLFDMRTGHQLQVYSREPDRNSNELPTVTSIAFSISGRLLFAGYSNGDCYVWDTLLAEVVLNLGNLQNSHDGRISCLGMSSDGSALCTGSWDKNLKIWAFSGHRKIV

SEQ ID NO: 6021 - protein, 75 aa, Zea mays
  UNSURE (1)..(75): unsure at all Xaa locations
  Clone ID: PAT_MRT4577_665C.1.pep
  unsure (1)..(75): unsure at all Xaa locations
ACNCGSSCGCGSSCKCGKKYPDMENTSTSAQATVVLGVAPXKKSAPEFVEAAAESGEAAHGCRYGGNCKCDPCNC

SEQ ID NO: 6022 - protein, 533 aa, Zea mays
  Clone ID: PAT_MRT4577_6674C.1.pep
MAGGGAAPPPKQEELQPHPVKDQLPSVSYCITSPPPWPEAVILGFQHYIVMLGTSVIIPSALVPQMGGGNEEKARVIQTLLFVAGINTLCQSFFGTRLPAVMGGSYTIVAPTISIIMAGRYSNEADPREKFLRTMRGTQGALIIASTIQIVLGFSGLWRNVVKLLSPLSAVPLVSLAGFGLYELGFPGVAKCVEIGLPEIILMLIFSQYLPHAVHAAKPVFDRFSVIFTIAIVWLYAYILTVSGAYKSARTKTQLHCRVDRSGLVGGAPWISVPYPFQWGAPTFDAGESFAMMVAAFVALVESSGAFIAVSRYASATMIPPSVLGRGIGWQGIGTLLGAFFGTANGTAVSVENAGLLALTHVGSRRVVQISAGFMIFFSVLGKFGAIFASIPLPIFAALYCILFAYIGACGLSFLQFCNLNSFRTKFIMGFSLFMGLSVPQYFNEYTSVAGYGPVHTGARWFNDMINVPFSSKPFVAVLVAFLLDNTIQVRDSGVRRDRGYHWWDKFRSFKTDSRSEEFYSLPFNLNKFFPSV

SEQ ID NO: 6023 - protein, 136 aa, Zea mays
  Clone ID: PAT_MRT4577_6675C.1.pep
VVGKYPLGGFVNKFPPGSLVMRLPDSEIGQIPPVIFGPINGGIGIIASLPPGQKIFLEKLPSPLVKYIKGVGNLSPEQWGSFHNDKKTGEGGNFLPGGLIEFFLALNRSKMEEGSKAMGVPLEELSKRVEKLTRLP

SEQ ID NO: 6024 - protein, 94 aa, Zea mays
  UNSURE (1)..(94): unsure at all Xaa locations
  Clone ID: PAT_MRT4577_66C.1.pep
  unsure (1)..(94): unsure at all Xaa locations
ALARSVTNPQVSVAFIAASFVWRGEDRKWRRLRACSWGWATPLLDISAVVGDAFLTKYDIKLNNAILAEEEHLPMYDELASXSNVEYIAGGAAQ

SEQ ID NO: 6025 - protein, 163 aa, Zea mays
  UNSURE (1)..(163): unsure at all Xaa locations
  Clone ID: PAT_MRT4577_67053C.1.pep
  unsure (1)..(163): unsure at all Xaa locations
GRRPAGHNVVLVIQVIIPSTPDKRGKXGXMFKGVLLPYIVVALCYFPVALIGYWAFXNSVQDNILITLSKPSWLIALANMMVVIHVIGSYQIYAMPVIDMIDTVLVKKLRFPSGLTLXFIAGTAYVAFTMFHMFSSFPFFCGTXLAFFGGFVFAPTXTLFLPC

SEQ ID NO: 6026 - protein, 87 aa, Zea mays
  UNSURE (1)..(87): unsure at all Xaa locations
  Clone ID: PAT_MRT4577_67111C.1.pep
  unsure (1)..(87): unsure at all Xaa locations
RFVPLTGLAAMYCRVILQQRQVLPFIQLAGVSPGTFVMQPRLVPLXQRGGPNVGTLLXVRQFVPFNLLALTNPSAFYQQPIIGGALF

SEQ ID NO: 6027 - protein, 38 aa, Zea mays
  UNSURE (1)..(38): unsure at all Xaa locations
  Clone ID: PAT_MRT4577_67166C.1.pep
  unsure (1)..(38): unsure at all Xaa locations
GPXPRSVNPIXKDMRIHVQCNLKGNMAEEIVKHAYAQS

SEQ ID NO: 6028 - protein, 83 aa, Zea mays
  Clone ID: PAT_MRT4577_67392C.1.pep
PLNAGGGYAGAAAASGAAGASGGGGGGYGGGTRGGGYGNSAGNWRNLPVGPARPSYPVRPRDVSPSPKGLSSFAPFVVAPLCF

SEQ ID NO: 6029 - protein, 573 aa, Zea mays
  UNSURE (1)..(573): unsure at all Xaa locations
  Clone ID: PAT_MRT4577_6745C.1.pep
  unsure (1)..(573): unsure at all Xaa locations
CAFRRIGLHACATGTMWTASAHIITAVIGSGVLSLGWAIAQLGWVAGPVVMLLFSLVTYYTSSLLADCYRSGDPSTGKRNYTYMDAVNANLSACPSAFVPLLPTSLHCDFARVGDPLARAYSVHPVDWNFVEXGIKVQICGFLQYANIVGVAIGYTIAASISMLXERSLSXTVMHECRTSCDLIYIWCRVGXATACSAIRRANCFHQKGHGNPCKISSTPYMIIFGVAEIFFSQIPDFDQISWLSILAAVMSFTYSSIGLGLGVVQVIGTLQAHAVTHDAFFFRSGKHQVISRQCHXTYHECDAXANRGVQGSLTGITIGVVTPMDKVWRSLQAFGDVAFAYSYSLILIEIQDTIRAPPPSESTVMKRATVVSVAVTTLFYMLCGCMGYAAFGDGAPGNLLTGFGFYEPFWLLDVANAAIVVHLVGAYQVYCQPLFAFVEKWAAQRWPDSAYITGEVEVPLPLPASRRRCCKVNLFRATWRTAFVVATTVVSMLLPFFNDVVGFLGALGFWPLTVYFPVEMYVVQKKVPRWSSRWVCLQMLSLGCLVISIAAAAGSIAGIASDLKVYRPFKSY

SEQ ID NO: 6030 - protein, 341 aa, Zea mays
  UNSURE (1)..(341): unsure at all Xaa locations
  Clone ID: PAT_MRT4577_67667C.1.pep
  unsure (1)..(341): unsure at all Xaa locations
MISLTKLLSSALHGYHSCSIRRFSWFAALGEHQFAVXLLKIRNQIGTTEELLCVLAFEPENMWQLYEPLRDKWITLPVMPSQIRNIARFGVASVAGKLYVIGGGSDRVDPLTGDHDRIFASNEVWSYDPLHRVWSQRAPMLVARAMFACCALDGKIIVAGGFTNCRKSISKAEIYDPEAGIWEPLPDLRLAHSSACTGLVIKGKMHVLHKGLSTVQILEDGGSHWAVEDFSWLQGPMAMVGGELYVLSNSCIMKQRGENFPDKMVSCASEFQSRIGFGMIGVGDNIYLVGGVIGPGPRNQCIKLLSDVDILNVTSERPTWRPGSPMTHCRGSICGCALLRI

SEQ ID NO: 6031 - protein, 342 aa, Zea mays
  Clone ID: PAT_MRT4577_67670C.1.pep
MPFSSDEYQKCLARVPFLFHPTLQLVCRSWRASVCSGELLKIRNQIGTTEELLCVLAFEPENMWQLYDPLRDKWITLPVMPSQIRNIARFGVASVAGKLYVIGGGSDRVDPLTGDHDRIFASNEVWSYDPLHRVWSQRAPMLVARAMFACCALDGKIIVAGGFTNCRKSISKAEIYDPEAGIWEPLPDLRLAHSSACTGLVIKGKMHVLHKGLSTVQILEDGGSHWAVEDFSWLQGPMAMVGGELYVLSNSCIMKQRGENFPDKMVSCASEFQSRIGFGMIGVGDNIYLVGGVIGPGPRNQCIKLLSDVDILNVTSERPTWRPGSPMTHCRGSICGCALLRI

SEQ ID NO: 6032 - protein, 65 aa, Zea mays
  Clone ID: PAT_MRT4577_67676C.1.pep
CLPWSRGFICVRVVFGRARLGFRWQGRPVPVVRAVFILGFSRPMHQTAWTADRWMLLPPSGFILS

SEQ ID NO: 6033 - protein, 221 aa, Zea mays
  Clone ID: PAT_MRT4577_67708C.1.pep
SYAYILIEIQDTIKAPPPSEVTVMKKATMVSVATTTVFYMLCGCMGYAAFGDDAPDNLLTGFGFYEPFWLLDVANAAIVVHLVGAYQVFCQPLFAFVEKRAAARWPDSRFMTRELRLGPFVLGVFRLTWRTAFVCLTTVVAMMLPFFGDVVGLLGAVSFWPLSVYFPVEMYKAQRRVRRWSTRWLCLQTLSAVCLLVSIAGAVGSTAGVINAVNLHRPFSG

SEQ ID NO: 6034 - protein, 194 aa, Zea mays
  UNSURE (1)..(194): unsure at all Xaa locations
  Clone ID: PAT_MRT4577_67784C.1.pep
  unsure (1)..(194): unsure at all Xaa locations
KAMLMSQKRLEKRFGQSPIFTASTFMTQGGIPPSTNPASLLKEAIHVISCGYEDKTEWGKEIGWIYGSVTEDILTGFKMHARGWISIYCMPPRPCFKGSAPINLSDRLNQVLRWALGSVEILFSRHCPIWYNYGGRLKLLERVAYINTIVYPLTSXPLIAYCVLPAICLLTNKFIIPEISNXLGCXFILMFASI

SEQ ID NO: 6035 - protein, 423 aa, Zea mays
  UNSURE (1)..(423): unsure at all Xaa locations
  Clone ID: PAT_MRT4577_67810C.1.pep
  unsure (1)..(423): unsure at all Xaa locations
MALAVRTPRIQPRPASVSAPTTPTSTSLAAGNALPCYGLAXRLCXPFTEATSSSRYRRDAWSYAADGSSNSASPSSAAAAAAGRRDDEIALQLPELRRLLDVLRASRGRGAEEGGGPGEVALVGTGPGDPELLTLKAVRAIEAADLVLYDRLVSNDVLDLVGEGARLLYVGKTAGYHSRTQEEIHELLLSFAEAGANVVRLKGGDPLVFGRGGEEMDFLQQQGIKVEVIPGITSASGIAAELGIPLTHRGVATSVRFLTGHSRNGGTDPLYVAGNAADPDTTLVVYMGLSTLPSLAPKLMKHGLPPDTPAVAVERGTTPQQRTVFASLKDLVDEVKSADLVSPTLIIIGKVVSLSPFWVESSEHDALKVQSSYANEAXDDNRFSWFLVTGQYLRNARSQIWEHRFDLVYTETSQEAWILNGGW

SEQ ID NO: 6036 - protein, 118 aa, Zea mays
  Clone ID: PAT_MRT4577_67817C.1.pep
QIPPANPQFLRVRAPMSGRGKGGKGLGKGGAKGPPKVFRDNIQGIPKPPIRRLARRGGVKRISGLIYEETPGVLKIFLENVIRDPVTYPEHAPPKTVPPMDVVYAPKRQGRPLYGFGG

SEQ ID NO: 6037 - protein, 99 aa, Zea mays
  UNSURE (1)..(99): unsure at all Xaa locations
  Clone ID: PAT_MRT4577_6783C.1.pep
  unsure (1)..(99): unsure at all Xaa locations
MAAKIFCLLMLLGLSASAATATILPQCSQAPIAYLLPSYLSPAVSNVCENPMLHLYRIQLVFAVCILPLSXLXFLQQSSAILQHLPMVHRLTQNIRSHQ

SEQ ID NO: 6038 - protein, 323 aa, Zea mays
  Clone ID: PAT_MRT4577_67934C.1.pep
MASAIKAASTSSRWSSSPAAVHSSPLSKRRRAVAAVAPAAPAAPAKLTAGAGGRCLPVSQTMSRLRAQGKTAFIPYITAGDPDLATTAEALRLLDACGADVIELGVPFSDPYADGPVIQASAARALASGTTPDGVLAMLKEVTPELSCPVVLFSYFNPIVRWGLADFAAAVKEAGVHGLIVPDLPYGNSCALTLRTEAIKNNLELVLLTTPSTPADRMEEITRASRGFVYLATVNGVTGPRANVNTRVQSLIQEVKQVTDIPVAVGFGISKPEHVKQIAEWGADGVIIGSAMVRQLGEAASPKEGLKRLEKYARSMKNALPCQ

SEQ ID NO: 6039 - protein, 144 aa, Zea mays
  UNSURE (1)..(144): unsure at all Xaa locations
  Clone ID: PAT_MRT4577_68005C.1.pep
  unsure (1)..(144): unsure at all Xaa locations
SCKRNFDRSALRGTAVKAPCLPFPRLTPLGEPPSPRAAHVATAVXTMVVIQGGIGPAGLSAEDLHXLDLKQQRPRWHRVVVQGPGPWYGYVMALVGQRFLLTIGGNDGKRPPADVWALDTAAKPYEWRKLEPEGEGPPPCITCV

SEQ ID NO: 6040 - protein, 63 aa, Zea mays
  Clone ID: PAT_MRT4577_68112C.1.pep
NGGGLSLDYCVYTGPQKAFFFNQAKKHLRPFLAQKWALFIAYARAFIRCNFYRAEPARWGLLD

SEQ ID NO: 6041 - protein, 768 aa, Zea mays
  Clone ID: PAT_MRT4577_6821C.1.pep
MASLGDIGLAAGLNVLTAVAFLLAFAFLRLQPINDRVYFPKWYLRGMRDNPIVSGAAVQKFVNLDARSYLKFLNWMPAALKMPQDELINHAGLDSVVYLRIYVTGLKIFVPITVLAFLVLVPVNWTNDTLGRINVVYSPIDKLSISNVPNGSKRFIAHLGMAYAITFWTCYVLLKEYEIISNMRLRFLASEKRRPDQFTVLVRSVPPDPDESISELVEHFFLVNHPDHYLQHQVVYNANKLADLVEKKKKMRNWLDYYLLKYERNSSLRPTTKTGFLGCFGSKVDAIDYYKSEIEKIGKQEAEERKNVMKDPKSVVPAAFVSFRSRWGAAVCAQTQQTSNPTLWLTEWAPEPRDVYWNNLSIPFVSLTIRRLIVAVAFFFLNFFYVIPITFVQSLANLEGIEKALPFLKPLIDLPFIKSFIQGFLPGIALKIFLIVLPTILMFMSKFEGLISQSSLERRSASKYYIFLFFNVFLGSVIAGSALEQLKTYLHTSANDIPRIIGDSIPMKATFFITYVMVDGWTGIAGEILRLKPLIFFHLKNFFLVKTEKDREEAMDPGSICFDSTEPRIQLYFLLGLVYAAVTPFLLPFILVFFGFAYVVFRHQIINVYNQQYESAAQFWPSVHGRIITALIVSQLLLLGLMSTNDFEQTTPVLLVLPVLTFGFYKYCKNRFEPAFVRNPLQEAMKKDTLERAREPNLDLKAYLANSYLHPVFKGDEGDDRYSVMDDDGWMEEEVIVPTKRHSRRTTPAQSKHEGSDSLSVLESSLQR

SEQ ID NO: 6042 - protein, 99 aa, Zea mays
  Clone ID: PAT_MRT4577_68294C.1.pep
LLPFSQLVVAYHQQFFPFNQLAALNFPVYVQQQLLPFSQLVVVSPAAFLTKQQLLRFYLHAGPKVGTFLQLQQLLPFNQHVLTNPTGFYQQPIIGGALF

SEQ ID NO: 6043 - protein, 178 aa, Zea mays
  Clone ID: PAT_MRT4577_68371C.1.pep
GDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIVQVQAKKKSSLNYYA

SEQ ID NO: 6044 - protein, 430 aa, Zea mays
  Clone ID: PAT_MRT4577_68373C.1.pep
MSSSGAPAPAAAMAVDDAEDDQLASMSTEDIIRASRLLDNEIRVLKDELQRTNLELESFKEKIKENQEKIKLNKQLPYLVGNIVEILEMNPEDEAEEDGANIDLDSQRKGKCVVLKTSTRQTIFLPVVGLVDPDKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIVQVQAKKKSSLNYYA

SEQ ID NO: 6045 - protein, 137 aa, Zea mays
  UNSURE (1)..(137): unsure at all Xaa locations
  Clone ID: PAT_MRT4577_68380C.1.pep
  unsure (1)..(137): unsure at all Xaa locations
CLMPPXVSLLXATQGDAIRNYYHDNHVIQDMLVPLYKVGDALEFVHHEMEVYPLWLCPHRLFKLPVKTMIYPEPGFEHQQRQGDTSYAQMFTDVGVYYTPACIFRGEEFDGAESVKRLEQWLIENHSYQPQYAVTEL

SEQ ID NO: 6046 - protein, 80 aa, Zea mays
  Clone ID: PAT_MRT4577_68431C.1.pep
RIGCSCLSPGSAASGGGEGEKLVRSVPDHACLLVNQGSHTYLRLLECGVLMESKGGKKSSSRHSMLVEAPLGYRFDVFRP

SEQ ID NO: 6047 - protein, 123 aa, Zea mays
  Clone ID: PAT_MRT4577_68483C.1.pep
ASGKLSCRPIIYMTSWKRKTCSSTNHSAWLRYKKEKASAYLSMHASADLEPGAGQLCRGFGPWGTSLLDTIRICLQQSSPRCRPDAEEDDWLGKQQPLPGGEPPPPPPLSLTANAPSSATLRL

SEQ ID NO: 6048 - protein, 87 aa, Zea mays
  UNSURE (1)..(87): unsure at all Xaa locations
  Clone ID: PAT_MRT4577_6864C.1.pep
  unsure (1)..(87): unsure at all Xaa locations
GARTKNRDKWVSQMPRFYYLLVLAANWFSRPSLFYERGRLIWCNFCSRQYSVPDLTLYYFQRXAWRVALCAINHLXEAWRRRVIVRM

SEQ ID NO: 6049 - protein, 286 aa, Zea mays
  UNSURE (1)..(286): unsure at all Xaa locations
  Clone ID: PAT_MRT4577_69309C.1.pep
  unsure (1)..(286): unsure at all Xaa locations
DECNTSASTTRSRSRLTTHDWRSVGGGGSKRPSNNRHPHARNPRFLKELDLQKSCVKHQDHQWINCFPKSSTSLECLNFSCLTGEVNAVALEELVARSPNLKSLRLNLAVPFDVLSRILSRTPKLEDLGTGSFLQGNDPAAYASLCRALENCTSLKSISGFWDAPGFYVQGILSNCKIRNLTCLNLSYATLIQSTQLIGIIRHCKKLHVLWVLDHIGDEGLKAVSFSCPDLQELRVYPSVVAPRGTVTXEEGLVALSSCXKLQHVLFSCVRMTNTALMTIARYCPR

SEQ ID NO: 6050 - protein, 573 aa, Zea mays
  Clone ID: PAT_MRT4577_69310C.1.pep
MAYFPDEVVGYILGYVTSHQDRNAVSLVCRAWYDIERHGRHSVLVRNCYAVCPERVHMRFPNMRALSLKGKPHFAEFNLVPAGWGATANPWVDACARACPGLEELRLKFMVVTDECLKLLSLSFTNFKSLVLVCCEGFSTTGLANIATNCRFLKELDLQKSCVKHQDHQWINCFPKSSTSLECLNFSCLTGEVNAVALEELVARSPNLKSLRLNLAVPFDVLSRILSRTPKLEDLGTGSFLQGNDPAAYASLCRALENCTSLKSISGFWDAPGFYVQGILSNCKIRNLTCLNLSYATLIQSTQLIGIIRHCKKLHVLWVLDHIGDEGLKAVSFSCPDLQELRVYPSVVAPRGTVTEEGLVALSSCRKLQRVLFSCVRMTNTALMTIARYCPRLTSFRLCIRKPRSADAVTGQPLDEGFGAIVRSCRGLRRLAMSGLLTDSVFLYIGMYAEKLEMLSVTFAGDTDDGMVYVLNGCRNLKKLVIKESPFGDAALLAGAHRYESMRSLWMSSCQITLGGCKALAATMPNINVEVIGGASFGAMDGGVSGARKVDMLYLYRTLAGPRCDTPGFVSIL

SEQ ID NO: 6051 - protein, 573 aa, Zea mays; identical to SEQ ID NO: 6050
  Clone ID: PAT_MRT4577_69311C.1.pep

SEQ ID NO: 6052 - protein, 351 aa, Zea mays
  Clone ID: PAT_MRT4577_69313C.1.pep
MMMLIDCSRCRTPLQLPHGAPCIRCAICGAITHVAPAPPVEPNRGAVQPPPGWGPPPPPVHGRKRAVVCGISYRHSRYELKGCINDVKCMRHLLMTRFNFPDDSIIMLNEEQTDPYKIPTKHNIGMAMYWLVQGCQPGDSLVFHYSGHGAQQRNYNGDEVDGFDETLCPLDFETQGMIVDDDINTALVRPLPRGVKLHAFIDACHSGTALDLPYLCRMNRSGQYVWEDHRPPSGVWKGTSGGEAISFSGCDDDQTSADTSALSKVTSTGAMTFGFIQAIERGQGTTYGSILNSMRSTIRNTDDSAGVGGGAVTSLITMLLTGGSLSAGGLRQEPQLTACEPFDVYAKPFSL

SEQ ID NO: 6053 - protein, 63 aa, Zea mays
  UNSURE (1)..(63): unsure at all Xaa locations
  Clone ID: PAT_MRT4577_69357C.1.pep
  unsure (1)..(63): unsure at all Xaa locations
MASSEGVLLGMGLPLLDISSVVHDAFLXQYDIXLNNAILADDIHSPMYDDSTSISNVAYIVAG

SEQ ID NO: 6054 - protein, 55 aa, Zea mays
  Clone ID: PAT_MRT4577_69475C.1.pep
DRPSQYNGPCFIQQWNGFTWCRVHHKKGAYIHVLELFRFSSHCDVLFLLSSCYNR

SEQ ID NO: 6055 - protein, 64 aa, Zea mays
  Clone ID: PAT_MRT4577_69499C.1.pep
GEGDEAESAGPLRLPMYHDLELYALARRCSRRCGGSGSPWHRRGRPRSSGTQLSDAAISIGRVG

SEQ ID NO: 6056 - protein, 278 aa, Zea mays
  Clone ID: PAT_MRT4577_69510C.1.pep
MGRQPCCDKVGVKKGPWTAEEDQKLVGFLLTHGHCCWRVVPKLAGLLRCGKSCRLRWTNYLRPDLKRGLLSDDEERLVIDLHAQLGNRWSKIAAQLPGRTDNEIKNHWNTHIRKKLVRMGIDPVTHLPLQEPPAPAPAPAEQQEQSHRQQEELQLQELQNGRELIMQEGAGEDDITPMIQPHEIMPTAAAASNCGSVSSAHAGSASVVSPSCSSSAVSGVEWPEPMYLLGMDGIMDADWGSLFPDTGAGGGGGGFDLGVDPFDQYPGGGFDQEDDHRI

SEQ ID NO: 6057 - protein, 119 aa, Zea mays
  UNSURE (1)..(119): unsure at all Xaa locations
  Clone ID: PAT_MRT4577_69619C.1.pep
  unsure (1)..(119): unsure at all Xaa locations
IFCLLMLLYLSAIAPTATIFPQYSQASIAFLLPTYLXPTVSSVCXNPILQPYTIQQSITACILPLSPLFLQQSSYLLQQLPFVHLLAQNIKAQQLQQLLLTNLATYSXQHQFLSFNQLT

SEQ ID NO: 6058 - protein, 116 aa, Zea mays
  Clone ID: PAT_MRT4577_69631C.1.pep
MDQGDVAVAVPPAAPSSSCGGAGCKKGKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 6059 - protein, 276 aa, Zea mays
  Clone ID: PAT_MRT4577_69730C.1.pep
MDEENVVELLQRYRRDRQVLLNYILSGNLIKKVAMPPGAISLDDVDIDQVSVDYVLNCAKKGEPLDLGDAIRLFHDSLDYPYVNNTGAVDEFYLLTKPEYSGPAPTREPPPIPATAPSSVVVPPPDVEPAPIIVSSPVTATNLPKSQPFDSPTEKELTIDDIEDFEDDEDEFDGRRASRRHQTDASDLSLLLPLFETGITDNDLRETAYEILVAAAGASGGLIVPQKEKKKEKRHRLMRKLGRSKSESVDINTQRQPGLVGLLETMRAQLGITESM

SEQ ID NO: 6060 - protein, 266 aa, Zea mays
  Clone ID: PAT_MRT4577_69830C.1.pep
MKALPRIDLSNATTDITEWRPPDAPVSASRRRLDVGRGKQNNAGSATASASRAPCHGADTESGNRKGGREMDSSTSAAAAGEAAVPPEDDVCSVCHDRFRIPCQANCSHWFCGECIIRVWNYGPPVQACKCPICRRLINLLVPAALSGQEDGPQAQRILGEIQHYNCIFGGAPRSLTQRLQDLPFFIRRLFRELMDPQRTLPLVFRARMLMMVALSAIYVLSPVDILPESMLGLFGFVDDLLILLIVFLHLAAVYRSLLLYRHGGQ

SEQ ID NO: 6061 - protein, 163 aa, Zea mays
  Clone ID: PAT_MRT4577_69852C.1.pep
MLVHQQNLEEQEPLSSIFDGSSPASAIVAVDTNLDTSTPDTYRAPPAPLPYDVILAVPNNPGFGNSVGLEKPDTKSKTDDQQESINDQESLEVDESCKKSVTEDKADEEDVCPICLEEYDEENPRSITKCEHHFHLCCILEWMERKDTCPVCDQITLVDEMFE

SEQ ID NO: 6062 - protein, 184 aa, Zea mays
  Clone ID: PAT_MRT4577_69855C.1.pep
MGGCCCCSSRTSEAVRARAPVDIYHQQNLEEQEPLSSIFDGSSPASAIVAVDTNLDTSTPDTYRAPPAPLPYDVILAVPNNPGFGNSVGLEKPDTKSKTDDQQESINDQESLKVDESCKKSVTEDKADEEDVCPICLEEYDEENPRSITKCEHHFHLCCILEWMERKDTCPVCDQITLVDEMFE

SEQ ID NO: 6063 - protein, 104 aa, Zea mays
  UNSURE (1)..(104): unsure at all Xaa locations
  Clone ID: PAT_MRT4577_6991C.1.pep
  unsure (1)..(104): unsure at all Xaa locations
KQQQQPPVSQQPAANPQQFHTINQPAARDSPAXAQQQQXXPXSQQAGVSXATIRTQPQKKPFNQHEAXNAGTLXQXQQLXPFNQXALTNPAVFXQQPIIGGVLF

SEQ ID NO: 6064 - protein, 156 aa, Zea mays
  Clone ID: PAT_MRT4577_69980C.1.pep
MDAVMFGLETPLMAALQHLLDVPDGDNKTGGGATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 6065 - protein, 166 aa, Zea mays
  Clone ID: PAT_MRT4577_69981C.1.pep
MDAVMFGLETPLMAALQHLLDVPDGDAGAGGDSDNKTGSGGSATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 6066 - protein, 163 aa, Zea mays
  Clone ID: PAT_MRT4577_69984C.1.pep
MDAVMFGLETPLMAALQHLLDVPDGDAGAGGDNKTGGGGATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 6067 - protein, 163 aa, Zea mays
  Clone ID: PAT_MRT4577_69985C.1.pep
MDAVMFGLETPLMAALQHLLDVPDGDAGAGGDSDNKTGGGATRTYVRDARAMAATPADVKELPGAYAFVVDMPGLGTGDIRVQVEDERVLVVSGERRREEREDAKYLRMERRMGKFMRKFVLPTNADVDRVAAVCRDGVLTVTVEKLPPPEPKKPRTIEVKVA

SEQ ID NO: 6068 - protein, 164 aa, Zea mays
  Clone ID: PAT_MRT4577_69986C.1.pep
MDAVMFGLETPLMAALQHLLDVPDGDAGAGGDNKTGSGGSATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 6069 - protein, 164 aa, Zea mays; identical to SEQ ID NO: 6068
  Clone ID: PAT_MRT4577_69987C.1.pep

SEQ ID NO: 6070 - protein, 164 aa, Zea mays
  Clone ID: PAT_MRT4577_69988C.1.pep
MDAVMFGLETPLMAALQHLLDVPDGDAGAGGDSDNKTGGGATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 6071 - protein, 103 aa, Zea mays
  UNSURE (1)..(103): unsure at all Xaa locations
  Clone ID: PAT_MRT4577_70077C.1.pep
  unsure (1)..(103): unsure at all Xaa locations
GFPGFGFVGERIEIAASDVEDRXLVCGLAWATDDHSLHNAFSTYGEVLQFMIILGRETQRFRGFSFATFFTGEAMRNAIXGMNGLELDSRNISVNEAHSRGGR

SEQ ID NO: 6072 - protein, 416 aa, Zea mays
  UNSURE (1)..(416): unsure at all Xaa locations
  Clone ID: PAT_MRT4577_70092C.1.pep
  unsure (1)..(416): unsure at all Xaa locations
LFGXYAESSCAALVVASISSFGINHQFTPMVYPLLVSSVGIIACLITTLFATDFFEIKAANEIEPALKKQLIISTVVMTIGIALISWLGLPYTFTIYNFGAQKTVQSWQLFLCVAVGLWAGLVIGFITEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTTKPDYATCVKISTDASIKEMIPPGALVMPTPLIVGILFGVETLAGVLAGALVSGVQIAISASNTGGAWDNAKKYIEAGASEHARTLGP

SEQ ID NO: 6073 - protein, 766 aa, Zea mays
  Clone ID: PAT_MRT4577_70096C.1.pep
MAAAAILPELATQVLIPVAAAVGIAFAVVQWVLVSKVRVTPERRADGGAVKSGPSDYLIEEEEGLNDHNVVVKCAEIQTAISEGATSFLFTEYKYVGLFMGIFAILIFLFLGSVEGFSTKSQPCHYIKDQTCKPALANAIFSTIAFVLGAVTSLVSGFLGMKIATYANARTTLEARKGVGKAFITAFRAGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVDEIEPALKKQLIISTIVMTIGIALISWLGLPYTFTIFNFGVQKTVQSWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNNIPGLMEGTTKPDYATCVKISTDASIKEMIPPGALVMLTPLIVGILFGVETLSGVLAGALVSGVQIAISASNTGGAWDNAKKYIEAGVSEHARTLGPKGSDPHKAAVIGDTIGDPLKDTSGPSLNILIKLMAVESLVFAPFFAAHGGILFKWL

SEQ ID NO: 6074 - protein, 235 aa, Zea mays
  UNSURE (1)..(235): unsure at all Xaa locations
  Clone ID: PAT_MRT4577_70099C.1.pep
  unsure (1)..(235): unsure at all Xaa locations
MAAKIFCLLMLLGISASAATATIFPQCSQAPIASLLPPYLSPAVSSVCENPIVQPYRIQQAIAAGILPLSPLFLQQSSALLQQLPLVHLLAQNIRAQQLQQLVLANLAAYSQQQQFLPFNQLAALNSASYLQQQQLPFSQLPVAYPQQFLPFNQLAALNSPAYLQQQQLLPFSQLAGVSPATFLTQPQLLAVYQHAAPNAGTLLQLXQLVAFTQLVLTNLAGXYQQPIFGGCPSL

SEQ ID NO: 6075 - protein, 200 aa, Zea mays
  UNSURE (1)..(200): unsure at all Xaa locations
  Clone ID: PAT_MRT4577_70100C.1.pep
  unsure (1)..(200): unsure at all Xaa locations
RGSHANIAACLSPYLXQRAYSECESPILQXPYRIQQAASGGIIPLSPLFLQQSSALLQQLPLVHLLAQNIRAQQLQQLVLANLAAYSQQQQFLPFNQLAASNSASYLQQQQLPFSQLSAAYPQQFLPFNQLTALNSPAYLQQQQLLPFSQLAGVSPATFLTQPQLLPFYQHAAPNAGTLLQLQQLLPFNQLALTNPTAFY

SEQ ID NO: 6076 - protein, 220 aa, Zea mays
  UNSURE (1)..(220): unsure at all Xaa locations
  Clone ID: PAT_MRT4577_70102C.1.pep
  unsure (1)..(220): unsure at all Xaa locations
AXKIFRILVLLALLACAATVAIVPQCSQGSIATLLXPYLSPTVSSVCENPIFQTYRNQQANAGDILPLSPLMLQQSSALXQQLPLVHLLTQNIRAQQLQQLVLANLAAYSQQQQFLPFNQLAALNSASYLQQQQLPFSQLSAAYPQQFLPFNQLTALNSPAYLQQQQLLPFSQLAGVSPATFLTQPQLLPFYQHAAPNAGTLLQLQQLLAFNQLALTNPA

SEQ ID NO: 6077 - protein, 220 aa, Zea mays
  UNSURE (1)..(220): unsure at all Xaa locations
  Clone ID: PAT_MRT4577_70103C.1.pep
  unsure (1)..(220): unsure at all Xaa locations
MGAKTFCLLMLLGLSASTATASILPQCXQAPIATLFSPYLSPTVPSVCENPILQPYRIQQAIAAAILPLTPLFLQQXSALLQXLPLVHLLAQNIRPQQLQQLVLANLAAYSQQQQFLPFNQLAALNSATYLQQQQLPFSQLSAVYPQQFLPFNQLTALNSTAYLQXQQLLPFNQLAGVSPATFLTQPQVLXYYQHAVPNAGTLLQLTQLVPFNQFDLTNP

SEQ ID NO: 6078 - protein, 201 aa, Zea mays
  UNSURE (1)..(201): unsure at all Xaa locations
  Clone ID: PAT_MRT4577_70107C.1.pep
  unsure (1)..(201): unsure at all Xaa locations
FCLLMLLGLSARAAAATMLPKCSQAPIASLLPPPYXPAGPSVXENPILQPYRIQQAIAVGTLPLSPLFLQQSSTLLQQTPXVHLLAQNIRAQQLQQLALANLAGYSPQQQCLPFNQLAALNSAYYWQQQQLPFSQLPVDYPHQLLPFNQLAALNSPAYXQEQQLLPFNQLAGVSPATFLTQPQLLPFYQHAAPNAGTLLQL

SEQ ID NO: 6079 - protein, 122 aa, Zea mays
  UNSURE (1)..(122): unsure at all Xaa locations
  Clone ID: PAT_MRT4577_70109C.1.pep
  unsure (1)..(122): unsure at all Xaa locations
NPIVQPYMIQHAIATCILPLSPLFLQQPSSLLHHLPLVHLLAHNIIAQHLQQLVLANLAAYSQQHQFLPFNQPGFIXNSAAYLQQQLPFIQLVASYPHXILSFNQLTTLNSAAYLQQQQLLP

SEQ ID NO: 6080 - protein, 141 aa, Zea mays
  Clone ID: PAT_MRT4577_70114C.1.pep
VLAPQVRQLVLTVLGHYFQRQQSLPFTLLDALNSAYYALQQVLPFSQLRFAYQQQYLPFNHLSALNSPAYLQQQHLLPFSQLAGVSPATFLMQPQLLPFYQHAAPNAGTLLHLQQLLPFNQLALTSPAAFYQQPIIGGALF

SEQ ID NO: 6081 - protein, 160 aa, Zea mays
  UNSURE (1)..(160): unsure at all Xaa locations
  Clone ID: PAT_MRT4577_70133C.1.pep
  unsure (1)..(160): unsure at all Xaa locations
SSALLHQXRLVHLLAHNISAHQXLQQLVLANLAAYFQHQQFLPFNQRAALNYACYLHQRXMLPFSQLPDAYPQQFLPFNQLAALNSHAYLQQHQLLPVSQIAGVSLVTFWIQPQLLPFYQHDAPTAGTLLHLQQLLPFNQLALTNPAAFYQQPIIGGALF

SEQ ID NO: 6082 - protein, 141 aa, Zea mays
  UNSURE (1)..(141): unsure at all Xaa locations
  Clone ID: PAT_MRT4577_70137C.1.pep
  unsure (1)..(141): unsure at all Xaa locations
FLPFNQLGSLMSACYLHQQXLPFSQLPAAYQQQFLPFNQLAALNSPAYLQQQQLLPFSQLAGVSPATFLTQPQLLPFYQHVAPNVGTLFHLQQLMPFRQLALSNSSVFYQQAFIGGALLLYLLVSYSSSNKVFFFMFVASH

SEQ ID NO: 6083 - protein, 225 aa, Zea mays
  UNSURE (1)..(225): unsure at all Xaa locations
  Clone ID: PAT_MRT4577_70138C.1.pep
  unsure (1)..(225): unsure at all Xaa locations
MAAKIFCFLMLLGLSASAATATIFPQCSQAPIASLLPPYLSSAVSSVCENPILQPYRIQQAIAAGILPLSPLLLQQPSFLLQQPPLQHLVPHNMTPQQLQQLVLDHLADYYQQQQLPSYQQPAVNNAADXQQQQLPFSQLSAAYPQQFLPFNQLTALNSAAYLQQQQLLPFSQLAGVSPATFLTQPQLLPFYQHAAPNAGTLLQLQQLLAFNQLALTNPAAFYQQ

SEQ ID NO: 6084 - protein, 143 aa, Zea mays
  UNSURE (1)..(143): unsure at all Xaa locations
  Clone ID: PAT_MRT4577_70140C.1.pep
  unsure (1)..(143): unsure at all Xaa locations
MAAKISCLLMLLGLPARAATATIIPHCSQADIACLLPTYLSPTVSSVCENTMLQPYRIQHAITAGILPLSPLFLQQXSALLQQVPLVHLLTQNIRAQQLLQLXVLTYLAAYSQQQQLLPFNQLAALNSASYLQQQQLPFIQLS

SEQ ID NO: 6085 - protein, 175 aa, Zea mays
  UNSURE (1)..(175): unsure at all Xaa locations
  Clone ID: PAT_MRT4577_70141C.1.pep
  unsure (1)..(175): unsure at all Xaa locations
QAIAAGILHLSPMFVQQSSAILQQLRLVHLLAHIIRAQQVQQLVIANLAAYSQQHQFLPFNQLVALNSASYLQHHQLPFIQLVAAYPQQFLPFNQLAALNSPAYLQQQHLLPFSQVAGVSPAAFLTQPQLFPLYQHAAPNAGTLLQMQQLLPFSXLLCTNPAVLYQQPIIGGALF

SEQ ID NO: 6086 - protein, 163 aa, Zea mays
  UNSURE (1)..(163): unsure at all Xaa locations
  Clone ID: PAT_MRT4577_70142C.1.pep
  unsure (1)..(163): unsure at all Xaa locations
QHRRHNRVPTRAAKIFGFLRLLGLFERAATGTIFPKGXQAPIASFFPPYLXRGVLXVWENPIFKPYRIQQAIAAGILPLSPLFLQQPSSLLQKLPLGHLWAQNIRAQQLQQLGLANLAAYFXKQQFFPFNQLAALTSAAYLQQQLPFSQLVVAYPQQLLPFNQ

SEQ ID NO: 6087 - protein, 129 aa, Zea mays
  UNSURE (1)..(129): unsure at all Xaa locations
  Clone ID: PAT_MRT4577_70145C.1.pep
  unsure (1)..(129): unsure at all Xaa locations
SPVQVLTLVFKIFCLLMRGGLSASAATATIIPQCSQAPIASLLPPYLSPVVSSVCXENPILQSHKIQQXAIAAGILPLSPXFLQQSXVLLQQIPLVHLLAHNIMAQHLQHLVLANLAAYSQKHKYLPFN

SEQ ID NO: 6088 - protein, 170 aa, Zea mays
  UNSURE (1)..(170): unsure at all Xaa locations
  Clone ID: PAT_MRT4577_70162C.1.pep
  unsure (1)..(170): unsure at all Xaa locations
MAAKILCLLMLLGLSAXAVTATIFPQCSQAPIAXFFSAYLSPAVSWVCENPILQPYRIQQAXTAGIXPLSPLXLHQSXALLHQLPLVHLLXQNIRAQQLQQLVLANLAXYFQQQXFXLXNQLAXXNSASYLQQQQLPLSQXPAAYPQXFLPLYQLXAXNSSAYXQHQQLL

SEQ ID NO: 6089 - protein, 111 aa, Zea mays
  UNSURE (1)..(111): unsure at all Xaa locations
  Clone ID: PAT_MRT4577_70166C.1.pep
  unsure (1)..(111): unsure at all Xaa locations
MNYACYFIKQQVPFSQLSAAYRQQFLPFNQLSALNYLGYLQQHQVLPFSQLAGVSRVTFLTQPQLLPFYQHGAPSDGSLFQLQQLVPFTQLVLXTNPAAFYQQPIMGGALI

SEQ ID NO: 6090 - protein, 111 aa, Zea mays
  UNSURE (1)..(111): unsure at all Xaa locations
  Clone ID: PAT_MRT4577_70175C.1.pep
  unsure (1)..(111): unsure at all Xaa locations
MAAKIFRFLMLLGLSASDATATIFPQCSQAPIAFLFPPYLSPAVXSVCENPIVQPYRIQQAIATGILPLSPLFLQQPSALIQELPWVHWGAQNLRDQHLQQLGLANLAVTL

SEQ ID NO: 6091 - protein, 122 aa, Zea mays
  UNSURE (1)..(122): unsure at all Xaa locations
  Clone ID: PAT_MRT4577_70190C.1.pep
  unsure (1)..(122): unsure at all Xaa locations
MMRHHTMAAKIXCLLMLLGIXASAATATIFPQCSQAPIASLLPPYLSPAASSVCEXNPILQPYRIQQAIATGMLPLSPLLLQQSXTLLQHLPWVHXLAQNIRAQQLQQLVLSNRAAYCQHQK

SEQ ID NO: 6092 - protein, 230 aa, Zea mays
  Clone ID: PAT_MRT4577_70195C.1.pep
KIFCFLMLLGLSASAATATIFPQCSQAPITSLLPPYLSPAVSSVCENPILQPYRIQQAIAAGILPLSPLFLQQPSALLQQLPLVHLLAQNIRAQQLQQLVLGNLAAYSQQHQFLPFNQLAALNSAAYLQQQLPFSQLAAAYPQQFLPFNQLAALNSAAYLQQQQLPPFSQLADVSPAAFLTQQQLLPFYLHAAPNAGTVLQLQQLLPFDQLALTNPTAFYQQPIIGGALF

SEQ ID NO: 6093 - protein, 111 aa, Zea mays
  Clone ID: PAT_MRT4577_70196C.1.pep
MAAKIFCLLMLLGLSASAATATIFPQCSQAPIASLLSPYLSPTGSSVWENPILQPFRIQPAIAACILPLLPLVLQQSLGLLQQVPLGHLLAQNIKGQQLPQPGLANPGCLL

SEQ ID NO: 6094 - protein, 184 aa, Zea mays
  UNSURE (1)..(184): unsure at all Xaa locations
  Clone ID: PAT_MRT4577_70202C.1.pep
  unsure (1)..(184): unsure at all Xaa locations
MFQQWLSQIFSLLMLPALSGSAATXTIFPQCSQAPIAYLLPPYLSPTVCSICQNQLLQPYMIQQGITADILPFHTVFLQQLLDILQQLPSVHLLTQNIRSQQLQQLVLANLAAYSQQQQFLTFNQLGSLNSASYVQQQQLPFSQLPAAYPHQCLPFNQLATLNSPAYLQQQQLLPFIQLACVSP

SEQ ID NO: 6095 - protein, 258 aa, Zea mays
  UNSURE (1)..(258): unsure at all Xaa locations
  Clone ID: PAT_MRT4577_70203C.1.pep
  unsure (1)..(258): unsure at all Xaa locations
TIIRTSSSIQSSIVGQQWPAKYACLLMLLGXLSASAGTGTTFPXQCSQAPIASLMPPYLSPEEHRVCENPMLQXPYRIQQAXVAAGILPLXPSFLHQSSALLQQLPLVHLLAQNIRARQLQXQLVLADLAAYCQEQQILPLNQLAALNSASYLQQQQLPFSQLPAAYPQQXFLPFNQLAALNSAAYLQQQQLLPFSQLAGVSPATFLIQPQVLPVYQHAAPNAGTLLQLQQLLPFNQLALTNPAAFYQQPIIGXGALF

SEQ ID NO: 6096 - protein, 104 aa, Zea mays
  UNSURE (1)..(104): unsure at all Xaa locations
  Clone ID: PAT_MRT4577_70204C.1.pep
  unsure (1)..(104): unsure at all Xaa locations
MAAKIFCLLMLLGLSARAGTATIFPKCSQASIAFLLSPYLSPAGSSVCENPILXPYRIQQAITGGILPLSPLVLQQSSGLLHQVPLVHLLAQNIKAQQLQQLVL

SEQ ID NO: 6097 - protein, 93 aa, Zea mays
  UNSURE (1)..(93): unsure at all Xaa locations
  Clone ID: PAT_MRT4577_70229C.1.pep
  unsure (1)..(93): unsure at all Xaa locations
MAAEGEKLMITLKSSDGEEFDMEDAVAMESQTIRHMIDDYCVDNGIXPLPNVNSMIVSTVLEYCNKHVHGAAAAADVSTAGSDDVGDESGNST

SEQ ID NO: 6098 - protein, 143 aa, Zea mays
  UNSURE (1)..(143): unsure at all Xaa locations
  Clone ID: PAT_MRT4577_70230C.1.pep
  unsure (1)..(143): unsure at all Xaa locations
TNHVADSQQQQFLPFKQLVALNTTCNLQQQQVPFSQLLAAYPQQFLPFNQLAALNSPAYFQQQQLVPFSQLAGVSPATFLMQXQLFPFYQHAAPSAGTLLQGQQWLPFNQRALTNPAAFXYQQPIIGGASLSLYEDSQKNLLV

SEQ ID NO: 6099 - protein, 162 aa, Zea mays
  UNSURE (1)..(162): unsure at all Xaa locations
  Clone ID: PAT_MRT4577_70234C.1.pep
  unsure (1)..(162): unsure at all Xaa locations
RPPGAGNALQRTTDQVLWAQNIKEQXLQELXLANLAAYSQQHQFLPFNQLAALNSASYLQQQQLPFNQLAAAYPQQFLPFNQLAALNSPAYXQQQQLLPFSQLAGVSPAAFLTQPQXMPFYQLAEPNAGTLLQLQQLLPYNQLAXDKPSXIYQQPIIGGAPL

SEQ ID NO: 6100 - protein, 232 aa, Zea mays
  UNSURE (1)..(232): unsure at all Xaa locations
  Clone ID: PAT_MRT4577_70239C.1.pep
  unsure (1)..(232): unsure at all Xaa locations
AHQQWQRKILGLLMLLGLSXSAVTATXLFPHCSQAXPIASLLPPYXLTPAGCSGCENPILQPYRIQQAIAAGILPLSPLFLQQXSALLQQLPLEHLLVQNIRAQQQQLVLANLAAYSQQQQFLPFNQLGSLNSASYLQQQQLPFSQLPAAYPQQYXPFNQLAALNSPAYLQQQQLLPFSQLAGVSPATFLTQPQMLPFYQHVAPNAGTLLQLQQLLAFNQLALTNPAVLYQQ

SEQ ID NO: 6101 - protein, 111 aa, Zea mays
  Clone ID: PAT_MRT4577_70242C.1.pep
MAAKGVCLIMLLGLSASAATASIFPQCSQAPIASLLPPYLSPAMSSVCENPILLPYMIQQAIAAGILPLSPLFLQQSSSLLQQVPLRHLFGQIIMAQHLQQLALSNLASYS

SEQ ID NO: 6102 - protein, 143 aa, Zea mays
  UNSURE (1)..(143): unsure at all Xaa locations
  Clone ID: PAT_MRT4577_70245C.1.pep
  unsure (1)..(143): unsure at all Xaa locations
HIKHNHIPSISTKIFCFLVSLXLYASAATATIFPQCSQAPIASFLPPYLSPAVSSLCENPILQPYKIQHAIAACILPLSPLFLQQPSALLQHLPFVHFLAQNINAQQLQQLFLXNLATYSHQQHFLPFNQLASFNSTAYFQQQ

SEQ ID NO: 6103 - protein, 135 aa, Zea mays
  UNSURE (1)..(135): unsure at all Xaa locations
  Clone ID: PAT_MRT4577_70261C.1.pep
  unsure (1)..(135): unsure at all Xaa locations
MAAKIFCLLMLLGITASAATATILPQCSQAAIDSLFPPYLSPAESSVCENPILQPYRIQQAIAAGILPLSPLFLQQSSALLQELPMVHLLAQNIRAQQLHQLALXNLAVYSQEQQFFPFNQLAALNFASXQHQQL

SEQ ID NO: 6104 - protein, 194 aa, Zea mays
  UNSURE (1)..(194): unsure at all Xaa locations
  Clone ID: PAT_MRT4577_70267C.1.pep
  unsure (1)..(194): unsure at all Xaa locations
ISPTVSSVCXNTILHPNRIQQAIAVGMLPLXALVACNNNXLLQKIPLEHLLAQNIRAQRLQQLVLANLAAYSQQQQFLPFNQLAALNSASYLQQQQLPFRQLSAAYPQQFLPFNQLTALNSPAYLQQQQLLPFSQLAXGVSPATXFLTQPQLLPFYQHAAPNAGTLLQLQQLLPFNQLALTNPAAFYQQPIIEW

SEQ ID NO: 6105 - protein, 117 aa, Zea mays
  Clone ID: PAT_MRT4577_70268C.1.pep
VAAVNYHYSSQQPLVPFRQIPAANPQQFLPFNQLAALNSPAYLQQQQLLPFSQLAGVSPATFLIQPQLLPFYQHDAPNAGTLLQLQLLLPFNLLDLPNSAAFYHQPIIGGALLLDFL

SEQ ID NO: 6106 - protein, 106 aa, Zea mays
  UNSURE (1)..(106): unsure at all Xaa locations
  Clone ID: PAT_MRT4577_70270C.1.pep
  unsure (1)..(106): unsure at all Xaa locations
QLPFSQLVAAYLQQFVPSNLLAALSSAVYXQQQQLLPFSQLADVRRDAFFTQQQLLLFYVHAMPNAGTLLHLQQLLPFNLLALTNPTVFYHQPIIGGALFYIAYEL

SEQ ID NO: 6107 - protein, 169 aa, Zea mays
  UNSURE (1)..(169): unsure at all Xaa locations
  Clone ID: PAT_MRT4577_70275C.1.pep
  unsure (1)..(169): unsure at all Xaa locations
TSPFFSSECENPGGYFYKIQHAFTADMLPLSPLVLQQSSPLLHPSPLVHLLAQNIMAQQLPQLVLANLAVYSQQQQFLPFNQLAALNSASYLQQQQLPFSQLPAAYPQQFLSFKQLAALNSPAYLQQQQLLPFKQLAGVSPATFLIQPQFVPFXQHAAPNACPLLQLEQ

SEQ ID NO: 6108 - protein, 121 aa, Zea mays
  UNSURE (1)..(121): unsure at all Xaa locations
  Clone ID: PAT_MRT4577_70277C.1.pep
  unsure (1)..(121): unsure at all Xaa locations
FLPFKQLVALYSACYLQQQQLPFSQLLVAYPQQFLPFMQLAALTSPAYFQQQQLLPFSQLAGVSPATFLTQPQLLPFYQHAAPNAGTLLQVQQFLPFNQLALTNLAVSTXQPIIGGASFRF

SEQ ID NO: 6109 - protein, 299 aa, Zea mays
  Clone ID: PAT_MRT4577_7027C.1.pep
MAGAQESLSLVGTMRGHNGEVTAIATPIDNSPFIVSSSRDKSLLVWDLTNPVHSTPESGATADYGVPFRRLTGHSHFVQDVVLSSDGQFALSGSWDGELRLWDLSTGLTTRRFVGHEKDVLSVAFSVDNRQIVSASRDKTIKLWNTLGECKYTIGGDLGGGEGHNGWVSCVRFSPNTFQPTIVSGSWDRTVKVWNLTNCKLRCTLDGHGGYVNAVAVSPDGSLCASGGKDGVTLLWDLAEGKRLYSLDAGSIIHSLCFSPNQILYCTSLSWSADGSTLYTGYTDGSIRVWKISGYGYAG

SEQ ID NO: 6110 - protein, 235 aa, Zea mays
  UNSURE (1)..(235): unsure at all Xaa locations
  Clone ID: PAT_MRT4577_7028C.1.pep
  unsure (1)..(235): unsure at all Xaa locations
MANMQESLGLVGTMRGHNDVVTAIAAPIDNSPYIVSGSRDKSLLVWDLTNPVQSLGDGTVGTDYAVPFRRLTGHGHFVQDVVISSDGQFALSGSWDGELRLWDLSTGLTTRRFVGHSKDVISVAFSVDNRQIVSASRDNTIKLWNTLGECKYTIGGDMGGGEGHTGWVSCVRFSPNIQQPTIVSGSWDKTVKVWNLTNCKLRSTLXRHGGYVNAVAVSPDGSLCASGXGKDGVTL

SEQ ID NO: 6111 - protein, 128 aa, Zea mays
  UNSURE (1)..(128): unsure at all Xaa locations
  Clone ID: PAT_MRT4577_70292C.1.pep
  unsure (1)..(128): unsure at all Xaa locations
MHFNVPTMAAKRSGLLMLLGLSASAATATIFPQCSQATIASILTPYLXPAVYSVCENPILQPYRIQLAITDGILPLSPLFLQQSSALLHQLPQVHLLAQNIMAHQLQQLVLTYLAAYSQQHHYVAFNQ

SEQ ID NO: 6112 - protein, 135 aa, Zea mays
  UNSURE (1)..(135): unsure at all Xaa locations
  Clone ID: PAT_MRT4577_70294C.1.pep
  unsure (1)..(135): unsure at all Xaa locations
LFALYLTSIVQQHHSFSQLAAAYRQQFLPFNQLAALNYAAYLQQQQLPPFSQLADVSPIAFLXTQHQLLPFYLPAAPSAGTLLQLQQLLPFNQRALTNPAAFYQQPIIGGASFRLHMSDSSIMNFLYDECGFPEI

SEQ ID NO: 6113 - protein, 124 aa, Zea mays
  UNSURE (1)..(124): unsure at all Xaa locations
  Clone ID: PAT_MRT4577_70296C.1.pep
  unsure (1)..(124): unsure at all Xaa locations
MAAKIFXLIAPCLSASAAREHLPQCSQAAIASLLPPXYLSQRVFSMXENPILLPYRIQQAIAAGILPLSPLFLQQSSALLQQLPMVHXLAQNIRAQQLQQLVLVHLAAYSQHQLLPMVHLEAXN

SEQ ID NO: 6114 - protein, 156 aa, Zea mays
  UNSURE (1)..(156): unsure at all Xaa locations
  Clone ID: PAT_MRT4577_70299C.1.pep
  unsure (1)..(156): unsure at all Xaa locations
YSSYPLVHLLAQXXIRAQQXLQQLVLASLAAYYQQQQFLPFXRLAALNCAAYLHXELPFSQLAAAYLQQLLPFIQLAALICAAYLQQHQLPPFSQLADVSPAAFLTQQQLLSFYSHAAPNAGTLLHLQQLLPFXQLCFVQYSAAFYHQPIIGGVLF

SEQ ID NO: 6115 - protein, 129 aa, Zea mays
  UNSURE (1)..(129): unsure at all Xaa locations
  Clone ID: PAT_MRT4577_70303C.1.pep
  unsure (1)..(129): unsure at all Xaa locations
MAAKIFCLLMLLGLSASAATATIFPQCSQAPIASLLAPYLSPTVSSVCENPGVEPYRIQQAIAAGILPLSPLFLQQXSGLLQQXPLLHLLAQNIWAHQLHQLVXLQPAADYFYQQXFFSFNQLTALNPV

SEQ ID NO: 6116 - protein, 173 aa, Zea mays
  UNSURE (1)..(173): unsure at all Xaa locations
  Clone ID: PAT_MRT4577_70306C.1.pep
  unsure (1)..(173): unsure at all Xaa locations
MADKKFCLLMLLGXLSACAATATIFPQCSQAAIASLLPPYLSPALSSVCENPILQPYRIQQAIAAGILPLSPLFLQQSSALLQQLPLAHLYGTTTCRAQQLQQLVLSILAAYSQQQQFLPFMQLGSSNSASYLQRQQLPFSQLPAAYPQQCLPFNQLAVWNYCAYFLHQQLLP

SEQ ID NO: 6117 - protein, 171 aa, Zea mays
  UNSURE (1)..(171): unsure at all Xaa locations
  Clone ID: PAT_MRT4577_70307C.1.pep
  unsure (1)..(171): unsure at all Xaa locations
RRPGGRASPLILQQPTALXTVTPLGHLXEQNIKGQQLQQLVLRNLAVYSQQQQCVGCNQLAASNSAAYLQQQLPFSQLAAAYPQQFLPFNQLAEMNSAAYLQQQQVPPFRQLADVSPIALLTQQQLLSDYLHAAPNASTLLQLQQLLPFNQLVLTNPTAFYQQRIIGGALF

SEQ ID NO: 6118 - protein, 129 aa, Zea mays
  UNSURE (1)..(129): unsure at all Xaa locations
  Clone ID: PAT_MRT4577_70308C.1.pep
  unsure (1)..(129): unsure at all Xaa locations
MAAKILCVLMLLGLSACVATATHFPXQCSQAHIASLLPPYLSPAPSSMSQTPIVQPYKIQQAIATRILPLSPLFLQQLAPLLQQLPLVHLMAQNIRAQQLQQLVLANLVAYSHEHQCLPFNQMAALNSA

SEQ ID NO: 6119 - protein, 334 aa, Zea mays
  Clone ID: PAT_MRT4577_7030C.1.pep
MGGAQESLSLGGTMRGHNGEGTAIATPIDNSPLIVSSSRDKSLLGGDLTNPGHSTPESGATADYGVPFRRLTGHSHFAQDVVLSSDGQFALSGSWDGELRLWDLSTGLTTRRFVGHEKDVLSVAFSVDNRQIVSASRDKTIKLWNTLGECKYTIGGDLGGGEGHNGWVSCVRFSPNTFQPTIVSGSWDRTVKVWNLTNCKLRCTLDGHGGYVNAVAVSPDGSLCASGGKDGVTLLWDLAEGKRLYSLDAGSIIHSLCFSPNRYWLCAATQDSVKIWDLESKHVVQDLKPDIQISKNQILYCTSLSWSADGSTLYTGYTDGSIRVWKISGYGYAG

SEQ ID NO: 6120 - protein, 167 aa, Zea mays
  UNSURE (1)..(167): unsure at all Xaa locations
  Clone ID: PAT_MRT4577_70311C.1.pep
  unsure (1)..(167): unsure at all Xaa locations
QLVLVNQATXSHLNQFLPFNXLFALYFTAYFQQHLPFSQLATAYPQQFLPFNQLAALNSAAYLQQQQLPPFSQLADVSPIAFXTQQQLLPFYLPAAPNAGTLLQLQQLPPPNQLALTNPTAFYQQPIIGGASFRLLMSYSSIMKFLDDVCGLPRNKLSPPSPRLSRA

SEQ ID NO: 6121 - protein, 365 aa, Zea mays
  Clone ID: PAT_MRT4577_7031C.1.pep
MAIKKKKKNRIILSLAPPPTQPLQPQSLTATMAGAQESLSLVGTMRGHNGEVTAIATPIDNSPFIVSSSRDKSLLVWDLTNPVHSTPESGATADYGVPFRRLTGHSHFVQDVVLSSDGQFALSGSWDGELRLWDLSTGLTTRRFVGHEKDVLSVAFSVDNRQIVSASRDKTIKLWNTLGECKYTIGGDLGGGEGHNGWVSCVRFSPNTFQPTIVSGSWDRTVKVWNLTNCKLRCTLDGHGGYVNAVAVSPDGSLCASGGKDGVTLLWDLAEGKRLYSLDAGSIIHSLCFSPNRYWLCAATQDSVKIWDLESKHVVQDLKPDIQISKNQILYCTSLSWSADGSTLYTGYTDGSIRVWKISGYGYAG

SEQ ID NO: 6122 - protein, 218 aa, Zea mays
  UNSURE (1)..(218): unsure at all Xaa locations
  Clone ID: PAT_MRT4577_70330C.1.pep
  unsure (1)..(218): unsure at all Xaa locations
SAATAXISXQCSQTRIASFLPXPYLSPAVSSVCENSILQPYRIQQAIAAGILPLSPLFLQQXSAILQQXRLVHLLAQNIKALQLQQLVLGNLAAYSQQQQFLPFNQLAALKCAAYLQQQLPFSQLAAAYPQQFLPFNQLAALNSAAYLQQQQLPPFSQLADVSPTAFLTQQQLLPFYLHAAPNARRIKQLQQLMPFNQLALTNPTAFYQQPIIGGALF

SEQ ID NO: 6123 - protein, 187 aa, Zea mays
  UNSURE (1)..(187): unsure at all Xaa locations
  Clone ID: PAT_MRT4577_70334C.1.pep
  unsure (1)..(187): unsure at all Xaa locations
ENTNIFNTYTIQQAIADGVLPLSCLCLQHSSALLQQXPLEHLLGQNMKTQQLQQLVLANLAAYSQQQQILPFNQLGSLNSASYLQQQQLPFNQLPAAYPQQLLPFNQLAALNSTAYLQQQQLLPFIQLAGVRPDKLLTQTQVMTFYQHNAPNAGTLLQLRQLLTFNQLGLTNPEWFYQQPIIGGALF

SEQ ID NO: 6124 - protein, 173 aa, Zea mays
  UNSURE (1)..(173): unsure at all Xaa locations
  Clone ID: PAT_MRT4577_70337C.1.pep
  unsure (1)..(173): unsure at all Xaa locations
AGDFDLLMLVGLFCSAGTATXLFPQCSQAPIASLLPPYLSPAASSVCXENPILQPYRIQQAIAADILPLSPLXLQQSSXALLQQLPLVHXLAQNIRAQQLQQLVLANLAAYSQQQQVLPFDQLGSLNSGAYLEQQQLRCRQLPAGYPQQFLSLNQLAGLHSAGCLQEEQLLPC

SEQ ID NO: 6125 - protein, 334 aa, Zea mays
  Clone ID: PAT_MRT4577_7033C.1.pep
MAGAQESLSLVGTMRGHNGEVTAIATPIDNSPFIVSSSRDKSVLVWDLTNPVHSTPESGVTADYGVPFRRLTGHSHFVQDVVLSSDGQFALSGSWDGELRLWDLSTGLTTRRFVGHEKDVISVAFSVDNRQIVSASRDKTIKLWNTLGECKYTIGGDLGGGEGHNGWVSCVRFSPNTFQPTIVSGSWDRTVKVWNLTNCKLRCTLDGHGGYVNAVAVSPDGSLCASGGKDGVTLLWDLAEGKRLYSLDAGSIIHSLCFSPNRYWLCAATQDSVKIWDLESKHVVQDLKPDIQVSKNQILYCTSLSWSADGSTLYTGYTDGSIRVWKISGYGYAG

SEQ ID NO: 6126 - protein, 228 aa, Zea mays
  UNSURE (1)..(228): unsure at all Xaa locations
  Clone ID: PAT_MRT4577_70342C.1.pep
  unsure (1)..(228): unsure at all Xaa locations
MAAKIFCFLMLLGLSASVATATIFPQCSQAPIASLLPPYLSPAVSSMCENPIVQPYRIQQAIATGILPLSPLFLQQPSALLQQLPLVHLVAQNIRAQQLQQLVLANLAAYSQQHQFLPFNQLAALNSAAYLQQQLPFSQLVAAYPQQFLPFNQLAALNSAAYLQXQQLLPFSQLADVSPAAFLTXQQLLPLYLHAMPNAGTLLQLQQXLLPYHXQLAFTNXTVFLPNN

SEQ ID NO: 6127 - protein, 225 aa, Zea mays
  Clone ID: PAT_MRT4577_70343C.1.pep
MKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPETNTGIIVLAEGRLMNLGCATGHPSFVMSCSFTNQVIA

SEQ ID NO: 6128 - protein, 136 aa, Zea mays
  UNSURE (1)..(136): unsure at all Xaa locations
  Clone ID: PAT_MRT4577_70345C.1.pep
  unsure (1)..(136): unsure at all Xaa locations
SLPSVHPLASYIKPHHLPLLELPNXLDAYSQEQQVLPFIQLSALNSACYLQQQQLPFSQLPAAYPHQLLPFNQLAALNSPAYLQQHQLLPFSQLAGVSPATFLIQPQVLAIYQDAAPNAGTLLPLXQLVAFNQLGL

SEQ ID NO: 6129 - protein, 209 aa, Zea mays
  UNSURE (1)..(209): unsure at all Xaa locations
  Clone ID: PAT_MRT4577_7035C.1.pep
  unsure (1)..(209): unsure at all Xaa locations
MAVLNLLALIIATLLLLFRRTSGAGISPADTLNSGGNVTDGETLVSAGGTFTLGFFSPSTTVLTKRYLGIWFTASGTDAVLWVANRETPLNNTSGVLVMSSRVGLRLLDGSGRTAWSSNTTGAPTSSVAQLLGSGNXXVVREKSSNAVFQWXSFDHPQNTLLAGMRFGKNLKTGXXWSXTSWRAQDDPATGDYXRVMDTKGLPDIVTWH

SEQ ID NO: 6130 - protein, 213 aa, Zea mays
  UNSURE (1)..(213): unsure at all Xaa locations
  Clone ID: PAT_MRT4577_70364C.1.pep
  unsure (1)..(213): unsure at all Xaa locations
MAAKIFCFLMLLGLSASVATATIFPQCSQAPIASLLPPYLSPAVSSMCENPIVQPYRIQQAIATGILPLSPLFLQQPSALLQQLPLVHLVAQNIREQQLQQLVLANLAAYSQKHQILPFNQLDELNSAAYLQQQLPFSQVDDDYPQQFLPFNQLAELNSAAYLQQQQLLPFKQLHDVRPDDFLTKQXQMMTIYLNNMHNDGTLLQMKKLMKLN

SEQ ID NO: 6131 - protein, 235 aa, Zea mays
  Clone ID: PAT_MRT4577_70368C.1.pep
MAAKIFCLIMLLGLSASAATASIFPQCSQAPIASLLPPYLSPAMSSVCENPILLPYRIQQAIAAGILPLSPLFLQQSSALLQQLPLVHLLAQNIRAQQLQQLVLANLAAYSQQQQFLPFNQLAALNSAAYLQQQQLLPFSQLAAAYPRQFLPFNQLAALNSHAYVQQQQLLPFSQLAAVSPAAFLTQQQLLPFYLHTAPNVGTLLQLQQLLPFDQLALTNPAAFYQQPIIGGALF

SEQ ID NO: 6132 - protein, 254 aa, Zea mays
  UNSURE (1)..(254): unsure at all Xaa locations
  Clone ID: PAT_MRT4577_70372C.1.pep
  unsure (1)..(254): unsure at all Xaa locations
PHISCDLLPHRKHNSRPTLAAKIYRFLMLLGLYAGDATAIIRPQXCSQAPIASLLPPYLSRSGVXMCENPIVQPYRIQQAIATGSLTMISPXVLQHPPALLQQXPLDHLVAQNIRAQQLQQLVLANLAAYSQQHEVLPFNQLAALNSAAYLQQQLPFSQLGAAYPQQFLPFNQLAALNSAAYLQQQQLLPFSQLADESPAAFLTQQQLLPFYLHAMPNAGTLLQLQQLLPFNQLALTDSSVVYQQPIIGGRPLL

SEQ ID NO: 6133 - protein, 152 aa, Zea mays
  UNSURE (1)..(152): unsure at all Xaa locations
  Clone ID: PAT_MRT4577_70374C.1.pep
  unsure (1)..(152): unsure at all Xaa locations
QLPLGHGXAQNSRAHQLHQLGRANLLANSQQQQFLPFNQEAALDSAYNWQRQQLPFSQLSAAYPQQFLPFNQLTALNSPAYXQQQQLLPFSQLAGVSPATFLTQPQLLPFYQHAAPNAGTLLQLQQLLPFNQPALTNPAAFHQQPIIGGALF

SEQ ID NO: 6134 - protein, 144 aa, Zea mays
  UNSURE (1)..(144): unsure at all Xaa locations
  Clone ID: PAT_MRT4577_70375C.1.pep
  unsure (1)..(144): unsure at all Xaa locations
TIRPLSPFLFQHSSALMQELPMADLLPQNIMTHQLQHPMLANLVAYSQQHQFLSFNQLAALNSASYLQQQQLPFSQIPAVYPQQFLPFNQLSALNSPAYLQQQQLLPFSQLAGVSPATFLIQPQFLSFYQHAXPNAGTLLQLQQ

SEQ ID NO: 6135 - protein, 163 aa, Zea mays
  UNSURE (1)..(163): unsure at all Xaa locations
  Clone ID: PAT_MRT4577_70376C.1.pep
  unsure (1)..(163): unsure at all Xaa locations
MAAKIFCLLMLLGISASAATATIFPQCSQAPIASLLPPHLSPAVSSVCENPILQPYXIQQAIAGGILPLSPLFLQQSXALLQQLPLVHLLAQNMRAQQLQQLVLANLAAYSKQQRVLPFNQLSELNSACYLEQQQLPFSQLPVAYPQELVALNQLGRWNSAAY

SEQ ID NO: 6136 - protein, 149 aa, Zea mays
  UNSURE (1)..(149): unsure at all Xaa locations
  Clone ID: PAT_MRT4577_70378C.1.pep
  unsure (1)..(149): unsure at all Xaa locations
MAAKILCLLMXLGLHASAATDTIFPQCXQAPIASLLPPYLSPTVSSVCENPIXLQPYRIQQAIAAGILPISPLFLQQSSALLQQLPLVHLLAQNIRAQQLQQLVLANLAAYSQQQHFLTFNQLACIDSASYLQQQQLPFSQLSACHPQQ

SEQ ID NO: 6137 - protein, 274 aa, Zea mays
  UNSURE (1)..(274): unsure at all Xaa locations
  Clone ID: PAT_MRT4577_70465C.1.pep
  unsure (1)..(274): unsure at all Xaa locations
MFFFXGCRKECAFYLVSLPVSYRYEYLMAETIFSQLLLLPNPPFKPIYYTLVIIDLCKALPGAFPSVVVGAVHALFDRISNMDMECRTRLILWFSHHLSNFQFIWPWQEWSYVKDLPKWAPQRVFVQEVLEREVRLSYFEKIKQSIEDAAELEELLPPKAGPNFKFHSDESNESTDGLKLSKELIGLIRGKKSTYDIILWVEEQIIPKNGTEFALDVVSQTLLDMGSKSFTHLVTILERYNKIISKLCPNEEMQLLLMNGVSAYWKDKYQMTAI

SEQ ID NO: 6138 - protein, 783 aa, Zea mays
  UNSURE (1)..(783): unsure at all Xaa locations
  Clone ID: PAT_MRT4577_70528C.1.pep
  unsure (1)..(783): unsure at all Xaa locations
MAKSSADDAELRRACAAAVAASGARGEEVAFSIRVAKGRGIFEKLGRLAKPRVLALTVKQSSRGEANKAFLRVLKYSSGAVLEPAKLYKLKHLTKVEVISNDPSGCTFVLGFDNLRSQSVAPPQWTMRNIDDRNRLLFCILNMCKEILSYLPKVVGIDIVELALWAKENTLTIDNQVSTQDGQETSVATQTERKVTVTVAYGIXLLERLRIHKPFVIYRLHLXHCYVIQSVNNKGLMEELDKLLERLRIPQEFAASLTGGSFEESRMLKNVEACEWLTGAIRSLEVPNLDPCYVNMRAVREKNXDREKLKTTFVRRASEFLRNYFSSLVDFMISDKSYFSQRGQLKRPDHADLRYKCRTYARLLQHLKSLDKSCLGPLRKAYCHSLNLLLRREAREFANELRASTKAPKNPAVWLEGSGGSGHNGSSSDTSQVSDAYSKMLTIFIPLLVDESSFFAHFMCFEVPALVPAGSPNANKSKSGGNDPDDDLGLMDPDGNDLKPDSTSAELGTLNEALQELLDGIQEDFYAVVDWAYKIDPLRCISMHGITERYLSGQKADAAGFVRKLLDDLESRISVQFSRFIDEACHQIERNERNVRQTGILAYIPRFAVLASRMEQYIQGQSRDLIDKAYTKLVSTMFATLEKIAQSDPKTADIVLIENYAAFQNSLYDLANVVPTLAKFYHQASESYELACTRHISSLIYLQFERLFQFNRKVDELTYTIAAEEIPFQLGLSKTDLRRVLKSSLSGIDKSISAMYRRLQKTLTSDELFPSLWDKCKKEFLDK

SEQ ID NO: 6139 - protein, 46 aa, Zea mays
  Clone ID: PAT_MRT4577_70616C.1.pep
KFVFPCFYGENVESAPPLFKKDSKLVIFFFWEEEADPMEEKAGVFF

SEQ ID NO: 6140 - protein, 391 aa, Zea mays
  UNSURE (1)..(391): unsure at all Xaa locations
  Clone ID: PAT_MRT4577_70810C.1.pep
  unsure (1)..(391): unsure at all Xaa locations
MDPWISSQPSLSLDLRVGLPPLSLHHQAPVAVALPRPKLLVEENFLLPPPKKEPEVRIYTLHSDPMCDASMHPPHLDWTETAGVTTSKDSNGLSPXLIPXAALETELQRMGEENRRLAEALAEVASKYEALRGQYTEMVAAAATACGNHPSSTSEGGSVSPSRKRKSESTDTAPPAQQLLHQHYPAVAPDQTECTSGEPCKRIREAECKPRVSKLHVHADPADLSLVVKDGYQWRKYGQKVTKDNPCPRAYFRCSFAPACPVKKKVQRSADDPTILVATYEGDHNHGQPPPQAQAPHDGSSPGASKKPPSPPRPVAAAPAPLHHQQVQQHQQQQAVGAVKCEPPVAAAASELIRRNLAEQMAMTLTRDPSFKAAFVTALSGRLFEMSPTKD

SEQ ID NO: 6141 - protein, 347 aa, Zea mays
  Clone ID: PAT_MRT4577_70811C.1.pep
MDPWISSQPSLSLDLRVGLPPLSLHHQAPVAVALPRSKLLVEENFLLPPPKKEPEVAALETELQRMGEENRRLAEALAEVASKYEALRGQYTEMVAAAATACGNHPSSTSEGGSVSPSRKRKSESTDTAPPAQQLLHQHYPAVAPDQTECTSGEPCKRIREAECKPRVSKLHVHADPADLSLVVKDGYQWRKYGQKVTKDNPCPRAYFRCSFAPACPVKKKVQRSADDPTILVATYEGDHNHGQPPPQAQAPHDGSSPGASKKPPSPPRPVAAAPAPLHHQQVQQHQQQQAVGAVKCEPPVAAAASELIRRNLAEQMAMTLTRDPSFKAAFVTALSGRLFEMSPTKD

SEQ ID NO: 6142 - protein, 172 aa, Zea mays
  UNSURE (1)..(172): unsure at all Xaa locations
  Clone ID: PAT_MRT4577_70834C.1.pep
  unsure (1)..(172): unsure at all Xaa locations
MSDSKEHHFQSKVDAGASKIYPQQAGTVRKNGFIDIXNRPCEVXQVSTSKTGMYDHAKCHFVAIDIFNEXKLEDIVPSXHNCXIPHVNRTEYHLIDISEDGFVSLLTSDGNTKDDLTLPNDDTREAQIKESFESDKDLAVTVQSAMSNEXICTLKDGVPKQLPCLGILHLTI

SEQ ID NO: 6143 - protein, 161 aa, Zea mays
  Clone ID: PAT_MRT4577_70875C.1.pep
MDGRMFGLETPLMVALQHFLDVPDGDAGAGGDKAGGGGPTRTYVRDARAMAATPADVKELPGAYAFVVDMPGLGTGDIKVQVEDERVLVISGERRREEREDAKYLRMERRMGKFMRKFVLPDNADMDKISAVCRDGVLTVTVEKLPPPEPKKPKTIEVKVA

SEQ ID NO: 6144 - protein, 165 aa, Zea mays
  Clone ID: PAT_MRT4577_70877C.1.pep
MDGRMFGLETPLMVALQHLLDVPDGDAGAGGDKASGAAAGGGPTRTYVRDARAMAATPADVKELPGAYAFVVDMPGLGTGDIKVQVEDERVLVISGERRREEREDAKYLRMERRMGKFMRKFVLPDNADMDKISAVCRDGVLTVTVEKLPPPEPKKPKTIEVKVA

SEQ ID NO: 6145 - protein, 297 aa, Zea mays
  UNSURE (1)..(297): unsure at all Xaa locations
  Clone ID: PAT_MRT4577_70979C.1.pep
  unsure (1)..(297): unsure at all Xaa locations
MAILSALATEVLIPVAAVIGIAFAVVQWVVVSRVKLSPAASGGSGGKAGYADSLIEEEEGLNDHNVVVKCAEIQNAISEGTGATSFLFTEYQYVGIFMAIFAVVIFLFLGSVEGFSTKSQPCTYSKDKYCKPALFTALFSTVSFLLGAITSLVSGFLGMKIATYANARTTLEARKGVGKAFITAFRSGAVMGFLLASSGLVVLYITINVFKLYYGDDWEGLFESITGYGLGGSSMALFGRXVGGGIYTKAADVGADLVGKVERNIPEDDPRNPAVIADNVGDNVGDIAGMGSDLFGS

SEQ ID NO: 6146 - protein, 71 aa, Zea mays
  Clone ID: PAT_MRT4577_71035C.1.pep
ERPALFFFFKVNQSCINFFGPRTTIIHKHMHTHTYTYDRLRSHAYSCITRAHTYVRAQNTVGAQYHSQTHA

SEQ ID NO: 6147 - protein, 351 aa, Zea mays
  Clone ID: PAT_MRT4577_71053C.1.pep
MMMLIDCSGCRTPLQLPHGAPCIRCAICGAVTHIAPAPPAEPNRGAVQPAPGWAPPPPPVHGRKRAVVCGISYRYSRHELKGCINDAKCMRHLLMTRFNFPDDSIIMLNEEQTDPYKIPTKHNIRMAMYWLVQGCQPGDSLVFHYSGHGSQQRNYSGDEVDGFDETLCPLDFETQGMILDDEINTALVRPLPHGVKLHALIDACHSGTALDLPYLCRMNRSGQYVWEDHRPRSGVWKGTSGGEAISFSGCDDDQTSADTSALSKITSTGAMTFCFIQAIERGQGTTYGSILNSMRSTIRNTGDSAGVGGGAVTSLITMLLTGGSLSAGGLRQEPQLTACEPFDVYAKPFSL

SEQ ID NO: 6148 - protein, 148 aa, Zea mays
  UNSURE (1)..(148): unsure at all Xaa locations
  Clone ID: PAT_MRT4577_7151C.1.pep
  unsure (1)..(148): unsure at all Xaa locations
MALSVEKTSAERGYKVKDLSQADFGRLEIELAEVEMPGLMACRAEFGPPNPFAGARISRSLHMTIQTAVLIESLTALGGEGRXDPVYFFSTQDHAXGAIARDSAAMFDWNDHTLXQYWGRTERYLDXNERGEPDLVVXDVGDTTLLEH

SEQ ID NO: 6149 - protein, 228 aa, Zea mays
  Clone ID: PAT_MRT4577_71648C.1.pep
MSTAGKTITCKAAVAWEAGKPLSIEDIEVAPPKANEVRIQIYYTGVCHTDAYTLSGKDPEGAFPIVLGHEGAGIVESIGEGVTNVKVGDHVVALYTPECKECKFCKSGKTNLCGKIRATQGKGLMPDGTSRFKCKGKDLLHFMGTSTFSQYTVVADISVVAIEHDAPMDRTCLLGCGITTGYGAATITANVQAGDNVAIFGAGCVGLSVVQGAAARKAGKIIVVTSPF

SEQ ID NO: 6150 - protein, 79 aa, Zea mays
  Clone ID: PAT_MRT4577_7168C.1.pep
RSGYGGGNGGFRCLSRCSSRGSRLGCSGRSCSTTCMSSFVRCLGRTACMRSFCRCLCRSEGSDDDDVEEDLNYGARHFP

SEQ ID NO: 6151 - protein, 56 aa, Zea mays
  UNSURE (1)..(56): unsure at all Xaa locations
  Clone ID: PAT_MRT4577_71725C.1.pep
  unsure (1)..(56): unsure at all Xaa locations
MAIKRTKAAKKIAYDKMLCSLLXDEYTNVLIALPDNVGCTQLQDIRRGLKGDSVVL

SEQ ID NO: 6152 - protein, 349 aa, Zea mays
  Clone ID: PAT_MRT4577_71847C.1.pep
MNFGGNGNATIRCKYCRASLSVIPGERAIQCAQCNCVTRIRRADRIPLARPAHVPPAFQRARGKKRAVLVGITYAGARRGCGDLRGPVNDVKCMRNLLCQRFGFPGECIIMLTDDQRDPFRLPTKENIRMAMHWLVQGCSYGDSLVFHFSGIGAQVADDDGDEADGYDEAICPLDAFQSGPILDDEINEVIVRPLVHGARLHAVVDACYSATVLDLPYQCRMSRNGFWQWEDESPPSGAWKGTSGGHAVLISGYSEGKGNFAMMPDAHASVVGAMTHSFVRTLECQPRGVTYGHLLSSMRAIMKNRGGGCDLQGAIGAPIRTVANFSGVQEPNLSSSETFDIYRKQFVL

SEQ ID NO: 6153 - protein, 381 aa, Zea mays
  UNSURE (1)..(381): unsure at all Xaa locations
  Clone ID: PAT_MRT4577_71852C.1.pep
  unsure (1)..(381): unsure at all Xaa locations
MNFGGNGNATIRCKYCRASLSVIPGERAIQCAQCNCVTRIRRADRIPLARPAHVPPAFQRARGKKRAVLVGITYAGARRGCGDLRGPVNDVKCMRNLLCQRFGFPGECIIMLTDDQRDPFRLPTKENIRMAMHWLVQGCSYGDSLVFHFSGIGAQVADDDGDEADGYDEAICPLDAFQSGPILDDEINETIVRPLVHGARLHAVVDACYSATVLDLPYQCRMSRNGFWQWEDESPPSGAWKGTSGGHAVLISGYSEGKGXRHGQGHDTYIHTADRALLPCIYLYTXMHMLLLGRRAAXMPDAHASVVGAMTHSFVRTLECQPRGVTYGHLLSSMRAIMKNRGGGCDLQGAIGAPIRTVANFSGVQVSMSNLSVSVNNNILG

SEQ ID NO: 6154 - protein, 218 aa, Zea mays
  UNSURE (1)..(218): unsure at all Xaa locations
  Clone ID: PAT_MRT4577_71853C.1.pep
  unsure (1)..(218): unsure at all Xaa locations
RVIFFILNALIWGEKSSGAVPFTTMFALVLLWFGISVPLVFVGSYLGFKKPAMEPPVKTNKIPRQIPEQAWYMNPXFTILIGGVLPFGAVFIELFFILTSIWLHQFYYIFGFLFLVFVILIITCAEITIVLCYFQLCSEDYMWWWRSYLTSGSSALYLFLYAGFYFFTKLQITKLVSGILYFGYMLLASYAFFVLTGTIGFCACFWFTRLIYSSVKID

SEQ ID NO: 6155 - protein, 399 aa, Zea mays
  Clone ID: PAT_MRT4577_71970C.1.pep
MASTDRSTPAEDEQQQKRPSLFSPYQMPRFRLAHRVVLAPMTRCRAPDAVPGPALAEYYAQRSTEGGLLISEGTIISPSGPGFPRVPGIYNQEQTDAWRKVVDAVHAKGAIFFCQLWHVGRASHQVYQPGAAAPISSTDKPISSRWRILMPDGSYGKYPTPRRLATSEIPEIVEQYRQAAINAIKAGFDGIEIHGAHGYLIDQFLKGGINDRTDEYGGSLSNRCRFLLEVTRAVVSAIGADRVAVRVSPAIDHLDAYDSNPLQLGLAVVERLNALQQEAGRLAYLHVTQPRYTAYGQTESGQHGSAEEESRLMRAVRGAYRGTFMCSGGYTRELGVEAIESGDADLVSYGRLFIANPDLVERFRRDAPLNKYVRKTFYTPDPVVGYTDYTFLGQPKARM

SEQ ID NO: 6156 - protein, 98 aa, Zea mays
  Clone ID: PAT_MRT4577_72073C.1.pep
MTGRGKGGKGLGKGGAKRHRKILRDNIQGITKPAIRRLARRGGVKRISAMIYEETRGVLKSFLEGVIRDAVTYTEHAKRKTVTLLDVVYALKRQGRTL

SEQ ID NO: 6157 - protein, 332 aa, Zea mays
  Clone ID: PAT_MRT4577_72153C.1.pep
MGECEDGKEYRCWEELLPDALGLIFRNLPLQEVLTVLPRVCKSWGRVVAGPYCWQEIDIEEWSQQQGKPEQIARMVELLVGRSAGSCRRISVSGLPCDPRFSFIGDNARALRTLEIPRSEISDSMVESVAPRLPNVTFLDISSCTKMGARGLEAFGKHCKSLAGLRRVMHPIDLADRACQHDEAHAIACSMPRLRHLEMGYMLVATEAVAEILGRCRELRFLDLRGCWAVDDKLLPRDRHPGLRVLGPRVDDCYENSYWEECSDDYSDDSSIYSWELMDDVDDDYDYAAGSDDDDDEAVWDDDGQGLENLEVRFYGGGFGETFAGFDWPPSP

SEQ ID NO: 6158 - protein, 339 aa, Zea mays
  Clone ID: PAT_MRT4577_72159C.1.pep
MLQGSEVMGECEDGKEYRCWEELLPDALGLIFRNLPLQEVLTVLPRVCKSWGRVVAGPYCWQEIDIEEWSQQQGKPEQIARMVELLVGRSAGSCRRISVSGLPCDPRFSFIGDNARALRTLEIPRSEISDSMVESVAPRLPNVTFLDISSCTKMGARGLEAFGKHCKSLAGLRRVMHPIDLADRACQHDEAHAIACSMPRLRHLEMGYMLVATEAVAEILGRCRELRFLDLRGCWAVDDKLLPRDRHPGLRVLGPRVDDCYENSYWEECSDDYSDDSSIYSWELMDDVDDDYDYAAGSDDDDDEAVWDDDGQGLENLEVRFYGGGFGETFAGFDWPPSP

SEQ ID NO: 6159 - protein, 106 aa, Zea mays
  UNSURE (1)..(106): unsure at all Xaa locations
  Clone ID: PAT_MRT4577_72196C.1.pep
  unsure (1)..(106): unsure at all Xaa locations
FVGERIEMAAXDVEYRCFVGGLTWATDDHSLHNAFSTYGEDLEYKIMLDRETQRSRGLRYVPFSTEEAMRNAIKGMNGKELYGSNMTVNDAQSXGGRGCGSGGYGG

SEQ ID NO: 6160 - protein, 270 aa, Zea mays
  Clone ID: PAT_MRT4577_72198C.1.pep
MGRGKVQLKRIENKINRQVTFSKRRNGLLKKAHEISVLCDAEVAVIVFSPKGKLYEYASDSRMDKILERYERYSYAEKALISAESESEGNWCHEYRKLKAKIETIQRCHKHLMGEDLESLNPKELQQLEQQLESSLKHIRSRKSHLMAESISELQKKERSLQEENKALQKELSERQKAVASRQQQQQQVQWDQQTQVQVQTSSSSSSFMMRQDQQGLPPPQNICFPPLSIGERGEEVAAAAQQQLPPPGQAQPQLRIAGLPPWMLSHLNA

SEQ ID NO: 6161 - protein, 94 aa, Zea mays
  Clone ID: PAT_MRT4577_72272C.1.pep
GRVGGRVGRHRMVLRDNIQGVTKPAIRRLARRGGVKRISGLIYEETRGVLKIFLENVIRDAVTYTEHARRKTVTAMDVVYALKRQGRTLYGFGG

SEQ ID NO: 6162 - protein, 66 aa, Zea mays
  UNSURE (1)..(66): unsure at all Xaa locations
  Clone ID: PAT_MRT4577_72299C.1.pep
  unsure (1)..(66): unsure at all Xaa locations
MFGRGKGSKGLGKGGAKRHRKVLRDNLXQCITKPAIPKLAPKGGVKRISGLIYEETRGVLKIFLEN

SEQ ID NO: 6163 - protein, 105 aa, Zea mays
  UNSURE (1)..(105): unsure at all Xaa locations
  Clone ID: PAT_MRT4577_72350C.1.pep
  unsure (1)..(105): unsure at all Xaa locations
PPVSSVCENPIFKPYRIQQALAACFLPXSPLVLQHPSXALLQQLPLQHLLAQNFKAQHLHQLGLGNLAAYFRHQKFLPFNQLADXNSGAYWQQNLPLSQLAAAYP

SEQ ID NO: 6164 - protein, 110 aa, Zea mays
  UNSURE (1)..(110): unsure at all Xaa locations
  Clone ID: PAT_MRT4577_72434C.1.pep
  unsure (1)..(110): unsure at all Xaa locations
RFQKGGFVKTHKTNAXYFKRYXQCKFKRRRAGQTHYMARIRLVNQDKNKSNTPKYRFVVRFTNKDIIGPIIYGSIAGDMVLASAYXDEVPRHGLEDGLTNYSDAYCTGLL

SEQ ID NO: 6165 - protein, 128 aa, Zea mays
  UNSURE (1)..(128): unsure at all Xaa locations
  Clone ID: PAT_MRT4577_72545C.1.pep
  unsure (1)..(128): unsure at all Xaa locations
SARGVGCYTPCGSGTGSRGSPESGFVGERTETAASDCEYRCFAGGLGWATDDHCLHNAYSTYXEVLWSKIILDRETHRSRGYGFVTFSTDEAMQNAIEGMNGKELDGLNITVNEAHTRSRRRSGSSSC

SEQ ID NO: 6166 - protein, 183 aa, Zea mays
  UNSURE (1)..(183): unsure at all Xaa locations
  Clone ID: PAT_MRT4577_72561C.1.pep
  unsure (1)..(183): unsure at all Xaa locations
MGLSVDNTSSGRQHXVKELSHEDFVRLEIELXQAEMPGLMACRAEFGPSNPFAGARMSVALHMTIQTAVLIKTLTAVGAEVRWCSCKIFSTQDHGVAVIARDSGAEFAWKAETLDEDCGGNHRCLDXGKEGGPYLIIDDGGKSTLLIHKDDKAKDDYENTGQRPHPENIDNAEFKTAVTIIRD

SEQ ID NO: 6167 - protein, 230 aa, Zea mays
  UNSURE (1)..(230): unsure at all Xaa locations
  Clone ID: PAT_MRT4577_7259C.1.pep
  unsure (1)..(230): unsure at all Xaa locations
LSAADASTVYAITVEGYXERRLGITXSEAPVFMDPHGSGMRALSRSLIXSVLDLGRCTIVSXLSNMDFESYVLSESSSLIYPLEIVVXTCGTTKLLFTIPRILELAQXLFIPVADMKYSRVTVIFPTEQSSPQMSLSDEVAALNRYFGELKSDGDAYVIRDPPTAGQKWHVFYASEYPEIAMWNLEMRMTVLDEMTASVLFKTNADGNSICVKDMTKISGISEMILGMEI

SEQ ID NO: 6168 - protein, 100 aa, Zea mays
  UNSURE (1)..(100): unsure at all Xaa locations
  Clone ID: PAT_MRT4577_72622C.1.pep
  unsure (1)..(100): unsure at all Xaa locations
SCRYVLLTRTQFIPFKHLXAALISLVYLHKQQVLPFSQLDGVSXTTFLIQPXQLFPFXQHDAPXFGTLIQLQQLLXPFNQLAFTNPAAFYQQPIIGGAFF

SEQ ID NO: 6169 - protein, 112 aa, Zea mays
  Clone ID: PAT_MRT4577_7264C.1.pep
RETGRSPGLGFVTFSSENSMFDAIEKINGKELAGRNIPVNQAQSLSGAGGAGGYGGGSGGGGYGGGPRDGGYGGGGGYPGRPKGGGAGYKNGGGYAGRPKGGGGGYGGGGGG

SEQ ID NO: 6170 - protein, 53 aa, Zea mays
  Clone ID: PAT_MRT4577_72741C.1.pep
SCGARAAKLSCSLHVMFTLVQRVYLRSCRVCMLTICVIDCKVDLCQLLVLCSS

SEQ ID NO: 6171 - protein, 275 aa, Zea mays
  UNSURE (1)..(275): unsure at all Xaa locations
  Clone ID: PAT_MRT4577_72742C.1.pep
  unsure (1)..(275): unsure at all Xaa locations
KSHGPKRDDGPVILVVNACASRDLHDDVVGVCFVAQDMTVHKLVMDKFTRVEGDYMAIIHNPNPLIPPIFGADEFGWCCEWNAAMTKLTGWHREEVLDKMLLGEVFDSRNASCLLKNKDAFVSLCVVINSALAGEETEKAPFGFFDRSGKYTECLLSVNRRQNEGGLITGVFCFIHIPSHELQQALQVQQASEQKSLKRLKAFSYMRHAINNPLSGMLYSRKALKNTDLNEEQMRQIHVADNCHHQLNKILADLDHXNIMEKSXCLDLEMAEIVL

SEQ ID NO: 6172 - protein, 209 aa, Zea mays
  UNSURE (1)..(209): unsure at all Xaa locations
  Clone ID: PAT_MRT4577_72813C.1.pep
  unsure (1)..(209): unsure at all Xaa locations
MAMLVDPPNGMGNQGKHYYSMWQTLFEIDTKYVPIKPIGRGASGIVCSSINRETNEKVAIKKIHNVFDNRVDALRTLRELKLLRHLRHENVISLKDIMMPVQRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLXCC

SEQ ID NO: 6173 - protein, 61 aa, Zea mays
  UNSURE (1)..(61): unsure at all Xaa locations
  Clone ID: PAT_MRT4577_72949C.1.pep
  unsure (1)..(61): unsure at all Xaa locations
MVPEQKVVKKAPAGLPGGAGPKKNPVSRSLKAGLNFPLGLIGRNLNQVRXSNLVGTGAPFN

SEQ ID NO: 6174 - protein, 117 aa, Zea mays
  Clone ID: PAT_MRT4577_72974C.1.pep
GGFSSPSGRVRFARFSGFGFGVSDRDGGVDVEYRCSGRLPGPRTTTPSQRLSTYGRSSSPRSSLSERRIGPRLGFSPYDGGCDAERHQGMNGRSWTAASSPATGESRAAGRRCREVR

SEQ ID NO: 6175 - protein, 111 aa, Zea mays
  Clone ID: PAT_MRT4577_73333C.1.pep
TASISSPAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6176 - protein, 129 aa, Zea mays
  Clone ID: PAT_MRT4577_73338C.1.pep
RARSHKSSCSSSPQPNSSHSGETLGDVWRVARAYKGLGKGGAKRHRKVLRDNIQGITNPAIRRLARRGGDKRISGLIYEETRGVLKIFLENVMRDAVTYTEHARRKTVTVMDAVYAPKRQGRTLYGFGG

SEQ ID NO: 6177 - protein, 93 aa, Zea mays
  Clone ID: PAT_MRT4577_73341C.1.pep
MGGRIKGGKGLRKAGANRHRKVLRDNIQGITKPAIRRLDRRGGVKRISVLIYDETRSVLKIFLENVIRDADTYTEHARRKTVTAMDVSYALKR

SEQ ID NO: 6178 - protein, 112 aa, Zea mays
  UNSURE (1)..(112): unsure at all Xaa locations
  Clone ID: PAT_MRT4577_73343C.1.pep
  unsure (1)..(112): unsure at all Xaa locations
MYHHLSKSTSNPXILRVRATMSGRGKGGKGLGKGGAKRHRKVLRDNIQGITKPAIRRLARRGGVKRISGLIYEETRGVLKIFLENVLRDAVAYTNHDRRKSDAAMHVVFFFF

SEQ ID NO: 6179 - protein, 125 aa, Zea mays
  Clone ID: PAT_MRT4577_73345C.1.pep
EAGRDLFLIPPANPQFLRVRATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6180 - protein, 508 aa, Zea mays
  Clone ID: PAT_MRT4577_73424C.1.pep
MAGDGMEVSASGGGGGNKQPQISLLGLFLACMVAGGVQYGWALQLSLLTPYVQTLGIPHALTSVMWLCGPIAGLLVQPCVGLYSDKCTSKLGRRRPFIFTGCIIICISVIVIGFSSDIGYALGDTTEDCNVYTGKRLHAALFFVMGFWLLDFSNNTVQGPARALMADLAGSHGPSTANAIFVSWMAIGNILGYSSGSTDKWHTWFPFLQTRACCEACANLKAAFLVSVVFLGLSTVVTMIFAREVPLDPAAAAKQDEAGESSGPFAVFKGMKNMPPGMPQVLIVTGLTWLSWFPFILFDTDWMGREMYHGRPDGSPEEVARFQEGVRQGAFGLLLNSVVLGASSFLIEPMCRKLTAKVVWVMSSFLVCVAMALVTVLSSWSLGDIGGNVQDAAAVDKGLKTTALAIFVFLGFPFAVLCSVPFAVTAQLAAAKGGGQGLCTGVLNISIVVPQMVIAIGSGPWDELFGKGNIPAFGLAAVFAFTAAVAGIIMLPKQPKTSFRSVSMGGGH

SEQ ID NO: 6181 - protein, 106 aa, Zea mays
  UNSURE (1)..(106): unsure at all Xaa locations
  Clone ID: PAT_MRT4577_73505C.1.pep
  unsure (1)..(106): unsure at all Xaa locations
MAEEKHHHHHLLHLYLDEEQDEQVAGGGYGESAEYTEGTETEVLSTGENEYHEHKKEDKQDKHKQHLXMAATSAPAAVALFEXHEAIMDPELSHRHKIYVEVAGAA

SEQ ID NO: 6182 - protein, 183 aa, Zea mays
  Clone ID: PAT_MRT4577_73523C.1.pep
MINLFKIKGQKKEEAASAAGKAPVKKQSAGELRLHKDISELNLPKTTSISFPNGKDDLMNFETTIRPDEGYYMGGTFVFTFQVSPSYPHDPPKVKCKTKVYHPNIDLEGNVCLNILREDWKPVLNINTVIYGLNLLFTQPNDEDPLNHEAAVVLRDNPKMFEANVRRAMAGGYVGQHYFQRCA

SEQ ID NO: 6183 - protein, 183 aa, Zea mays
  Clone ID: PAT_MRT4577_73526C.1.pep
MINLFKIKGQKKEEAASAAGKAPVTKQSAGELRLHKDISELNLPKTTSISFPNGKDDLMNFETTIRPDEGYYMGGTFVFTFQVSPSYPHDPPKVKCKTKVYHPNIDLEGNVCLNILREDWKPVLNINTVIYGLNLLFTQPNDEDPLNHEAAVVLRDNPKMFEANVRRAMAGGYVGQHYFQRCA

SEQ ID NO: 6184 - protein, 83 aa, Zea mays
  UNSURE (1)..(83): unsure at all Xaa locations
  Clone ID: PAT_MRT4577_73530C.1.pep
  unsure (1)..(83): unsure at all Xaa locations
MAAADVEYRCLKSXLACATSNESVENAFDFYGEILDSKVITDRETGRLRGFGLITFSCENSMLDAIENMNRKEIYGRYITVNQ

SEQ ID NO: 6185 - protein, 92 aa, Zea mays
  Clone ID: PAT_MRT4577_73591C.1.pep
IGLENGNYTVTLQFAEVDFPDMQSWRSRGRRVFDIYVQGERKEQNFDIRKAAGGKSFTAVKKQYVVPVTKNFLEIHLFWAGKGTCCIPYKGY

SEQ ID NO: 6186 - protein, 96 aa, Zea mays
  Clone ID: PAT_MRT4577_73654C.1.pep
MLYAIENMNGKELDGGNITVNQAQSRDGGGADGDYADGLGGDAYGGGHRDAGFVDGVAYGGRHEGGDDGSGAGGGYDGRHKGGGDASVGGDGGWRN

SEQ ID NO: 6187 - protein, 273 aa, Zea mays
  Clone ID: PAT_MRT4577_73837C.1.pep
MYKQGGAGGGAGLDRKRINDALDKHLEKAVASPSTSRGSAGGGRDHHRLVVPSSVSSIPKGRCSEGESDSDSEASDVSGSDGEDTSWISWYCNLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYEHLKPQKLSQRYVPRVFGFKLHKP

SEQ ID NO: 6188 - protein, 70 aa, Zea mays
  Clone ID: PAT_MRT4577_73990C.1.pep
FESARICDGILALVDSHLVPSAGGAESKVFYLKMKGDYHRFLAEFKSGAERKDAVDSSMNVFKADQVIVL

SEQ ID NO: 6189 - protein, 79 aa, Zea mays
  UNSURE (1)..(79): unsure at all Xaa locations
  Clone ID: PAT_MRT4577_74051C.1.pep
  unsure (1)..(79): unsure at all Xaa locations
PQHPRHEGQSPDDREGGGGGYGGDRGGXGYGGGGHRDGGGGYGGGDGYGGGGVYGGGGGGYGGGNRGGGYGNSDGNWRN

SEQ ID NO: 6190 - protein, 124 aa, Zea mays
  UNSURE (1)..(124): unsure at all Xaa locations
  Clone ID: PAT_MRT4577_74152C.1.pep
  unsure (1)..(124): unsure at all Xaa locations
AGLDPNMPKRATNAFFEFMEECRLEFNDKNPNNKAAAAVSKAAGDRCKSLSESVKAPYVANANKLKLEYNKAISAYIKGESTAANKAAAKEDEEDDDEDSDTSXSDVNDEDDEEGIEDDADVDK

SEQ ID NO: 6191 - protein, 53 aa, Zea mays
  Clone ID: PAT_MRT4577_7455C.1.pep
MAGEEAKKVEVEVTKEPEAAAKEDVADDKAVIPSTDPPPSPPSADDSKALAIV

SEQ ID NO: 6192 - protein, 55 aa, Zea mays
  Clone ID: PAT_MRT4577_74610C.1.pep
MAAKIFCLNMLPGLSANAATASIFPQCSQTPIAFLFSPYLSPAMCLVCENTILLP

SEQ ID NO: 6193 - protein, 906 aa, Zea mays
  UNSURE (1)..(906): unsure at all Xaa locations
  Clone ID: PAT_MRT4577_7471C.1.pep
  unsure (1)..(906): unsure at all Xaa locations
MPSSSPCYRHSFLFLALLSACFSTPGAADGTGGAGDGGDAAAMQALRRDLAPPGWGPGADHCAWRGVTCAARNEISGQIPIEMRGMLRLIEVNLSNNRLALARLDLSANSLSGGLSPAFGALTRLEYLDLSMNALTGAVPAALAGASALRFLNLSNNALSGAIPDDLRGLKKLQELQISGNNLTGSLPGWLARLPGLRVLSAYENALSGPIPPGLGLSSELQVLNLHSNALEGSIPSSLFELGNLQVLILTMNRLNGTIPDTIGRCRGLSNVRIGDNLLSGAIPASIGDATGLTYFEANTNDLSGGIPTQFARCANLTLLNLAYNRLAGEVPDVLGELRSLQELIVSGNGLCGEFPKSILRCRNLSKLDLSYNAFRGGLPESICNGSRMQFLLLDHNEFSGGIPAGIGGCTRLLELHLGSNNLSGEIPAEIGKVKSLQIVLNLSFNHFTGPLPHELGRLDKLVMLDXCRSRGAGQMLAVLRVAMLCTERAPAXAPDEEGGGNAAGGQGQLSGLVPLXSMMCGWLXELGTLEVEARNSELIIVGVRVWSPSGXLICVLIFSLVSLLVALFMWRERQEKEEEEAKKKAAEVAVAAAAPQVVASAVFVESLQQAIDFQSCVKATFKDENEVGNGTFSTTYKAVMPSGMVVCVKKLKSVDRAVIHQQTKMIRELERLAHINHKNLVRPVGYVIYDDVALLLHQHMLNGTLLQLLHSSGGDTDGKKQKPDWPRLLSIAIDVAEGLAFLHQVATIHLDICSGNVFLDSHYNALLGEVEISKLLDPSKGTASISTVAGSFGYIPPEYAYTMQVTVPGNVYSYGVVLLEILTSKLPVDDVFGEGVDLVKWVHTAPARGETPEQIMDPRLSTVSFAWRRQMLAVLKVAMLCTERAPAKRPRMRKVVEMLQEAKNS

SEQ ID NO: 6194 - protein, 287 aa, Zea mays
  Clone ID: PAT_MRT4577_74755C.1.pep
MRPVFCGNLDYDVRISEVERLFGKYGRVERVDLKTGFAFIYMEDERDAEDAISRLDGIDFGRKGRRIKVEWTKEDRTADRRGNSRRSPTNAKPTKTLFVINFDPINTRIRDLERHFDKYGRVANVRIKKNFAFIQFEAQEDATRALEGANGSHFMDRVISVEYALRDDDEKGERATNGYSPDRRGRERSPGARRSPSPYGRGRERGSPDYGRGKERGSPDYGRGGRSPDNGRGGRPAGGGGGGRGDHARGGGRRRSPDYYDRERREASPGYDRPPSCSPGTGRDARD

SEQ ID NO: 6195 - protein, 121 aa, Zea mays
  UNSURE (1)..(121): unsure at all Xaa locations
  Clone ID: PAT_MRT4577_74826C.1.pep
  unsure (1)..(121): unsure at all Xaa locations
MAARSSSQQLVAASDLASWLLLLAAGAGTASAAASCGQVTSSLASCLGYAMGSAPSPSAACCSAVCSLNSRASSTANRHATCNXLKSMTXARLRXFTMANASNIPGKCGVSGGVPIRPTVD

SEQ ID NO: 6196 - protein, 461 aa, Zea mays
  Clone ID: PAT_MRT4577_74831C.1.pep
MQSLLMPTAASAPVAAPRARRNLPMRLSVRASATAAAAPRRETDPKKRVVITGMGLVSVFGNDVDAYYDRLLAGESGIGPIDRFDASKFPTRFAGQIRGFSSEGYIDGKNDRRLDDCLRYCIVSGKKALEAAGIAHGSKPMEKIDKTRAGVLVGTGMGGLTVFSDGVQNLIEKGYRKITPFFIPYAITNMGSALLGMDIGFMGPNYSISTACATSNYCFYAAANHIRRGEADIMIAGGTEAAIIPIGVGGFVACRALSQRNDDPKTASRPWDKDRDGFVMGEGAGVLVMESLEHAIKRDAPIIAEYLGGAVNCDAYHMTDPRSDGLGVSSCIKQSLKDAGVAPEEVNYINAHATSTLAGDLAEVNAIKQVFKDPSGIKINATKSMIGHCLGAAGGLEAIATVKAITTGWVHPSINQFNPEEAVEFDTVPNVKKQHEVNVGISNSFGFGGHNSVVVFAPFKP

SEQ ID NO: 6197 - protein, 461 aa, Zea mays
  Clone ID: PAT_MRT4577_74832C.1.pep
MQSLLLPTAAVAPVAPPCGRRNLPGRLSVRASATVVAAPRRETDPKKRVVITGMGLVSVFGNDVDAYYDRLLVGESGIGPIDRFDASKFPTRFAGQIRGFSSEGYIDGKNDRRLDDCLRYCIVSGKKALEASGIAHGSKPMEKIDKTRAGVLVGTGMGGLTVFSDGVQNLIEKGYRKITPFFIPYAITNMGSALLGMDIGFMGPNYSISTACATSNYCFYAAANHIRRGEADIMIAGGTEAAIIPIGVGGFVACRALSQRNDDPKTASRPWDKDRDGFVMGEGAGVLVMESLEHAMKRDAPIIAEYLGGAVNCDAYHMTDPRSDGLGVSSCIKQSLKDAGVAPEEVNYINAHATSTLAGDLAEVNAIKQVFKDPSGIKINATKSMIGHCLGAAGGLEAIATIKAITTGWVHPSINQFNPEEAVEFDTVPNVKKQHEVNVGISNSFGFGGHNSVVVFAPFKP

SEQ ID NO: 6198 - protein, 86 aa, Zea mays
  Clone ID: PAT_MRT4577_7483C.1.pep
PSSSCRRLPKAPVADFIEVADVMLERNMLSTGVPEVHRAGLEHVTAPPVRPSSTQDPRVSTHRSLSPAGVFQDAWSGRHYNTTHYR

SEQ ID NO: 6199 - protein, 159 aa, Zea mays
  UNSURE (1)..(159): unsure at all Xaa locations
  Clone ID: PAT_MRT4577_74969C.1.pep
  unsure (1)..(159): unsure at all Xaa locations
MDSTAAGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLSGVTIAHGGVLPNINPVLLPKKTAEKASXGGSKEAKSPKKAAKSPKKA

SEQ ID NO: 6200 - protein, 74 aa, Zea mays
  Clone ID: PAT_MRT4577_75055C.1.pep
KLCFRPYRELLLAGCLRRRDWDAIDSGGIVNTGGVNDYPGKLTLFMEITCIVDDTGGLIFGYDIGILSGVTCMN

SEQ ID NO: 6201 - protein, 93 aa, Zea mays
  UNSURE (1)..(93): unsure at all Xaa locations
  Clone ID: PAT_MRT4577_75338C.1.pep
  unsure (1)..(93): unsure at all Xaa locations
MALYVDNTSYGREYNVQDLXQAHLARLEIDLAQVEMPELMACPAQFGPSKPFAGARISASLHMTIHTGELIETLTALDAEVRWCSCNIFFTQD

SEQ ID NO: 6202 - protein, 50 aa, Zea mays
  UNSURE (1)..(50): unsure at all Xaa locations
  Clone ID: PAT_MRT4577_75455C.1.pep
  unsure (1)..(50): unsure at all Xaa locations
MAVTITWVKARHILYRRRNPTVXEDLCLNDCSYSRRARPSIASTGIYEAL

SEQ ID NO: 6203 - protein, 104 aa, Zea mays
  Clone ID: PAT_MRT4577_75495C.1.pep
SGLLISSLSLLFLRPWWMRGTPSITSAVRSSRTPIDQVDVNDMELLNSLLGRNNHDYDQHKKKLTDKLATSMDKVTVSEPDKHGHKDDEHDVIGDNNEGLIDNL

SEQ ID NO: 6204 - protein, 300 aa, Zea mays
  Clone ID: PAT_MRT4577_75511C.1.pep
MNSQTKPYNKAQQNTIKDCINGSHAISLTPIGSTTTTTTTKHWVPRGRPGRGGPLCLFLFLPPLSPSFLLLPAPLTQPPAMSVETERSSTESSGASGLDFEDTALTLTLRLPGSAPSAAAAAAASLSLSSSSSSAFPDPDRKRASSDADPGRSSPLAASSDAAPAPKARVVGWPPVRSYRKNALADAAGSSKAAKFVKVAVDGAPYLRKVDLQAYAGYDQLLRALQDKFFSHFTIRKFADDERKLVDAVNGTEYVPTYEDKDGDWMLVGDVPWKMFVETCQRLRLMKGSEAVNLAPRAAR

SEQ ID NO: 6205 - protein, 62 aa, Zea mays
  UNSURE (1)..(62): unsure at all Xaa locations
  Clone ID: PAT_MRT4577_75526C.1.pep
  unsure (1)..(62): unsure at all Xaa locations
YRCFVVVLVCTTDDHSLHNAFSSDGDVLXSKIIRDRENHRSLGFVFFTCSTDYAIRNAIEVM

SEQ ID NO: 6206 - protein, 73 aa, Zea mays
  Clone ID: PAT_MRT4577_75536C.1.pep
EAQSRSGRGCFGGGYGGGREWGCYGCGGRRDGSGGYGGGGSYRGGCGYRGGGSGYCGGNRGGSYGNSHGNWRN

SEQ ID NO: 6207 - protein, 67 aa, Zea mays
  Clone ID: PAT_MRT4577_75564C.1.pep
GLYSRSIPSTSSKGSPCVHPQRSFPSAQRLLYPGLPIACFRESGNGSRFSPSLAFFMFACFNHPFVF

SEQ ID NO: 6208 - protein, 352 aa, Zea mays
  Clone ID: PAT_MRT4577_75661C.1.pep
MGDAAAAAASTSAPTTPTSILICLEDGSDLLADADDGAGTDLVVARDERLLVVDQDEEYVALLLSKESASGGGGPVEEMEDWMKAARSGCVRWIIKTTAMFRFGGKTAYVAVNYLDRFLAQRRVNREHAWGLQLLMVACMSLATKLEEHHAPRLSELPLDACEFAFDRASVLRMELLVLGTLEWRMVAVTPFPYISCFAARFRQDERRAVLVRAVECVFAAIRAMSSVEYQPSTIAVASILVARGRETPAGNLDALKAILGSSFPQLDTGHVYSCYSAMIREDDKSPTQSTSTSTGVASSGVSVAAHAGGSGSPSPPGASVSVGANNAAGTAPPATTDNRNKRRRLRSPQRQ

SEQ ID NO: 6209 - protein, 243 aa, Zea mays
  UNSURE (1)..(243): unsure at all Xaa locations
  Clone ID: PAT_MRT4577_75907C.1.pep
  unsure (1)..(243): unsure at all Xaa locations
MEAGGAGAEGVMRVLLVDDSPVDRRVAQLLLSSNSCAGSFHVIAVDSAKKAMEFLGLKDGGKEQAIDMVLTDYCMPEMTGYDLLKAIKALNPLKPIPVIVMSSEDEPQRISRCLNAGAEDFIVKPLQSKDVQRLRNCSTVGRPSNXAAPRCRARRTXAKWSNNKLPPSAGAGAGASATSPSGRRANLAGVAMRQVLHSSRVEISQYLPLLLKLVVLAYAALCLGELLHRWSSGGSCSLSPWCA

SEQ ID NO: 6210 - protein, 553 aa, Zea mays
  Clone ID: PAT_MRT4577_75935C.1.pep
MDGDFEMPPAGADDMMGDDEMGDFGGDEGPVMKVGEEKEVGKEGLKKKLLKEGEGWETPEVGDEVEVHYTGTLLDGTKFDSSRDRGEPFKFKLGQGQVIKGWDQGIKTMKKGENAIFTIPPELAYGASGSPPTIPPNATLQFDVELLSWTSVKDICKDGGIFKKILKEGEKWENPKDPDEVLVKYEACLEDGTVVSKSEGVEFTVKDGYFCPALAKAVKTMKKAEKVLLTVKPQYGFGEKGRPAAGEEGAVPPNASLLIDLELISWKTVTEIGDDKKILKKVLKEGEGYERPNEGAVVEVKIIGKLLDGAVFTKKGHDEELFKFKTDEEEVIAGLDRAVLNMKKGEVALVTIPPEYAFGSPASTQDLAVVPPNSTVIYEVELISFVKDKESWDLNNEEKIEAAGKKKEEGNALFKSGKYTRASKRYEKAAKYIEYDTSFSEDEKKQSKQLKISCNLNNAACKLKLKDYKEAAKLCTKVLELDSQNVKALYRRVQAYIQLADLELAEADIKKALEIDPDNRDVKLEYKILKEKIKEYNKKDAKFYSNMFAKMTK

SEQ ID NO: 6211 - protein, 559 aa, Zea mays
  Clone ID: PAT_MRT4577_75937C.1.pep
MDEDFEMPPAGADEMMGDDEMGDFGGDEGPVMKVGEEKEVGKEGLKKKLLKEGEGWETPEVGDEVEVHYTGTLLDGTKFDSSRDRGEPFKFKLGQGQVIKGWDQGIKTMKKGENAIFTIPPELAYGASGSPPTIPPNATLQFDVELLSWTSVKDICKDGGIFKKILKEGEKWENPKDPDEVLVKYEARLEDGTVVSKSEGVEFTVKDGYFCPALAKAVKTMKKAEKVLLTVKPQCEIPFQDGFGEKGRPAAGEEGAVPPNASLLIDLELISWKTVTEIGDDKKILKKVLKEGEGYERPNEGAVVEVKIIGKLQDGAVFTKKGHDEEPFKFKTDEEEVIAGLDRAVLNMKKGEVALVTIPPEYAFGSTESKQDLAVVPPNSTVIYEVELISFVKDKESWDLNNEEKIEAAGKKKEEGNALFKSGKYARASKRYEKAAKYIEYDTSFSEDEKKQSKQLKISCNLNNAACKLKLKDYKEAAKLCTKVLELDSQNVKALYRRVQAYIQLADLELAEADIKKALEIDPDNRDVKLEYKILKEKIKEYNKKDAKFYSNMFAKMTK

SEQ ID NO: 6212 - protein, 99 aa, Zea mays
  Clone ID: PAT_MRT4577_75952C.1.pep
TNDLPHMTFVSSRDDVGKCMAFYFAQGILQHDPFKVLDQRGVADLLNFATERGLNASPNLKVAICGKHGGKPSSVAFFTKAGLNYLSCPPFRVPIARLT

SEQ ID NO: 6213 - protein, 210 aa, Zea mays
  UNSURE (1)..(210): unsure at all Xaa locations
  Clone ID: PAT_MRT4577_7601C.1.pep
  unsure (1)..(210): unsure at all Xaa locations
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEXMKMGXVEVYHNLKSIIKKKYGQD

SEQ ID NO: 6214 - protein, 65 aa, Zea mays
  Clone ID: PAT_MRT4577_76050C.1.pep
RMYRDNGHGHRRTQAPGLSLLLIHPLRGQWSLRCHTGPLRAREARRWWWSRSLEAQVIRLTIENW

SEQ ID NO: 6215 - protein, 90 aa, Zea mays
  Clone ID: PAT_MRT4577_76057C.1.pep
KGTLYRMLLIFIAQISLQFRDLTVVTTGLLCNKDLVYPQYDPKCDLFCYLWKVTEKKMANPYMRYKQFVSILLEMSDFACQSFIVCPPVF

SEQ ID NO: 6216 - protein, 127 aa, Zea mays
  UNSURE (1)..(127): unsure at all Xaa locations
  Clone ID: PAT_MRT4577_7607C.1.pep
  unsure (1)..(127): unsure at all Xaa locations
PYLSPAVSSVCANPILGPWRIQQASAAGILPLSPMFLQQLSSLLQQSPLVHLLAQNIMAHQLPQLVLAYLAAYYQHQQHISFNQLGSLNSGSYLQQLQLPFNQLPACLRXQSTPFNQLASFNSFAYL

SEQ ID NO: 6217 - protein, 237 aa, Zea mays
  UNSURE (1)..(237): unsure at all Xaa locations
  Clone ID: PAT_MRT4577_76608C.1.pep
  unsure (1)..(237): unsure at all Xaa locations
MAAAAVAADSKIDNLRDAVAKLGEISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGQTGKDGWYPPGHGDVFPSLNNRGKLDTLLSQXGKEYVFVANSDXLGAIVDIKI

SEQ ID NO: 6218 - protein, 92 aa, Zea mays
  UNSURE (1)..(92): unsure at all Xaa locations
  Clone ID: PAT_MRT4577_76677C.1.pep
  unsure (1)..(92): unsure at all Xaa locations
WRDRPRCCHMWRPYRLPPSFHVPPPVRLPPPPCHYPTQPPRAQPHPQPHPXPCQQPHPSPGQLQETCELDNTPILRKRGKVLRNQYRPTTTA

SEQ ID NO: 6219 - protein, 406 aa, Zea mays
  Clone ID: PAT_MRT4577_76736C.1.pep
MNGASAGAGGEAPLVYKAWKGNNVFLLKGRFIFGPDARSLFITMFLIVAPVSIFCAFVAKELMDKFSYGLGLPVMIAAVLFTAYDLSLLLLTSGRDPGIIPRNAHPPEPEGFDGNAEVGANQTPPVRLPRVKDVVVNGITVKTKYCDTCMLYRPPRCSHCSICNNCVERFDHHCPWVGQCIGLRNYRFFYMFVFSTTLLCLYVFGFCWVFIIKIRNAEQITIWKAMTKTPASIALIIYTFIAVWFVGGLSVFHLYLMSTNQTTYENFRYRYDQRDNPYNKGVMENIKEIFFTTIPPSKNNFCGRVEQEHGLRPRPTNGFMSPNMGRAVGDIEMGRKPVAWDEPRMAAEIGDLGAGLSNLLEDKDGRFRTTSPDLSRDALAVGGGLEEHGSSAMNPGRSSWGVEAGR

SEQ ID NO: 6220 - protein, 273 aa, Zea mays
  UNSURE (1)..(273): unsure at all Xaa locations
  Clone ID: PAT_MRT4577_76902C.1.pep
  unsure (1)..(273): unsure at all Xaa locations
GPPLKXGPWTSAEDAILVDYVKKHGEGNWNAVQKNTGLFRCGKSCRLRWANHLRPNLKKGAFTPEEERLIIQLHSKMGNKWARMAAHLPGRTDNEIKNYWNTRIKRCQRAGLPIYPASVCNQSSNEDQGSSDFNCGENLSSDLLNGNGLYLPDFTCDNFIANSEALSYAPQLSAVSISSLLGQSFASKNCGFMDQVNQAGMLKQSDHLLPGLSDTINGALSSVDQFPNDSEKLKKALGFDYLHEXNSSSKTIAPFGGALTGXHXLXNGTFSTS

SEQ ID NO: 6221 - protein, 41 aa, Zea mays
  Clone ID: PAT_MRT4577_76926C.1.pep
QCPKHTKLSHLTALLRQGMCLSILLELPLPMPHFLIRMRYS

SEQ ID NO: 6222 - protein, 160 aa, Zea mays
  Clone ID: PAT_MRT4577_77005C.1.pep
MIAIKRVNCFHRDGYGAAGCNPSGSTYMVVFGLFQLLLSQLPSLLRTSSSSSPPPTLAVAPLKLVLRTIVIMFTTLVAMLVPFFNAVLGLIGALGFWPLSVYFPVSMHMARLNIRRGEIRWWMLQAMSFVCLLISVAASIGSVHDIVHNLKAAAPFNTAN

SEQ ID NO: 6223 - protein, 75 aa, Zea mays
  UNSURE (1)..(75): unsure at all Xaa locations
  Clone ID: PAT_MRT4577_77107C.1.pep
  unsure (1)..(75): unsure at all Xaa locations
CKQKLVANALLAVSLAVCKALAMVKMITVXQHIGNLAGNKNMVLPVPALNAINGRSHAGNKLAMQEFMILPTGSL

SEQ ID NO: 6224 - protein, 80 aa, Zea mays
  Clone ID: PAT_MRT4577_7710C.1.pep
EEGSKLLQYVYWSNGREAENPRVGNKQCPGKNFVVLVGRLLLVELFLRYDTFPPEVGKELLGTRVIFPGVTKATSGPGSE

SEQ ID NO: 6225 - protein, 399 aa, Zea mays
  Clone ID: PAT_MRT4577_77280C.1.pep
MDALRLRPSLLPVRPGAARPRDHFLPPCCSIQRNGEGRICFSSQRTQGPTLHHHQKFFEWKSSYCRISHRSLNTSVNASGQQLQSEPETHDSTTIWRAISSSLDAFYRFSRPHTVIGTALSIVSVSLLAVQSLSDISPLFLTGLLEAVVAALFMNIYIVGLNQLFDIEIDKVNKPTLPLASGEYTLATGVAIVSVFAAMSFGLGWAVGSQPLFWALFISFVLGTAYSINLPYLRWKRFAVVAALCILAVRAVIVQLAFFLHIQTFVFRRPAVFSRPLLFATGFMTFFSVVIALFKDIPDIEGDRIFGIRSFSVRLGQKKVFWICVGLLEMAYSVAILMGATSSCLWSKTATIAGHSILAAILWSCARSVDLTSKAAITSFYMFIWKLFYAEYLLIPLVR

SEQ ID NO: 6226 - protein, 131 aa, Zea mays
  UNSURE (1)..(131): unsure at all Xaa locations
  Clone ID: PAT_MRT4577_77291C.1.pep
  unsure (1)..(131): unsure at all Xaa locations
MWVGEAHHFFXHHKKDQEQPAGKYGYSETGVVTATDQGECERYMKEEKDHMHKQDLGEAVAFAAGTFLLYXKHEAKKDPEHAHRHNITDDVDAERXVCAGRYFFHEHNEKKMDHNDPDEAIGXKNHHHLFR

SEQ ID NO: 6227 - protein, 111 aa, Zea mays
  Clone ID: PAT_MRT4577_77349C.1.pep
MCGRAMAAGDVDYLYFVSGLAYVTTNESLENAFISYGEILDSKVITYRKTARSRGFRLVTFSFDNSMLDAIENMNGKELDGRNITVNQTQSLGSRGGGGGYSSGRRTGGYG

SEQ ID NO: 6228 - protein, 470 aa, Zea mays
  Clone ID: PAT_MRT4577_77402C.1.pep
MATTAVSVDEKLDKLRAEVAKLDQISENEKSGFISLVSRYLSGEAEQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGNEYVFVADSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTIIAKPGVKLEIPDGDVLENKDVYFY

SEQ ID NO: 6229 - protein, 544 aa, Zea mays
  Clone ID: PAT_MRT4577_77404C.1.pep
LRVRRDTALRHTHHTTPPRFHSARLTSRPVLSFRSLASPDDGHRRGVGRREARQASRRGRQARPDQASAPLLSALDLAARSLRLPFLLISECVFPRSENEKSGFISLVSRYLSGEAEQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTIIAKPGVKLEIPDGDVLENKDVNGPEDL

SEQ ID NO: 6230 - protein, 517 aa, Zea mays
  Clone ID: PAT_MRT4577_77406C.1.pep
MNSRRQEQQARRTIRALLAKNGALCTGVWRCRSGGADIASRAPTMATAAVSVDEKLDKLRAEVAKLDQISENEKSGFISLVSRYLSGEAEQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTIIAKPGVKLEIPDGDVLENKDVNGPEDL

SEQ ID NO: 6231 - protein, 473 aa, Zea mays
  Clone ID: PAT_MRT4577_77410C.1.pep
MAATAVSVDEKLDKLRAEVAKLSQISENEKAGFISLVSRYLSGEAEQIEWSKIQTPTDEVVVPYDILASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAVKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTITAKSGVKLEVPDGAVFENKDVNGPEDL

SEQ ID NO: 6232 - protein, 569 aa, Zea mays
  UNSURE (1)..(569): unsure at all Xaa locations
  Clone ID: PAT_MRT4577_77417C.1.pep
  unsure (1)..(569): unsure at all Xaa locations
RSPRVRPASAERPPGQRPLEAGRDKITSGGKCDFDLAATFFXCSVVYLVVGGDMQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYIQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADTYETEEEASKLLLAGKVPVGIGRNTKIRNCIIDMNARIGKNVVITNSKGIQEADHPEEGYYIRSGIVVILKNATINDGSVI

SEQ ID NO: 6233 - protein, 66 aa, Zea mays
  Clone ID: PAT_MRT4577_77476C.1.pep
FTSHVMCVCMQNMYVCHHGVRSRIRWTYVIIQSCHVYVRKICMYAIIASTNTSVARICNYKRQAHA

SEQ ID NO: 6234 - protein, 123 aa, Zea mays
  UNSURE (1)..(123): unsure at all Xaa locations
  Clone ID: PAT_MRT4577_77517C.1.pep
  unsure (1)..(123): unsure at all Xaa locations
PGLCSVVSRNRLEKYKXDNLYGCRHSLPDGLMTALTYDRGTSCVVCEYGDVGXGGASAVKKVCARVSLTEIDAICDLQALXEGLQVLPLEDVVSEADIFVSTTGNKDIIMVDQMRKMKNNAIV

SEQ ID NO: 6235 - protein, 170 aa, Zea mays
  Clone ID: PAT_MRT4577_77573C.1.pep
PFFFPSSLFCCRCLCRRRRRLDCFGICRLAVKSKGAEKPAKGRKGKAGKDPNKPKRAPSAFFVFMEEFRKEFKEKNPKNKSVAAVGKAAGDRWKSLSESDKAPYVAKANKLKLEYNKAIAAYNKGESTAAKKAPAKEEEEEDEEESDKSKSEVNDEDDEEGSEEDEDDDE

SEQ ID NO: 6236 - protein, 168 aa, Zea mays
  Clone ID: PAT_MRT4577_77574C.1.pep
TLRSVSSLESAMKGAKSKGAAKADAKLAVKSKGAEKPAKGRKGKAGKDPNKPKRAPSAFFVFMEEFRKEFKEKNPKNKSVAAVGKAAGDRWKSLSESDKAPYVAKANKLKLEYNKAIAAYNKGESTAAKKAPAKEEEEEDEEESDKSKSEVNDEDDEEGSEEDEDDDE

SEQ ID NO: 6237 - protein, 184 aa, Zea mays
  Clone ID: PAT_MRT4577_77605C.1.pep
MINLFKIKGQKKDEAASATGKAPVKKQSAGELRLHKDISELNLPKTTSISFPNGKDDLMNFEITIRPDEGYYMGGAFVFTFQVSPSYPHDPPKVKCKTKVYHPNIDLEGNVCLNILREDWKPVLNINTVIYGLNLLFTQPNDEDPLNHEAAAVLRGNPKMFEANVKRAMTGGYVGQHYFQRCLA

SEQ ID NO: 6238 - protein, 184 aa, Zea mays; identical to SEQ ID NO: 6237
  Clone ID: PAT_MRT4577_77606C.1.pep

SEQ ID NO: 6239 - protein, 70 aa, Zea mays
  Clone ID: PAT_MRT4577_77693C.1.pep
SKGFIFVRLVCCCPSVFFMQGRSETVVSPVFSPAPANPCPPSMDCGSMNTVTPVRICYKLILRKKWYLLV

SEQ ID NO: 6240 - protein, 65 aa, Zea mays
  UNSURE (1)..(65): unsure at all Xaa locations
  Clone ID: PAT_MRT4577_77815C.1.pep
  unsure (1)..(65): unsure at all Xaa locations
FLFSFSFFCTTRGGVFFNCGSGFKCGSSCKCGKKYPDLXETSTALQATVFLGLAPEKKAAPNFDK

SEQ ID NO: 6241 - protein, 55 aa, Zea mays
  Clone ID: PAT_MRT4577_77920C.1.pep
KRGPKASPNLKVGLCGEPGGDPPSVAFFAKAGLDYVSCPPFRVPIARLTPAQGLV

SEQ ID NO: 6242 - protein, 98 aa, Zea mays
  Clone ID: PAT_MRT4577_77952C.1.pep
FQKRPPQVNIGRLECPFHLHILFYRSSWGQKWGYSVVFLLLLVRVFLAKLELITAFQLGLLCPKRYCCPIAFFLRFLKLCIKAQRLPLLFWTRSFVSL

SEQ ID NO: 6243 - protein, 91 aa, Zea mays
  UNSURE (1)..(91): unsure at all Xaa locations
  Clone ID: PAT_MRT4577_7801C.1.pep
  unsure (1)..(91): unsure at all Xaa locations
MAAKLFSLLMLLGLSACAASASIFPLCSQAPIAYVLTPYLSPAESSXVCDYPILHPYWFHLAFAAGFLPLSPLLLQQSSALLQLLPLGHFL

SEQ ID NO: 6244 - protein, 57 aa, Zea mays
  UNSURE (1)..(57): unsure at all Xaa locations
  Clone ID: PAT_MRT4577_78059C.1.pep
  unsure (1)..(57): unsure at all Xaa locations
TLLPFLKKQQLLXPFXLHAXPKAGTLLKLQKLLPFNPLALKKPTVFXQQPIIGGALF

SEQ ID NO: 6245 - protein, 80 aa, Zea mays
  Clone ID: PAT_MRT4577_78070C.1.pep
VSRIKVDWDKWQDEDDEDAGFNDFGGMDFSKLDIGGADDHYIGDDEDDVVESAKKDEERRKTEQSKDEEAAPAAAKEVKP

SEQ ID NO: 6246 - protein, 257 aa, Zea mays
  UNSURE (1)..(257): unsure at all Xaa locations
  Clone ID: PAT_MRT4577_78087C.1.pep
  unsure (1)..(257): unsure at all Xaa locations
MGEEAVDDYELHMVCYGGGGGGSEDERVMEWESGLPGADELTPLSQPLVPAGLAAAFRIPPEAGRTLLDVHRASAATVSRLRRAPPPSSSGSGGSSSFAPFHPAARGDEGADSSAAGGGAAATTNGNNNMSSSSKRPRLVWTPQLHKRFVDVVAHLGMKNAVPKTIMQLMNVEGLTRENVASHLQKYRLYVKRMQGLSDEGPSPSDHIFASTPVPQSLVHEVPMXHHGQRRXAYHNHNGMGGGGYQYQYHHYHHAHK

SEQ ID NO: 6247 - protein, 148 aa, Zea mays
  Clone ID: PAT_MRT4577_78147C.1.pep
VHLMAQNIRAHQLHQLVLANLAACSQQQQFVPFSQLAALTYASYLHQQQLPFSQLPVAYLQQFLPFNHLPALSSPAYLQQHQLLPFRQLAGVSPITFFTQPQLLPFYQHDAPNDGTIFQFHQLLPFNQLAFLNLAVFYHQPIIGGALF

SEQ ID NO: 6248 - protein, 138 aa, Zea mays
  Clone ID: PAT_MRT4577_78248C.1.pep
MASLFKDPSKLSVYRDRRFPGTQEEFEAALLASLTVYVGNMSFYTTEEQAYELFSRAGEIKKIIMGLDKNTKTPCGFCFVLYYSREDAEDAVKYISGTMLDDRPIRVDFDWGFEEGRQWGRGRSGGQVRDEYRTDYDP

SEQ ID NO: 6249 - protein, 90 aa, Zea mays
  Clone ID: PAT_MRT4577_782C.1.pep
SAACFIANGADANTDLRRCCISGAPSWCVCVSVCDCVAAALYIVQTYRSPSHAATATDSIDALPTRGGVRTRERSVGRVKRNSASSSSSL

SEQ ID NO: 6250 - protein, 37 aa, Zea mays
  Clone ID: PAT_MRT4577_78338C.1.pep
AHHRLAVARRRRAQQRALQLALATAAGDAHRARIYIT

SEQ ID NO: 6251 - protein, 249 aa, Zea mays
  Clone ID: PAT_MRT4577_78440C.1.pep
MTETREINVFMAKLAEQAERYDEMVEAMKNVADLGQELTVEERNLLSVAYKNVIGARRASWRIITSIEQKEESKGNTAHVERIKEYRKKVENEVSKICADVLGTLDNKLIPNAQTTESKVFYYKMKGDYHRYLAEFATSEARKEAADNSLAAYKSATDIANSELAPTHPIRLGLALNASVFYYEIMGSPKQACELARKAFDDAIAELDQLNEESYKDSTLIMQLLRDNLTLWTSDLEGDKADAEPEAAN

SEQ ID NO: 6252 - protein, 227 aa, Zea mays
  Clone ID: PAT_MRT4577_78450C.1.pep
MGRGKIEIKRIENATNRQVTYSKRRTGIMKKARELTVLCDAQVAIIMFSSTGKYHEFCSPGTDIKTIFDRYQQAIGTSLWIEQYENMQRTLSHLKDINRGLRTEIRQRMGEDLDSLDFDELRGLEQNVDAALKEVRHRKYHVISTQTDTYKKKVKHSHEAYKNLQQELGMREDPAFGYVDNTGAGVAWDGAAAALGGAPPDMYAFRVVPSQPNLHGMAYGFHDLRLG

SEQ ID NO: 6253 - protein, 210 aa, Zea mays
  UNSURE (1)..(210): unsure at all Xaa locations
  Clone ID: PAT_MRT4577_78571C.1.pep
  unsure (1)..(210): unsure at all Xaa locations
MVLMAGMLPGVECARRRRVRQGGAGMGAEAAGGGTGRRSSFCLYAAGHGGAGNSGKRSGGVVHGHGWTLDSNAREAKERLDQKLRTXGRPPXEAPQHGEHKAGRAAPERRRGRARRELRAXMAGVQREVYSKKGVMRRLMRWSRPRWAAAEQAECAVCLDEFRAGDVLAHLRCGHRFHWACALPWLEGTSRCPFCRAAVDAGAAAAADGA

SEQ ID NO: 6254 - protein, 73 aa, Zea mays
  Clone ID: PAT_MRT4577_78749C.1.pep
IYHKSTLPYITHRFMHTCDKECFVSQSKAKYFFNILTTYCIMISENRSLDVSVTEGVHLVEARCKDVAPKGVM

SEQ ID NO: 6255 - protein, 247 aa, Zea mays
  Clone ID: PAT_MRT4577_78947C.1.pep
MASADLLRREEEFYSSLFDSAKGDGARSRSQLIERKIEALEDMATRVSNRRSRKWFNDRLLIELVPRLYVEEIKGLFAPPPWGEQVPLSAFYRANVGEWDSFRSIDMDAEARLMQHMKKSLEKPRNHVDEGESIALNAWHRIDRHTREAIKRNFLPDLLGIYEERVRAFIEDASDKDALVLNVQDPFQRLLLHGVCEFYNVSSTTTSSVREDGRPWKATTIKKRQGTGVPSRITLVSFLRMKKNGSQ

SEQ ID NO: 6256 - protein, 555 aa, Zea mays
  UNSURE (1)..(555): unsure at all Xaa locations
  Clone ID: PAT_MRT4577_79089C.1.pep
  unsure (1)..(555): unsure at all Xaa locations
MADTPTSRMVHPFGDVPRQTPKQFLYSGNPQHLCHPYQSAPDTHVVPQRRYTVRSQSHSPNNAGSQDHETHKQYTLESSAASRLXSRHGSPSSQSVHAGSGSPVSHDDSHSGSTNGHGSPVSASCVTGEDPTDLSXKLKDLEAVMLGTSETDPEIVNSLEISAANQLSLEPEEWEHMVSMPRGNLKELLIACARAVERNNSYAIDLMIPELRKMVSVSGEPLERLGAYMVEGLVARLAASGSSIYKALKCKEPRSSDLLSYMHFLYEACPYFKFGYMSANGAIAEAIKGEDRIHIIDFHIAQGAQWVSLLQALAARPGGPPFVRVTGIDDSVSAYARGGGLELVGRRLTHIAGLYKVPFQFDAVAISGSEVEEEHLGVVPGEAVAVNFTLELHHIPDETVSTANHRDRILRLVKGLSPKVLTLVEQESNTNTAPFAQRFAETLDYYTAIFESIDLALPRGDRERINIEQHCLAREIVNLVACEGEERVERHEVFGKWKARLMMAGFRPSPLSALVNATIKTLLQSYSPDYKLAEREGVLYLGWKNRPLIVSSAWH

SEQ ID NO: 6257 - protein, 46 aa, Zea mays
  UNSURE (1)..(46): unsure at all Xaa locations
  Clone ID: PAT_MRT4577_79171C.1.pep
  unsure (1)..(46): unsure at all Xaa locations
MESKGGKKSSSSRSMMYEAPLGYNIEDVRPAXCVKNFQAVAYSNFS

SEQ ID NO: 6258 - protein, 109 aa, Zea mays
  Clone ID: PAT_MRT4577_79229C.1.pep
HPQQPDKKYHAAGCLFVSSMESTELKVEMVALHEKRVRRCLSKVKGIERVEVEASLQKVVVTGCVNRSKILKALRRVGLRAEPWSPHNELLSAYAATTTLVFNNSYAFF

SEQ ID NO: 6259 - protein, 131 aa, Zea mays
  Clone ID: PAT_MRT4577_7924C.1.pep
EVYARVWVLPEDEDAEKRAQARVRDDEDADRRDGEDGGAMRPLARTPHMFCKTLTASDTSTHGGFSVPRRAAEDCFPPLDYSQQRPSQELVAKDLHGTEWKFRHIYRGQPRRHLLTTGWSAFVNRKKLISG

SEQ ID NO: 6260 - protein, 79 aa, Zea mays
  UNSURE (1)..(79): unsure at all Xaa locations
  Clone ID: PAT_MRT4577_79371C.1.pep
  unsure (1)..(79): unsure at all Xaa locations
RNIPVKEAQSHRACEGGAGGSGGARGGGGYAGGGPRDAGGGFGGAGGSGGAGGYGGGGGGXGGWHRWGGXGNSHGNWRN

SEQ ID NO: 6261 - protein, 328 aa, Zea mays
  Clone ID: PAT_MRT4577_79414C.1.pep
MVGGGRRGGAAAEEVKLNTGNVFAALESLKKKKKGDKGRAAGPSSRKKHGAGAAQQQQEPPQKDVFWAPAPLTTKSWADVEDDDDDDYFATTAPPRPVWAAAAAAEPAKEEEEDVEDAVRAALQEDVESDDEDLDDEDLDDGAEHEVEDAPAELAVKTVEALAAPPKDTERQLSKKELKKRELAELDAVLAELGLSGNSTSAAQDAEKEGANQAGDAEKKEDATVPSESKTSKKKKKKDKSSKEGRKETQEAAEGSEETASAGPDEEDTTAVDVKERLKKMASMKKKRSSKETDTGAKIAAAEATARSARLAAAKKKEKSHYNQQPVR

SEQ ID NO: 6262 - protein, 566 aa, Zea mays
  Clone ID: PAT_MRT4577_79557C.1.pep
MERYSDMRPKAEVSYLGRGSRFSSRNQSSEERTNHSSDKPGSSTRFNPTKARIGGNQGRPRYVCDSFKSPSSKVSPAGSSKFPLSKFEERRRQPFVPGFDIAESSRRKADAKQLQGSKKIAAENDSSDNLRGESEGFTTEQVVKPEGSHVVGHSGVSAYTVGSLVQTASLGSRTHRQKHKEVNLGTPGASSSTLTNRSTIPGNSTMGVRPAYGHVNGGQIHGLKNLGCSSVPDAQPSGCPSESVISRRRFEFMRKRAFDQESSSRSVNLSLGHSTPTDIRRIRMNEQSLCQQIPRSSSRSHQESAGSVRTRRPSPHATRMSVPDGRADGVLSLHESSTKDVQPAQEHLSLEEVSTESSIRPFFVEFDNNIFSSSHLRRSSTRAERGRPSSLFEESPRQMFHSLMGERDRHRHITMEGITEVLAALERIEQQAELTYDQLLMLEANLFFGAFASYDRHRDMRMDIDDMSYEELLALEERIGSVSTALSEEQFTKCLKRSIYSQVALEVNKSTVDDMKCSICQEEYAEGEEVGRLPCEHRYHVCCIGQWLGQKNWCPVCKASAVPSKG

SEQ ID NO: 6263 - protein, 43 aa, Zea mays
  UNSURE (1)..(43): unsure at all Xaa locations
  Clone ID: PAT_MRT4577_79616C.1.pep
  unsure (1)..(43): unsure at all Xaa locations
MLPSFVSPTAXCAASVAPPPRPFPGSYGAPVLGPLRDRLDFFW

SEQ ID NO: 6264 - protein, 207 aa, Zea mays
  UNSURE (1)..(207): unsure at all Xaa locations
  Clone ID: PAT_MRT4577_79625C.1.pep
  unsure (1)..(207): unsure at all Xaa locations
MPETVGENGNAAPGRLLLLSNRLPITIKRSEDGSYSFSMSSGGLVTGLSGLSKTTSFQWYGWPGLEVPDNEVEGMKQRLKEEYGAHPVFIDDELADRHYNGFSNSILWPLFHYHPGEITFDESAWAAYQEVNRLFAKTVIKDVQDGDLIWVHDYHLMLLPQMLREEIGESKKNVKIGFFLHTPFPSSEIYRILPVREALLTGXLDCD

SEQ ID NO: 6265 - protein, 109 aa, Zea mays
  UNSURE (1)..(109): unsure at all Xaa locations
  Clone ID: PAT_MRT4577_79648C.1.pep
  unsure (1)..(109): unsure at all Xaa locations
FTRTSTQNSIRVAQWMLETTGATSFMGCIGKDKFGEELKKNAQAAGVTADYYEDDTAPTGTCAECVGAGEWSLIANLLEAYCHKYEHLKRPVNXTLVVMASDIYIAGFL

SEQ ID NO: 6266 - protein, 72 aa, Zea mays
  Clone ID: PAT_MRT4577_79789C.1.pep
KNRKKTNPVHIHKMGSQIFVHTCILIVEARSCPPRAAYLLIQTDPACGTIVSSHAYRRQIFIPLACLVCFTD

SEQ ID NO: 6267 - protein, 701 aa, Zea mays
  Clone ID: PAT_MRT4577_79924C.1.pep
MRLSSSLQDLPTFTRIDALERGSSVGSDLSSGRPKPVRMLQRDGAVASFSKERTPPSSPTNRKKCMRAAGCAIALILLVFFAYGSWRYFHVFLSEGRSEYYVVLDCGSTGTRVYVYEWHINHNDANAFPIVLKPLGNAPKKKSGKLTRLYQRMETEPGLSKLVHNESGLKKAIEPLLQMAEKLIPRHAHKHTPLFLYATAGVRKLPSADSEWLLDKSWDILNNSSFLCSRDRVKIISGMDEAYYGWIALNHNMDMLGTSSSKMTYGSLDLGGSSLQVTFENDKSVQDETSIRLSIGSVEHHLSAYSLTGYGLNDAFDKSVAHLVKRLGGVASNGKVQVKHPCLQTGFKEDYICSYCHPLKQDGSPSVGEKNSGKEKQGIAVELVGAPQWNECSALAKVTVNLSEWSSASPGLDCNIHPCALASNFPRPYGQFFAISGFYVVFKFFNLTADATLGDVQKRGQEFCEKPWKVAKSSVPPQPFVEQYCFRAPYISSLLREGLQIKDSQVIIGSGSITWTHGVALLEAGQALSSRLDIQGYRILHREINPNILIVLFLISIVLVICAILCVSNSIPRSFRKSYLPIHRHNSGGSSVLGMGLPFKHLLWNPISSGDGRTKTPLSPTVAGSDPHPFAGLGGSSVELMESSRQSLGAYHSYSVGSLGQMQFSSGVRNPSRGQTTLQSRRSQSREDLSSSLADIHFPKV

SEQ ID NO: 6268 - protein, 925 aa, Zea mays
  Clone ID: PAT_MRT4577_79974C.1.pep
MRIMIKGGVWKNTEDEILKAAVMKYGKNQWARISSLLVRKSAKQCKARWYEWLDPSIKKTEWTREEDEKLLHLAKLMPTQWRTIAPIVGRTPSQCLERYEKLLDAACAKDENYEANDDPRKLRPGEIDPNPESKPARPDPVDMDEDEKEMLSEARARLANTRGKKAKRKAREKQLEEARRLASLQKRRELKAAGIDTRHRKRKRKGIDYNAEIPFEKRPPSGFYDTVGEDRPPEHVQFPTTIEGLEGKRRADIEAQLRKQDIARNKILQRQDAPAAIMQANKLNDPEAVTKRSKLMLPPPQISDHELEEIAKMGSAGDPALADELGEGSTATRTLLASYSQTPRLGMTPLRTPQRTPAGKGDAIMMEAENLARLRESQTPLLGGDNPELHPSDFSGVTPRKKEIQTPNPMATPLASPGPGITPRISMTPSREGHSFGLTPKATPLRDELNINEVEMQDNTKLELRRQAELRKSLRSGFASIPQPKNEYQIVMPPITEDEKEEAEEKIEEDMSDRLARERAEEQARHEALLRKRSKVLQRSLPRPPAVSVEIIRQSLIRSGESRSRSTFMPPTSLEQADELINEELLRLLEHDNAKYPLDEKTQKEKKKGSKRQQNGGPLVPEIDDFDEDELKEASSMVEEEIQYLRVAMGHENESFEDFVKAHDACQDDLMFFPTSNSYGLASVAGNADKISALQNEFETVKKRMDDEAKKASRLEQKIKLLTQGYQIRAGKLWSQVQDTFKQMDTAATELECFQELQKQEHLAASYRIQNLSEEVSKQKALERTLQSRYGELVSGFQRIQEQVEEHKRQLKVQEAVEAESHAQEEEAAASNHAAAEEEDERKEDDERKEEDGSKSLSSEEKPQQTSTATDEEPAGSKGTTEDQMDVDSGNGEGGVVGPVPPAPDTEGGNDEVSVQEISEAQPLP

SEQ ID NO: 6269 - protein, 506 aa, Zea mays
  UNSURE (1)..(506): unsure at all Xaa locations
  Clone ID: PAT_MRT4577_80047C.1.pep
  unsure (1)..(506): unsure at all Xaa locations
GYRHAGGGQDEEWLLGTPHPDVLPGRSRGRPDGEDGRVAHRPQPQGRPPHGGERRERXKRRPPTTKLSELESQLSQLQDELKKAKEQLHSSELSRKRALQEVDDAKAQAAAASAQARDTEAQLAELSSAEESRLLELRRLSQERDRSWQSELEAMQKQHAADSTALAAAMGEVHRLRVQLAATARADRRQDVVEALATINELRAKLKASEEAEAQARAMHEECKQQLEASRATIDSLLTDGSKLMDSFSLVVKELEESRATVKALEDEIAETSSRAAGDHCSCSGSESEASELRAELEAAEARYQEEKILSTVETQCAYELMDQIKTESDLRHGKLAAALEGAKSEVIFLKASLFDKESELRSALDAIKKLQAETRADGSADALKQQLQCALHENGQLKQELHQYESEKGSATARTAEADASEAAKKGEMETELRRLRVQAEQWRKAAETAMALLTVGKGGNGKFVERSESWEGVKYAGLCEELDDDAAVRKNGNVLRRISGMWKK

SEQ ID NO: 6270 - protein, 87 aa, Zea mays
  UNSURE (1)..(87): unsure at all Xaa locations
  Clone ID: PAT_MRT4577_80122C.1.pep
  unsure (1)..(87): unsure at all Xaa locations
QFLPYHQRAALNSPVYXQQQHLLPSSQLAGVSPAAFLSQPQLFPIDQHVAPHAGTLLQLQRLVPFNHLAFTHPPVFDHHPIIGGALF

SEQ ID NO: 6271 - protein, 157 aa, Zea mays
  Clone ID: PAT_MRT4577_80301C.1.pep
MDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAAEKAASAGSKEPKSPKKGAKSPKKA

SEQ ID NO: 6272 - protein, 171 aa, Zea mays
  Clone ID: PAT_MRT4577_80303C.1.pep
MVKYSTEPTNPTKSTKAMGRDLRVHFKNTRETAFALRKLSLTKAKRYLEDVIAHKQAIPFRRYCGGVGRTAQAKSRHSNGQGRWPVKSARFILDLLKNAESNAEVKGLDVDTLYVSHIQVNQAQKQRRRTYRAHGRINPYMSSPCHIELILSEKEEPVKKEAESQIATRNA

SEQ ID NO: 6273 - protein, 177 aa, Zea mays
  Clone ID: PAT_MRT4577_80350C.1.pep
MLRGVENSFLLHSLPRLHNPPPRSRPGTSPAAMTTRFKKNRKKRGHVSAGHGRIGKHRKHPGGRGNAGGMHHHRILFDKYHPGYFGKVGMRYFHKLRNKFYCPAVNIERLWSMVPADKAAEAGGDKAPQIDVTQFGYFKVLGKGVLPPKPIVVKAKLISKVAEKKIKAAGGAVVLTA

SEQ ID NO: 6274 - protein, 447 aa, Zea mays
  Clone ID: PAT_MRT4577_80424C.1.pep
MASSLAPASWALPLQMGGAGAAAAGPSCRATLAVVTEPRWAASLRRARVLVALAPRCVALDGPGASGEEEAPKIEDERKKSGETKKPARGRPVWSRILFASKKTRSIIILNALTVIYASDIPVLKEVEALTEPAVFNMVRFVVAAIPFVPFALRSFGDRSVRYAGLELGVWVSLAYLSQAIGLLSSDAGRASFITAFTVVVVPLIDGLLGASIPRLTWFGAIMSLFGIGLLECGGSPPSVGDILNFFSAVFFGIHMLRTEQISRSTDKKKFLALLGFEVLVVAFSSVLWFMFKDGYVDTSGSSFESWTFGMLWDTTVSFPWIPALYTGVLSTVLCMWAEMVAMGDVSATETAVVYGLEPVWGAAFAWFLLGERWDDAAWTGAALVLCGSLTVQLFGSAPEKSKKVKKRSSNALETPVKRRDYLSLSPIPVDSGKIIGRQLERKNKAV

SEQ ID NO: 6275 - protein, 242 aa, Zea mays
  UNSURE (1)..(242): unsure at all Xaa locations
  Clone ID: PAT_MRT4577_8051C.1.pep
  unsure (1)..(242): unsure at all Xaa locations
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILPTGAASFKEAMKMGVEVYHNLKSVIKKKYGQDATNVGDEXGGFAPNIQENKEGLELLKTAIEKAG

SEQ ID NO: 6276 - protein, 242 aa, Zea mays
  UNSURE (1)..(242): unsure at all Xaa locations
  Clone ID: PAT_MRT4577_8054C.1.pep
  unsure (1)..(242): unsure at all Xaa locations
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILPTGATSFKEAMKMGVEVYHNLKSVIKKKYGQDATNVGDEGGFAPNIQEXNRRGLELLKTAIEKAG

SEQ ID NO: 6277 - protein, 146 aa, Zea mays
  UNSURE (1)..(146): unsure at all Xaa locations
  Clone ID: PAT_MRT4577_80551C.1.pep
  unsure (1)..(146): unsure at all Xaa locations
LLAQNIRAQQLQQLGVTNPGAYXQQQQFFPFNQIGSLNFGFYLQQQQLPFSQVPGAYPQQFFPFNQLTALNFPGYLQQQQLLPFNQVSGVNPGTFFTQPQLVPFYQHGGPNAGPLLQLQPLVPFNQPGFTNPTVVYPQPIIGGALF

SEQ ID NO: 6278 - protein, 43 aa, Zea mays
  Clone ID: PAT_MRT4577_80580C.1.pep
TNYLRPDLKRGLLSTAEEQLVIDLHAMLGNRWSKIAAKLPGRT

SEQ ID NO: 6279 - protein, 56 aa, Zea mays
  Clone ID: PAT_MRT4577_80596C.1.pep
AVGTARPSYRVCNRGDCPRPQGLSPFVMCLWMPICVFDCKAALGQLVDLGSSSAST

SEQ ID NO: 6280 - protein, 201 aa, Zea mays
  UNSURE (1)..(201): unsure at all Xaa locations
  Clone ID: PAT_MRT4577_8071C.1.pep
  unsure (1)..(201): unsure at all Xaa locations
ITLDPTKFRSYSRHDTTGMTTNAAAPVWNDNEALTVRPRGPILLEDYHLIEKAEHFARERIPERVVHARVASAKGFLECTHDVTXLTCADFLLAPGVRTPVIVRFWTVIHERRSPETMRDPRVIAEKFYTREVNWDLLYNNLLGFFIRDGIKFPDVIHAIKPNLRPHVQEYCRVLYFLXNLPDSLHTFMFLFDDGGVLADY

SEQ ID NO: 6281 - protein, 56 aa, Zea mays
  Clone ID: PAT_MRT4577_80753C.1.pep
EILCTSAASATLSSSDGTGTTVSCPTSTSSWTTSHCTSSASCCCCSLPMSTMTVEL

SEQ ID NO: 6282 - protein, 240 aa, Zea mays
  Clone ID: PAT_MRT4577_8094C.1.pep
MESLFGQSQRRRRAGGSGFESLKRLGHISPAVQSHLKHVYLTLCSALAFSALGAYLHILLNVGGALTTVGCVASIAFLISLPASRDQERNRLALLMSAALLQGASVGPLVDLVIDLDSRILVTAFVGTAVAFACFSGAAIIAKRREYLYLGGLLSSGLSILLWLQFATSIFGHTSATFMFELFFGLLVFLGYMVFDTQEIIERAHRGDMDYIKHALTLFTDFVAMKNAQEKSQDEKRKKR

SEQ ID NO: 6283 - protein, 141 aa, Zea mays
  UNSURE (1)..(141): unsure at all Xaa locations
  Clone ID: PAT_MRT4577_80953C.1.pep
  unsure (1)..(141): unsure at all Xaa locations
MGDEIFWLLMQLXLSESAAAVTIFXPQWSQAPIGCLLAPFLSPAVSXVCENPILEPYRMQQTIRGGILPLSPLFLQQSSALLQELPLVHLLAQNIRAQQLQQLVLANLAAYSQQQQFXLPFNQTSCIGTPVXFLQQQQLPF

SEQ ID NO: 6284 - protein, 250 aa, Zea mays
  Clone ID: PAT_MRT4577_8095C.1.pep
MESLFGQSQRRRRAGGSGFESLKRLGHISPAVQSHLKHVYLTLCSALAFSALGAYLHILLNVGGALTTVGCVASIAFLISLPASRDQERNRLALLMSAALLQGASVGPLVDLVIDLDSRILVTAFVGTAVAFACFSGAAIIAKRREYLYLGGLLSSGLSILLWLQFATSIFGHTSATFMFELYFGLLVFLGYMVFDTQEIIERAHRGDMDYIKHALTLFTDFVSVLVRILVIMMKNAQEKSQDEKKRKKR

SEQ ID NO: 6285 - protein, 50 aa, Zea mays
  Clone ID: PAT_MRT4577_8096C.1.pep
WATAAASVRQVPRCSLVRPFVRSSLDPSSTSTHQTCIRARIKNNICSYRR

SEQ ID NO: 6286 - protein, 371 aa, Zea mays
  Clone ID: PAT_MRT4577_81096C.1.pep
MGSGGANTAPLLTPYKMGKFDVSHRVVLAPLTRQRSYGNVPQPHAILYYQQRATKGGLLIAEATGVSDTAQGYKDTPGIWTHEQVEAWKPIVDGVHQKGGIFFCQIWHVGRVSNSTFQPNGQAPISSTDKPLKPQVRANGIDVATFAVPRRLETDEIPLVVNDFRVAARNAIEAGFDGVEIHGAHGYLIDQFLKDGVNDRTDKYGGSLENRCRFALEVTQAVVDEIGADKVGIRLSPFASYSEAPDSDPEALGMYMANALNEFGILYCHMVEPRMVKLGEKFETPYSLRPIRDAFRGTFIVAGGYGREDGNRAISTGYADLVAFGRLFLANPDLPRRFEVDAPLNKYNRDTFYIPDPVVGYTDYPFLSSDV

SEQ ID NO: 6287 - protein, 411 aa, Zea mays
  UNSURE (1)..(411): unsure at all Xaa locations
  Clone ID: PAT_MRT4577_81100C.1.pep
  unsure (1)..(411): unsure at all Xaa locations
MGSGGANTAPLLTPYKMGKFDVSHRVVLAPLTRQRSYGNVPQPHAILYYQQRATKGGLLIAEATGVSDTAQGYXSSARPXLLRLLEICVVMXISSFSSLVDVXKDVFSVCAQGTXTPGIWTHEQVEAWKPIVDGVHQKGGIFFCQIWHVGRVSNSTFQPNGQAPISSTDKPLKPQVRANGIDVATFAVPRRLETDEIPLVVNDFRVAARNAIEAGFDGVEIHGAHGYLIDQFLKDGVNDRTDKYGGSLENRCRFALEVTQAVVDEIGADKVGIRLSPFASYSEAPDSDPEALGMYMANALNEFGILYCHMVEPRMVKLGEKFETPYSLRPIRDAFRGTFIVAGGYGREDGNRAISTGYADLVAFGRVFLANPDLPRRFEVDAPLNKYNRDTFYIPDPVIGYTDYPFLSSDV

SEQ ID NO: 6288 - protein, 122 aa, Zea mays
  UNSURE (1)..(122): unsure at all Xaa locations
  Clone ID: PAT_MRT4577_81104C.1.pep
  unsure (1)..(122): unsure at all Xaa locations
MAAKIFCFLMLLGLSASVATATIFPQCSQAPIAFLFSPYLLPAVSSMCENPIVXPYRIQQAIVTGILPLSPLFLQQPLALLQQIPLVHLVVQNIMAQQLQXLGLVNFAAFFQLHSFFXFNQL

SEQ ID NO: 6289 - protein, 101 aa, Zea mays
  Clone ID: PAT_MRT4577_81216C.1.pep
MAAAAQRLLAASTKIVGVGRNYVAHAKELGNPVPKEPVLFLKPTSSFLHAGVATTAVEVPEPLESLHHEVELAVVISRRARDVPEASAMDFVGGYALALDM

SEQ ID NO: 6290 - protein, 101 aa, Zea mays
  Clone ID: PAT_MRT4577_81245C.1.pep
VGFSCPFGSGSGSGGYPRFGFSNQRIEMAAYDVDYRCFFGGLAWATDNHSLHNAFSTYSEVLQCKIILDRETQRSRGFRYITFFTEEAMPNAIEGMNLKEL

SEQ ID NO: 6291 - protein, 72 aa, Zea mays
  UNSURE (1)..(72): unsure at all Xaa locations
  Clone ID: PAT_MRT4577_81527C.1.pep
  unsure (1)..(72): unsure at all Xaa locations
QLSPPAIGIAVECVFAPFLGREXYQPVVDENVDKLKKVLEVYDARVGTCTYLDGDFLSLAELRRFTIMQWLM

SEQ ID NO: 6292 - protein, 391 aa, Zea mays
  Clone ID: PAT_MRT4577_81549C.1.pep
MAAFAALFDPLYCPEEHLDLYRDEPGEGADEQWPGQHGQQEPAVLDDELPALFEAHRAKEGVVLAEDGGYGGAAGREAAVGWVSRAAARLGFSALTAALAAAYLDRCFLPGGALRLGDQPWMARLAAVTCFALAAKVEETRVPPLLDLQLYAAADAADPYVFEAKTVRRMELLVLSALGWRMHPVTPFSYLQPVLADAATRLRSCEGVLLAVMADWRWPRHRPSAWAAAALLITAAAGDGGDGDGDTELLALINAPEDKTAECAKIISEVTGMSFLACDVGVSAGNKRKHAAAQLYSPPPSPSGVIGALSCFSCESSTSATAMAAAVGPWAPSASVSVSSSPEPPGRAPKRAAAASASASASAGVAPPVQVPHQLPPDEESRDAWPSTCAA

SEQ ID NO: 6293 - protein, 45 aa, Zea mays
  Clone ID: PAT_MRT4577_81550C.1.pep
KTGSPPPANFLFKKVKRDFFFFVARLWTWTNPSSVTRFKYRLPFV

SEQ ID NO: 6294 - protein, 136 aa, Zea mays
  UNSURE (1)..(136): unsure at all Xaa locations
  Clone ID: PAT_MRT4577_81604C.1.pep
  unsure (1)..(136): unsure at all Xaa locations
MAAKIFWRLILLGLSAISATSTIFPKCSQAPISSLLPPYLLPAVSFVCENPILQSYTIQHSITAGILSLLPLFLHHSSILLHHLPLMHIFSHIIXSQQLQHLVLSYLAAYSHQHQFFFFNXLSAMISASYFTHHSN

SEQ ID NO: 6295 - protein, 593 aa, Zea mays
  Clone ID: PAT_MRT4577_81610C.1.pep
MDTAIGSVPAASDAARHPAPSASAPRDATLGRHLARRLAEVGARDVFTVPGDFNLTLLDELEAEPGGVRLVGCCNELNAAYAADGYARARAGGVGACAVTFTVGGLSAINGVAGAFSENLPVVCIVGGPNSNDYGSNRILHHTIGLPDFTQELRCFQNVTCYQAVVNNLEDAHEQIDTAISTAIKESKPVYISISCNLPSIPHPTFSRHPVPFFLSPRLSNQMNLEAAVEAAAAFLNKAVKPVLVGGPKMRVSKACEALAELADACGYPVAVMPSAKGLVPEHHSRFIGTYWGAVSTPFCAEIVESADAYLFAGPVFNDYSSVGYSLLLKKEKAIIVQPERVVVGHGPAFGCVLMKDFLHALATRLKKNTVAYENYRRIYVPPGEPLSSEPGEPLRVNVLFKHIQAMLSGDMAVIAETGDSWFNCQKLKLPEGCGYEFQMQYGSIGWSVGATLGYAQAAKDKRVIACIGDGSFQVTAQEVSTMLRWGHNSIIFLINNGGYTIEVEIHDGPYNVIKNWNYTGLVEAFHNGEGACYTAKVRTEEELTEALEAALGPKKDCLCFIEVIVHKDDTSKELLEWGSRVSAANSRPPNPQ

SEQ ID NO: 6296 - protein, 107 aa, Zea mays
  UNSURE (1)..(107): unsure at all Xaa locations
  Clone ID: PAT_MRT4577_81682C.1.pep
  unsure (1)..(107): unsure at all Xaa locations
DPDGPDAVRLTWNTWPRSKVEASRCVVPLAATISPGRVPDPSAXSPPPLPYPPLRCKAPCSXLLNPFARVDFAAKIWICPFCFSRNHFPLHYSAISESNVPAELSPQ

SEQ ID NO: 6297 - protein, 80 aa, Zea mays
  Clone ID: PAT_MRT4577_81745C.1.pep
RFLKSGSSRQLLHIYLYVCIMNYLVCFPQKRTPFFVHVHYVVPFVFLKCRPEKRTFTFVFSCLAVWLLQFFFALQKNFKL

SEQ ID NO: 6298 - protein, 117 aa, Zea mays
  UNSURE (1)..(117): unsure at all Xaa locations
  Clone ID: PAT_MRT4577_8178C.1.pep
  unsure (1)..(117): unsure at all Xaa locations
HKAGYTTYATKHNACETTEATKQKAVETTEAARQKAVDAMEAVKQNAVEAGQXYAKDTVVSGKDKFGDVIQXATDQVKSAAAGAKDAVMSTLVMGGYDKQGYANTNTNQDSLYHYQG

SEQ ID NO: 6299 - protein, 117 aa, Zea mays
  UNSURE (1)..(117): unsure at all Xaa locations
  Clone ID: PAT_MRT4577_8184C.1.pep
  unsure (1)..(117): unsure at all Xaa locations
PPQETEXGXXXKTHRSXAYFKXXQXKXKRRRAGKTDYRARIRLINQDKNKSNTPNCGGVVRFTNLDITAXIISASLAGDMVLASACSHELPRCGLAVGLSCFAAXAFCAVLLLARRV

SEQ ID NO: 6300 - protein, 228 aa, Zea mays
  UNSURE (1)..(228): unsure at all Xaa locations
  Clone ID: PAT_MRT4577_81870C.1.pep
  unsure (1)..(228): unsure at all Xaa locations
GFLVCSQLPLYGIYSTTGADPFYWMRVILASNRGTVMELGITPIVTSGMVMQLLVGSKIIEVDNSVREDRALLNGAQKLLGILIAIGEAVAYVLSGMYGSVSQLGTGNAILIILQLFFAGIIVICLDELLQKGYGLGSGISLFIATNICENIIWXVRALREAFYRQNLPNVTNLLATVLVFLIVIYFQGFRVVLPVRSKNARGQQGSYPIKLFYTSXMPIILHSALIT

SEQ ID NO: 6301 - protein, 174 aa, Zea mays
  UNSURE (1)..(174): unsure at all Xaa locations
  Clone ID: PAT_MRT4577_81872C.1.pep
  unsure (1)..(174): unsure at all Xaa locations
MHYHIKYIQLTISLFSSPRLGVHAVASACRGEASALPGAGLGSSSARKMAGGFRVLHLVRPFLAFLPEVQSADRKIPFREKVIYTVISLFIFLVCSQLPLYGIHSTTGADPFYWMRVILASNRGTVMELXITPIVTSXMVMQLLXGSKIFEVDNSVREDRALLNGAQKVLGILI

SEQ ID NO: 6302 - protein, 141 aa, Zea mays
  UNSURE (1)..(141): unsure at all Xaa locations
  Clone ID: PAT_MRT4577_81875C.1.pep
  unsure (1)..(141): unsure at all Xaa locations
MAGGFRVLHLVRPFLAFLPKVQSADRKIPFKEKVIYTVISLLIFLVCSQLPLYGIHSTTGADPFYWMRVILAXNRGTVMELGITPIVTSGMVMQLLVGSKIIEVDNSVREDRALLNGAQKLLGILIAIGEAVAYVLSEMYG

SEQ ID NO: 6303 - protein, 475 aa, Zea mays
  Clone ID: PAT_MRT4577_81878C.1.pep
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILIAIGEAVAYVLSGMYGSVSQLGTGNAILIILQLFFAGIIVICLDELLQKGYGLGSGISLFIATNICENIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILHSALITNLYFISQLLYRKYSGNFLVNLLGKWKESEYSGHSIPVGGLAYYVTAPSSLADVLANPFHALFYVVFMLSACALFSKTWIEVSGSSAKDVAKQLKEQQMVMPGHRESNLQKELNRYIPTAAAFGGVCIGALTVLADFMGAIGSGTGILLAVTIIYQYFETFEKERATELGFFGF

SEQ ID NO: 6304 - protein, 475 aa, Zea mays
  Clone ID: PAT_MRT4577_81879C.1.pep
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILIAIGEAVAYVLSGMYGSVSQLGTGNAILIILQLFFAGIIVICLDELLQKGYGLGSGISLFIATNICENIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILHSALITNLYFISQLLYRKYSGNFLVNLLGMWKESEYSGHSVPVGGLAYYVTAPSSLADVLANPFHALFYVVFMLSACALFSKTWIEVSGSSAKDVAKQLKEQQMVMPGHRESNLQKELNRYIPTAAAFGGVCIGALTVLADFMGAIGSGTGILLAVTIIYQYFETFEKERATELGFFGF

SEQ ID NO: 6305 - protein, 548 aa, Zea mays
  UNSURE (1)..(548): unsure at all Xaa locations
  Clone ID: PAT_MRT4577_81883C.1.pep
  unsure (1)..(548): unsure at all Xaa locations
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIXEVDNSVXREDRALLNGAQKLLGILIAIGXEAVAYVLSGMYGSVSQLGTGNAILIILQLFFAGIIVICLDELLQKXXGLGSGXISLFIATNICENXIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILHSALITNLYFISQLLYRKYSGNFLVNLLGKWKESEYSGHSIPVGGLAYYVTAPSXENLVPSVGTGEAFSPXHFCCFCYSIIRYSFDXIAHWKPHSLADVLANPFHALFYVVFMLSACALFSKTWIEVSGSSAKDVAKQLKEQQMVMPGHRESNLQKELNXHPHLLFLELLSNKXMPGHRESNLQKELNRYIPTAAAFGGVCIGALTVLADFMGAIGSGTGILLAVTIIYQYFETFEKERATELGFFGF

SEQ ID NO: 6306 - protein, 54 aa, Zea mays
  UNSURE (1)..(54): unsure at all Xaa locations
  Clone ID: PAT_MRT4577_81890C.1.pep
  unsure (1)..(54): unsure at all Xaa locations
APCGRAALEAASPTSPRDPPPPYPGPLLPPRPSXRAPEEGLPAPHXEASSHNPT

SEQ ID NO: 6307 - protein, 90 aa, Zea mays
  Clone ID: PAT_MRT4577_81929C.1.pep
YPQQFFPFNQGEALNFPVYFQQQQLFPFSQLGGVSPAPFLKHPQWLPFYQHVGPNGGTLLQLQQLVPFNQLVLTNPEGFYQQPIIGGALF

SEQ ID NO: 6308 - protein, 76 aa, Zea mays
  UNSURE (1)..(76): unsure at all Xaa locations
  Clone ID: PAT_MRT4577_81979C.1.pep
  unsure (1)..(76): unsure at all Xaa locations
MSCNCGSSCGCGSSCKCGKXYPDLEETSTAAQATDILGVDPEKRPCPISFRPRWYPTEDVHGCICNGNCKVDHCNY

SEQ ID NO: 6309 - protein, 88 aa, Zea mays
  UNSURE (1)..(88): unsure at all Xaa locations
  Clone ID: PAT_MRT4577_81984C.1.pep
  unsure (1)..(88): unsure at all Xaa locations
MASSTMALSSTAFAGKAVNVPSSSAFGEARVTLRXTAAKAKPAAASGSPWYCPHRVLYLGPLSGVPACYLTGVFRVDYGWNSPGLTVD

SEQ ID NO: 6310 - protein, 84 aa, Zea mays
  Clone ID: PAT_MRT4577_82033C.1.pep
STTSPFLLLALLPTSATLCSHSPSPMPVLSSADASPVSPISFEDYYKRLDITFSDAPAFVDPHGRTSRALSTAHIDSLLDLAQS

SEQ ID NO: 6311 - protein, 65 aa, Zea mays
  UNSURE (1)..(65): unsure at all Xaa locations
  Clone ID: PAT_MRT4577_82069C.1.pep
  unsure (1)..(65): unsure at all Xaa locations
FKTHKGRXQCRRLPALCGVWERVSLSAKPYPRNMQRLGLEHGTFRLQTVGSTAAPGPPFRFKTHS

SEQ ID NO: 6312 - protein, 58 aa, Zea mays
  UNSURE (1)..(58): unsure at all Xaa locations
  Clone ID: PAT_MRT4577_82076C.1.pep
  unsure (1)..(58): unsure at all Xaa locations
VSPATFLIQPQLLPFYQRAGPNAVTXLLQLQQLLPFNQLALTNPAAFYQHPIIVGALF

SEQ ID NO: 6313 - protein, 103 aa, Zea mays
  UNSURE (1)..(103): unsure at all Xaa locations
  Clone ID: PAT_MRT4577_8212C.1.pep
  unsure (1)..(103): unsure at all Xaa locations
GSPGFGFEGERIEMAASDVEYRFFIXXLTXTTDHHSLHSAFXTDRKXLXSKIILHLXTHKSHGFCFFTFFTEEAMRNAIDGMNGKELDGPNITVNEAQSRGGR

SEQ ID NO: 6314 - protein, 93 aa, Zea mays
  UNSURE (1)..(93): unsure at all Xaa locations
  Clone ID: PAT_MRT4577_82255C.1.pep
  unsure (1)..(93): unsure at all Xaa locations
TKTRNAXXDXHEHHXEXKADXGAXKTNPQQXGTXRKNGFIVXKTRPSKVVEVSKNKTGKHGHAKXHFVAIDIFNGKKLEDIVPSSHXCXXPHV

SEQ ID NO: 6315 - protein, 902 aa, Zea mays
  UNSURE (1)..(902): unsure at all Xaa locations
  Clone ID: PAT_MRT4577_82317C.1.pep
  unsure (1)..(902): unsure at all Xaa locations
VRYNLGTEQRCMLCFAVLMAPAPCGRSSQRVFHFGKGKSEGNKNMKELLGGKGANLAEMASIGLSVPPGFTVSTEACQQYQEAGRALPPGLWAEVLDGLRWVEEYMGAALGDPRRPLLLSVRSGAAVSMPGMMDTVLNLGLNDQVAAGLAAKSGDRFAYDSFRRFLDMFGNVVMDIPHALFEEKLEAMKKAKGLKNDTDLTATDLKELVGQYKDVYVEAKGEPFPSDPKRQLELAVLAVFDSWESPRAKKYRSINQITGLRGTAVNVQCMVFGNMGNTSGTGVLFTRNPNTGEKKLYGEFLVNAQGEDVVAGIRTPEDLDAMKDVMPQAYKELVENCRILESHYKEMQDIEFTVQESRLWMLQCRTGKRTGKSAVKIAVDMVNEGLVERRAAIKMVEPGHLDQLLHPQFENPSAYKDQVIATGLPASPGAAVGQVVFTAEDAETWHSQGKSVILVRAETSPEDVGGMHAAAGILTERGGMTSHAAVVARGWGKCCVSGCSGIRVNDAEKVVKIGGNVLREGEWLSLNGSTGEVILGKQPLSPPALSGDLGTFMSWVDDVRKLKVLANADTPEDALAARNNGAEGIGLCRTEHMFFASDERIKAVRQMIMAPTVELRQQALDRLLPYQRSDFEGIFRAMDGLSVTIRLLDPPLHEXFLPEGNVEEIVRELCSETGANQEDALARIEKLSEVNPMLGFRGCRLGISYPELTEMQARAIFEAAIAMTNQGVQVFPEIMVPLVGTPQELGHQVALIRQVANKVFTSMGKTIGYKIGTMIEIPRAALVADEIAEQAEFFSFGTNDLTQMTFGYSRDDVGKFIPIYLAQGILQHDPFEVLDQRGVGELVKLATERGRKARPNLKVGICGEHGGEPSSVAFFAKTGLDYVSCSPFRVPIARLAAAQVLV

SEQ ID NO: 6316 - protein, 44 aa, Zea mays
  Clone ID: PAT_MRT4577_82627C.1.pep
ASKDLKVKRITPRHLQLAIRGDEELDSLIKATIAGGGVIPHIHK

SEQ ID NO: 6317 - protein, 97 aa, Zea mays
  Clone ID: PAT_MRT4577_82701C.1.pep
PTRPRTRGPFFPLSTLQVLVGRRPLYTWVANLDTEVEEGSSQHMDSWISSQPSVSLDLCVGLAPFRLHHQAPVAVFFPRPKLLVEENFLLPPSKKEP

SEQ ID NO: 6318 - protein, 75 aa, Zea mays
  Clone ID: PAT_MRT4577_82704C.1.pep
MSRRRRGCAYESFTRELRDTFQGFHFGSGGRSSSSQCCSFGGSTSYETAVFSGIRVEGNETTEARGCKSDVPGLK

SEQ ID NO: 6319 - protein, 132 aa, Zea mays
  Clone ID: PAT_MRT4577_82761C.1.pep
SYLRRRRRQSRQLMDPMQSSVRGRRSSLHADAVITIGGVRPAPPPQTSTHVCQDEAMVSSGDPSWMSGYRSVEESRVNWREQWRWWSDALCGAKALHVLEHLRHPLMICPALRLPLRHHPRLHLVTFPPLFF

SEQ ID NO: 6320 - protein, 62 aa, Zea mays
  UNSURE (1)..(62): unsure at all Xaa locations
  Clone ID: PAT_MRT4577_82965C.1.pep
  unsure (1)..(62): unsure at all Xaa locations
MNYIEEDLVSTDYQGDSRSSIGEGNVGSGGNGIFMKIVSWYYNXWGYSTRVVKLIRHMNSTN

SEQ ID NO: 6321 - protein, 98 aa, Zea mays
  UNSURE (1)..(98): unsure at all Xaa locations
  Clone ID: PAT_MRT4577_82975C.1.pep
  unsure (1)..(98): unsure at all Xaa locations
MPVWTMISPDTIRRAIGAIGNGTALVIFLSRVTTFIHMWKKGSVEYNSPIPNEPTVQNCMMXVLYGMPAVHLHSMVVITINGTGMVIQMTYVVLFLLY

SEQ ID NO: 6322 - protein, 113 aa, Zea mays
  Clone ID: PAT_MRT4577_83132C.1.pep
MSFLVCDVGGMIAGNKRKHAAARMYSPPLSPSGVIGALSCFSCESSLSATADSRTLATTAAGVGPWAPSAPVSVSSSPEPPGRAPKRAAAAGVPHPLPPDEESRDAWPSTCAA

SEQ ID NO: 6323 - protein, 120 aa, Zea mays
  Clone ID: PAT_MRT4577_83176C.1.pep
VVVVAATAVPPVAAATATPAGSGGTDRWGPPGPVILFASVMFPLVQRGYLRSSRLVSPLRVFESKVPLCPLLVLGSSRGPAGPCLNPHGLWVDGCCSSRQGLFLVPPKEKMVLFGCAPKL

SEQ ID NO: 6324 - protein, 105 aa, Zea mays
  UNSURE (1)..(105): unsure at all Xaa locations
  Clone ID: PAT_MRT4577_83422C.1.pep
  unsure (1)..(105): unsure at all Xaa locations
ATQKAQERTNKGSQRGGVMLLGHTASAATATXFPQCXQAPKRSLLPXDLLPAESSECENPILQPYRIQQAIGAVILPLSPLVLQQSSALLQQLALXHLLAQNIRA

SEQ ID NO: 6325 - protein, 344 aa, Zea mays
  Clone ID: PAT_MRT4577_83725C.1.pep
MEAEKKAPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEVNAKGFICACVAVFCTSLQQITIGSFQKKYNIGSFELLSKTAPIQAISLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAMEAEKKAAAPVPRIKSEMLDGEDVPLKARVSGVPAVDLEDGEMKS

SEQ ID NO: 6326 - protein, 344 aa, Zea mays
  Clone ID: PAT_MRT4577_83726C.1.pep
MEAEKKPPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQITIGSFQKKYNIGSFELLSKTAPIQALSLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAVEAEKKAAAPIPRNKGGMLDGEDVPLKARVSGVPAVDLEDGDVKG

SEQ ID NO: 6327 - protein, 84 aa, Zea mays
  Clone ID: PAT_MRT4577_83846C.1.pep
VFLASSLIFIITYVSNVRVRASHEGIHTYLAYIPITCLDIYICPMEALGPPMRVYIHILRTYTLNMTGESCRDFLSQPKSGTMK

SEQ ID NO: 6328 - protein, 145 aa, Zea mays
  Clone ID: PAT_MRT4577_83935C.1.pep
MAAFAALFDPLYCPEEHLDLYHEGPVEVVDEQWQDQRGQQQPAALDDELPALFEALRDKEGVVLAGDGEEDGYGGSAGREAAVGWASRAAARLGFSALTSALSAAYLDRCFLPGGALRLGDQPWMSRLAAVACVALAAKVEETRV

SEQ ID NO: 6329 - protein, 438 aa, Zea mays
  Clone ID: PAT_MRT4577_83940C.1.pep
SVGDLEASSTPQPNAARAAGPCCPGVYCSLTPRAATPGPRHHSSRPPRRRSGQQEQDVQSGRPGAVSLTTRGPRPIGRTALWCTGVSRPSSLTPSPATPSSILPDGAPGSRNKMSNRATHWCYACRRPIRLRGQDIVCPNCNDGFIQEISEMGGILNTYGLIEPDFEERRARRFGMMDAMSSLMRQRMEEMGRDGLFDIRGRQGTGTEYGRRPTAVPTLVFGGIPSPGVGSGDVNVVLRGGRRAGAAQPNFSSLVVGPSLEALFEQLLLQNNRQGPAPAPQSAIDSMPVVKINRRHLDDDPQCAVCKDKFEVGAEAREMPCKHLYHTDCIIPWLVQHNSCPVCRHPLPSQRSGSTSSARPSAYYNEAADPPGVTRADLEPAPRDGGRESQERRRSFSFLWPFGPSSSRSSSYQYEQNVDEPAVYDPNQIAYSEWHYDH

SEQ ID NO: 6330 - protein, 75 aa, Zea mays
  UNSURE (1)..(75): unsure at all Xaa locations
  Clone ID: PAT_MRT4577_84205C.1.pep
  unsure (1)..(75): unsure at all Xaa locations
TXIFFFFFFFFGVVFWGGPELFHPRSTKITGLNASKDKTKLFYSRFRVHILEPILSIPSRFQKATPPSWGIGPQS

SEQ ID NO: 6331 - protein, 648 aa, Zea mays
  Clone ID: PAT_MRT4577_84221C.1.pep
TLAGSLIPVPHPSPFAKITAAGDSKNLHAHARPRSPASRPRAVADSLSDPDPMGGEVPEPRRLSRSLSFGCGGVPEEALHLVLGYVDDPRDREAASLVCRRWHRIDALSRKHVTVGFCYAVEPARLLARFRRLESLALKGRPRAAMYGLIPEDFGAYAAPWVAELAAPLDCLKALHLRRMTVTDEDIAVLVRARGHMLQVLKLDKCSGFSTDALRLVARSCRSLRTLFLEECIIADEGSEWLHELAVNNSVLVTLNFYMTELKVEPADLELLARNCKSLISLKMSDCDLSDLIGFLQTSKALQEFAGGAFFEVGEYTKYEKVKLPPRLCFLGGLTFMGKNEMPVIFPYSASLKKLDLQYTFLTTEDHCQLIAKCPNLLVLEVRNVIGDRGLEVVADTCKKLRRLRIERGDDDPGQEEQGGVSQIGLTAVAVGCRELEYIAAYVSDITNGALESIGTFCKNMYDFRLVLLDKQNKITDLPLDNGVRALLRSCTKLRRFALYLRPGGLSDAGLGYVGQYSGNIQYMLLGNVGESDNGLIRFAMGCANLRKLELRGCCFSERALAVAVLQMPSLRYVWVQGYRASQTGRDLMLMARPYWNIEFVPPRPESACRVMADGQPCVDTHAQVLAYYSLAGRRPDCPRWLVTLHPA

SEQ ID NO: 6332 - protein, 616 aa, Zea mays
  Clone ID: PAT_MRT4577_84224C.1.pep
ISDEPAPRGSRFAPRSRPMGGEVPEPRRLSRALSFGCGGVPEEALHLVFGYMDDPRDREAASLVCRLWHRIDALSRKHVTVGFCYAVEPARLLARFPRLESLALKGRPRAAMYGLIPEDFGAYAAPWVAELAAPLDCLKALHLRRMTVTDEDIAVLVRARGHMLQALKLDKCSGFSTDALRLVARSCRSLRTLFLEECIIEDEGSEWLHELAVNNSVLVTLNFYMTELKVEPADLELLAKNCKSLISLKMGDCDLSDLIGFFQTSKALQEFAGGAFFEVGEYTKYEKVIFPPRLCFLGGLTFMGKNEMPVIFPYSTMLKKLDLQFTFLTTEDHCQLIAKCPNLSVLEVRNVIGDRGLEVVAATCKKLRRLRIERGDDDPGQEEQGGVSQIGLTAVAVGCRELEYIAAYVSDITNGALESIGTFCKNLYDFRLVLLDKQKKITDLPLDNGVRALLRNCVKLRRFAFYLRPGGLSDVGLGYIGLYSGNIQYMLLGNVGESDNGLIQFATGCTNLRKLELRGCCFSERALAVAVLQMPSLRYIWVQGYRASRTGQDLMLMARPYWNIEFAPPIPESAYRVMADGQPCVDTHAQVLAYYSLAGRRPDCPQWLVTLHPASL

SEQ ID NO: 6333 - protein, 101 aa, Zea mays
  UNSURE (1)..(101): unsure at all Xaa locations
  Clone ID: PAT_MRT4577_84251C.1.pep
  unsure (1)..(101): unsure at all Xaa locations
QQLPFNQLAAAYPEEFLPFNHLAALNSPAYLQQQQLLPFSQLAGVSPAAFLTQPQLXPLSQHAAPKAGPLXRIVTIAPTQXLALTNPAVLHQQPIIGGALF

SEQ ID NO: 6334 - protein, 134 aa, Zea mays
  UNSURE (1)..(134): unsure at all Xaa locations
  Clone ID: PAT_MRT4577_84370C.1.pep
  unsure (1)..(134): unsure at all Xaa locations
PGPSQRVSGEATTTFFNHHNEGRGDSPAASTGYSRVPIVVNRPPARASTERYIEGXRKEHQAPSSTLRRGRLPFAXRRLRTSYEXXTRRXKGTPSTAHKAPRSRXXGRLPRRAVGRRAATYFHEHPXRRRRDPQ

SEQ ID NO: 6335 - protein, 231 aa, Zea mays
  Clone ID: PAT_MRT4577_84406C.1.pep
MGRGKVQLKRIENKINRQVTFSKRRSGLLKKAHEISVLCDAEVALIIFSTKGKLYEYSTDSCMDKILERYERYSYAEKVLISAEYETQGNWCHEYRKLKAKVETIQKCQKHLMGEDLETLNLKELQQLEQQLESSLKHIRTRKSQLMVESISALQRKLAEKQKDQRQQVQRDQTQQQTSSSSMSFMLREAAPTTNVSIFPVAAGGRVVEGAAAQPQARVGLPPWMLSHLSC

SEQ ID NO: 6336 - protein, 304 aa, Zea mays
  UNSURE (1)..(304): unsure at all Xaa locations
  Clone ID: PAT_MRT4577_84407C.1.pep
  unsure (1)..(304): unsure at all Xaa locations
MGRGKVQLKRIENKINRQVTFSKRRSGLLKKAHEISVLCDAEVALIIFSTKGKLYEYSTDSCMDKILERYERYSYAEKVLISAEYETQGNWCHEYRKLKAKVETIQKCQKHLMGEDLETLNLKELQQLEQQLESSLKHIRTRKSQLMVESISALQRKXLLSLLKLAVRTSSFKNCMISLAGHXGHGLLQVLTTLVALLHPQNISALALCCDALLPQEKSLQEENKVLQKELAEKQKDQRQQVQRDQTQQQTSSSSTSFMLREAAPTTNVSIFPVAAGGRVVEGAAAQPQARVGLPPWMLSHLSC

SEQ ID NO: 6337 - protein, 245 aa, Zea mays
  Clone ID: PAT_MRT4577_84409C.1.pep
MGRGKVQLKRIENKINRQVTFSKRRSGLLKKAHEISVLCDAEVALIIFSTKGKLYEYSTDSCMDKILERYERYSYAEKVLISAEYETQGNWCHEYRKLKAKVETIQKCQKHLMGEDLETLNLKELQQLEQQLESSLKHIRTRKSQLMVESISALQRKEKSLQEENKVLQKELAEKQKDQRQQVQRDQTQQQTSSSSTSFMLREAAPTTNVSIFPVAAGGRVVEGAAAQPQARVGLPPWMLSHLSC

SEQ ID NO: 6338 - protein, 245 aa, Zea mays
  Clone ID: PAT_MRT4577_84415C.1.pep
MGRGKVQLKRIENKINRQVTFSKRRSGLLKKAHEISVLCDAEVALIIFSTKGKLYEYSTDSCMDKILDRYERYSYAEKVLISAESETQGNWCHEYRKLKAKVETIQKCQKHLMGEDLETLNLKELQQLEQQLESSLKHIRTRKNQLMLESISELQRKEKSLQEENKVLQKELAEKQKAQRKQVQWGQTQQQTSSSSSCFVIREAAPTTNISIFPVAAGGRLVEGAAAQPQARVGLPPWMLSHLSS

SEQ ID NO: 6339 - protein, 245 aa, Zea mays; identical to SEQ ID NO: 6337
  Clone ID: PAT_MRT4577_84416C.1.pep

SEQ ID NO: 6340 - protein, 245 aa, Zea mays; identical to SEQ ID NO: 6337
  Clone ID: PAT_MRT4577_84417C.1.pep

SEQ ID NO: 6341 - protein, 264 aa, Zea mays
  Clone ID: PAT_MRT4577_84576C.1.pep
MRGTHSLLGRKKHDDDQEKKKQTDELATGMEKVTVSEPEKHGHKEEEHEVVGEKKEGLLAKLHRTSSSSSSSSDEEEEAIDENGEIIKRKKKKMGLKEKLKEKLPGHKDGHHTAAPSPAPAPVETHAHHQEEAHRPHVVPTPAPPPPPHVHQHDHGVVVQDDVKTGTPPHAPEEEKKGLLDKIKEKLPGGHNKKPEAAAAAAPAPPVHAPAPAPQAENVSSPDGKEKKGGLLGKIMDKIPGYHKSSAEEADHKADAAGEHRTSS

SEQ ID NO: 6342 - protein, 291 aa, Zea mays
  Clone ID: PAT_MRT4577_84578C.1.pep
MEDERNTQQHQGGEAQQDAADQVDVKDRGLLDSLLGRKKHDDDQEKKKQTDELATGMEKVTVSEPEKHGHKEEEHEVVGEKKEGLLAKLHRTSSSSSSSSDEEEEAIDENGEIIKRKKKKMGLKEKLKEKLPGHKDGHHTAAPSPAPAPVETHAHHQEEAHHRPHVVPTPAPPPPPHVHQHDHGVVVQDDVKTGTPPHAPEEEKKGLLDKIKEKLPGGHNKKPEAAAAAAPAPPVHAPAPAPQAENVSSPDGKEKKGLLGKIMDKIPGYHKSSAEEADHKADAAGEHRTSS

SEQ ID NO: 6343 - protein, 383 aa, Zea mays
  Clone ID: PAT_MRT4577_84736C.1.pep
MGVGKLMNDVKPYLAMVLLQVGFSGMYIVSVASLKRGMNHFVLVVYRNLVATVVMAPFALLFERRVRPKMTPLIFLKIMGLAVLEPVLDQNMYYLGAKLTSATFASALVNILPAITFLLALALRMERLRLRSLRSQAKVVGTVCTVAGAVLMILYHGPVVPFPWSAGRLHHHVPAAAVESQSSASWLNGICMIIGSCLCWSGFFILQSNTLQSYPAELTLTTLICFLGSVLTGGVALVAERRDMSAWVIGFDTRLFTAVYSGIVCSGVAFYVQGIVTQARGPVFVTAFQPLCMIITTVLGSTILKEETTLGSVIGAAIIVVGLYCLIWGKSKDHLGSNGGKPGAAAVAELPLTSSAPAWSNGKQALAVVETTPPSSLPNKCVH

SEQ ID NO: 6344 - protein, 361 aa, Zea mays
  Clone ID: PAT_MRT4577_84738C.1.pep
MGVGKLMNDVKPYLAMVLLQVGFSGMYIVSVASLKRGMNHFVLVVYRNLVATVVLAPFALLFERRVRPKMTPLIFLKIMGLAVLEPVLDQNMYYLGAKLTSATFASALVNILPAITFLMALVLRMERLRLRSLRSQAKVAGTVCTVVGAVLMILYHGPVVPFPWSAGHHQASAAAAAAAAESQSSASWLNGIVMIIGSCLCWSGFFVLQSNTLQSYPAELTLATLICFLGSVLTGGVALVAERHDMSAWVIGFDTRLFTAVYSGIVCSGVAFYVQGIVTQARGPVFVTAFQPLCMIITTVLGSTILKEETTLGSVIGAAIIVVGLYCLIWGKSKDHLGNGSKPAVAELPLTSAPNGGGTNG

SEQ ID NO: 6345 - protein, 97 aa, Zea mays
  UNSURE (1)..(97): unsure at all Xaa locations
  Clone ID: PAT_MRT4577_84900C.1.pep
  unsure (1)..(97): unsure at all Xaa locations
MESSTMALSSTDFAGKAANVPSTSAFSEARVTMRKTALKDXSTTASGMPWYGPXDRVLYLGPLSGNAPSYLTXEFPGDYGWDTADLSYDPETVSENQ

SEQ ID NO: 6346 - protein, 122 aa, Zea mays
  Clone ID: PAT_MRT4577_84959C.1.pep
MSAMETDINAPPPPAPAGEGSSAAGPSSSRKPNKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 6347 - protein, 144 aa, Zea mays
  UNSURE (1)..(144): unsure at all Xaa locations
  Clone ID: PAT_MRT4577_84993C.1.pep
  unsure (1)..(144): unsure at all Xaa locations
LVLAALAAYSQEQQFXLPFNSTXALFFAFYLQHQQLPFSQLHAAYPQXFLPFNELAALNFPVYLQQQQLLPFSQQDGVSPATYLXQGQRLPFYQHDAPKAGYPLXQVEQLVAFXQLALPNPPAFYQHSIIGGGSFRFPIEGECQ

SEQ ID NO: 6348 - protein, 1059 aa, Zea mays
  Clone ID: PAT_MRT4577_85039C.1.pep
MAGNDWINSYLEAILDAGGAAGDLSAAAGSGDGRDGTAVEKRDKSSLMLRERGRFSPARYFVEEVISGFDETDLYKTWVRTSAMRSPQERNTRLENMSWRIWNLARKKKQIEGEEASRLSKQRMEFEKARQYAADLSEDLSEGEKGETNNEPSIHDESMRTRMPRIGSTDAIDTWANQHKDKKLYIVLISIHGLIRGENMELGRDSDTGGQVKYVVELARALGSTPGVYRVDLLTRQISAPDVDWSYGEPTEMLSPISSENFGLELGESSGAYIVRIPFGPRDKYIPKEHLWPHIQEFVDGALVHIMQMSKVLGEQIGSGQPVWPVVIHGHYADAGDSAALLSGALNVPMVFTGHSLGRDKLDQILKQGRQTRDEINATYKIMRRIEAEELCLDTSEIIITSTRQEIEQQWGLYDGFDLTMARKLRARIRRGVSCFGRYMPRMIAIPPGMEFSHIAPHDVDLDSEEGNGDGSGSPDPPIWADIMRFFSNPRKPMILALARPDPKKNITTLVKAFGEHRELRNLANLTLIMGNRDVIDEMSSTNAAVLTSALKLIDKYDLYGQVAYPKHHKQSEVPDIYRLAARTKGVFINCALIEPFGLTLIEAAAYGLPMVATRNGGPVDIHRVLDNGILVDPHNQNEIAEALYKLVSDKHLWSQCRQNGLKNIHKFSWPEHCQNYLARVVTLKPRHPRWQKNDVAAEISEADSPEDSLRDIHDISLNLKLSLDSEKSGSKEGNSNALRRHFEDAAQKLSGVNDIKKDVPGENAKWSSLRRRKHIIVIAVDSVQDADFVQVIKNIFEASRNERSSGAVGFVLSTARAISELHTLLISGGIEASDFDAFICNSGSDLCYPSSSSEDMLNPAELPFMIDLDYHSQIEYRWGGEGLRKTLIRWAAEKNKESGQKIFIEDEECSSTYCISFKVSNTAAAPPVKEIRRTMRIQALRCHVLYSHDGSKLNVIPVLASRSQALRYLYIRWGVELSNITVIVGECGDTDYEGLLGGVHKTIILKGSFNTAPNQVHANRSYSSQDVVSFDKQGIASIEGYGPDNLKSALRQFGILKD

SEQ ID NO: 6349 - protein, 152 aa, Zea mays
  UNSURE (1)..(152): unsure at all Xaa locations
  Clone ID: PAT_MRT4577_85042C.1.pep
  unsure (1)..(152): unsure at all Xaa locations
FSLSASAATATGFPQCXQGAIACLVPPYLXPAGSSGCENPILEPYRIQQAIGTSILPLSPLCLQQPXGLLQHLPLLHSVAQNMKAQQLQQLVLGNLAAYSQEQQFVPFNQLAALNSAAYVRQQLPFSQLADAYPQQFLPLNQLAAVNSAAYL

SEQ ID NO: 6350 - protein, 77 aa, Zea mays
  Clone ID: PAT_MRT4577_85072C.1.pep
MSARGKEGKALGKAGPKRHRRVLRNTIQGLTNPAIRRLPPRAGLNPISGLIYKETRGVLKIFLENVIRNAVTYTEHA

SEQ ID NO: 6351 - protein, 275 aa, Zea mays
  Clone ID: PAT_MRT4577_85143C.1.pep
MAPAAPYGGAESQRQADLLKQEGNAFFRKERLSAAIDAYTGAITLCPNVAVYWTNRALCYRKRNEWTRVEEDCRTAIQLDSQSVKAHYMLGLSLVNSQRLSEGIKSLEKSLELGRGAHPASYMVEEIWQELSKAKYIEWESLSRDRTCQLQKLKVACKEALTSYNSLDNPAAGAPVEQLNELEEVFKKAAKTDTPAEVPDHLCCKITLDIFRDPVITPSGITYERAVLLDHLQTVGRFDPVTREALEPHQLVPNLAIKEAVHAFLSEHGWAYKIR

SEQ ID NO: 6352 - protein, 74 aa, Zea mays
  UNSURE (1)..(74): unsure at all Xaa locations
  Clone ID: PAT_MRT4577_85159C.1.pep
  unsure (1)..(74): unsure at all Xaa locations
MAAADVEYRCFSCGLAWATSNESLENAFAFYGEILDSNVITDRETGXSVSYGFFTFSFENSMLVAIVIIICNGV

SEQ ID NO: 6353 - protein, 30 aa, Zea mays
  Clone ID: PAT_MRT4577_85189C.1.pep
KGGFLPSRLIWVRQGFSSPDVVKPRPVNLI

SEQ ID NO: 6354 - protein, 210 aa, Zea mays
  UNSURE (1)..(210): unsure at all Xaa locations
  Clone ID: PAT_MRT4577_85206C.1.pep
  unsure (1)..(210): unsure at all Xaa locations
MAEVEAPAAAVAAATPEVATVTEGGAATEAKGPHKLHRQWTFWYDIQSKPKPGAAWGTSLXXAYTFDTVEEFWGLYDHVFRPSKLPGTADFHLFKAGVEPKWEDPECANGGKWTVPCNRKPTFETMWLETLMALVGEQFDETDDICGIVASVRPRGDKLALWTRTASNEAVQVNIGKKWKDVIDYNDKITYTFHDDSRRDKPSRGGRYTV

SEQ ID NO: 6355 - protein, 216 aa, Zea mays
  Clone ID: PAT_MRT4577_85208C.1.pep
MAEVEAPATAVEAPAAAVATTTPEVAAPEAGAATEAKGPHKLHRQWTFWYDIQTKTKSGAAWGTSLKKAYTFDTVEEFWSMYDQIFRPSKLSGNADFHLFKAGVEPKWEDPECANGGKWTVPCNRKATFETMWLETLMALIGEQFDETEDICGIVASVRARGDKLALWTRTASNEAVQVNIGKKWKDVIDYNDKITYTFHDDSKRDKPSRGGRYTV

SEQ ID NO: 6356 - protein, 210 aa, Zea mays
  Clone ID: PAT_MRT4577_85212C.1.pep
MAEVEAPAAAVAAATPEVATVTEGGAATEAKGPHKLHRQWTFWYDIQSKPKPGAAWGTSLKKAYTFDTVEEFWGLYDHVFRPSKLPGTADFHLFKAGVEPKWEDPECANGGKWTVPCNRKPTFETMWLETLMALVGEQFDETDDICGIVASVRPRGDKLALWTRTASNEAVQVNIGKKWKDVIDYNDKIIYTFHDDSRRDKPSRGGRYTV

SEQ ID NO: 6357 - protein, 112 aa, Zea mays
  Clone ID: PAT_MRT4577_85296C.1.pep
SLLSVFLTHYPEPCCHESEPQRVRGEAAQIRLRPVQLRPIDIKINRQVTFCKRLNGLLNKAHQISLLCDAEVALIVFFTKGKLYEYSSHSNMEGILERYQRYSFEERATLNP

SEQ ID NO: 6358 - protein, 41 aa, Zea mays
  Clone ID: PAT_MRT4577_85406C.1.pep
MSSIGQSFYAGDAEAEGEYHVEHAVECVNDTAGAADDISQV

SEQ ID NO: 6359 - protein, 105 aa, Zea mays
  UNSURE (1)..(105): unsure at all Xaa locations
  Clone ID: PAT_MRT4577_8543C.1.pep
  unsure (1)..(105): unsure at all Xaa locations
MGRGLVELKRVENKINRQVTFAXRLNGLLKKAYDLSVLCDAHIXLIFFSNRGKLYKFCIVPSITRTLERYXKNNYAGPHTAVQNTXNDLTHNTPNEYLKLKAKVD

SEQ ID NO: 6360 - protein, 277 aa, Zea mays
  Clone ID: PAT_MRT4577_85444C.1.pep
MRTPIGNPPKIPFSQSPLPVPDLVHSHSRNPAAPRLMASCGAGDAASAQPRASISHVIFDMDGLLLDTEGFYTEVQEKILARYDKVFDWSLKAKMMGKKAAESARIFVDECGLNGLLTPEQFLEERESMLQALFPSCTRLPGVLRLVHHLHANGVPMAVATGSHKRHFALKTQNHQEMFSLMHHVVMGDDPEVKAGKPSPDIFLAAMRRFEGGVEPSKCLVFEDAPSGVAAAKNAGMSVVMVPDPRLDVSYHKGADQVLSSLLDFKPAEWGLPAFKE

SEQ ID NO: 6361 - protein, 359 aa, Zea mays
  Clone ID: PAT_MRT4577_85466C.1.pep
MEEITQHFGVGASSHGHGHGQHHHHHHHHHPWASSLSAVVAPLPPQPPSAGLPLTLNTVAATGNSGGSGNPVLQLANGGGLLDACVKAKEPSSSSPYAGDVEAIKAKIISHPHYYSLLTAYLECNKVGAPPEVSARLTEIAQEVEARQRTALGGLAAATEPELDQFMEAYHEMLVKFREELTRPLQEAMEFMRRVESQLNSLSISGRSLRNILSSGSSEEDQEGSGGETELPEVDAHGVDQELKHHLLKKYSGYLSSLKQELSKKKKKGKLPKEARQQLLSWWDQHYKWPYPSETQKVALAESTGLDLKQINNWFINQRKRHWKPSEEMHHLMMDGYHTTNAFYMDGHFINDGGLYRLG

SEQ ID NO: 6362 - protein, 117 aa, Zea mays
  UNSURE (1)..(117): unsure at all Xaa locations
  Clone ID: PAT_MRT4577_85513C.1.pep
  unsure (1)..(117): unsure at all Xaa locations
MHIIVPTMAAKLFXLLMLLGLSASAASGTMFPQCSQATIAFLLPAYLLPAASLRCENHXFQPYGIQQAIGAGIXPLSPLLLQHXYTLLQQCPSVHXLAQNIKAQQLQQLVLANLADY

SEQ ID NO: 6363 - protein, 306 aa, Zea mays
  Clone ID: PAT_MRT4577_85555C.1.pep
MEGNAAAGKRSRTETANGAAGGGKRSKDMESFQTGLSSKSKPCNKFFSTIGCPFGEGCRFLHFVPGGYPAVAKMLNLGSPAVSAPSRTHVDHAALTGASHSASSGKTRMCTKYNTTEGCRFGDKCHFAHSERELGKPAYMPYGEPPMGGRFGGRPEPVQPAAMGPPAGNFGASATAKISVDASLAGGIIGKGGVNTKQISRVTGVKLCIRDHESSPNLKNIELEGNFDQIKQAGEMVRDLIATISTSMLAKNSSAAVAPSGGRGGGLGGKSNYKTKLCENFVKGACTFGERCHFAHGENEQRRGAV

SEQ ID NO: 6364 - protein, 68 aa, Zea mays
  Clone ID: PAT_MRT4577_85632C.1.pep
PAREEHKTGGILDRSGGSSSSSPEDDGLGGRRKTGLKENIKEKLPGGHKDHQHATATTGGAYRQHGHT

SEQ ID NO: 6365 - protein, 55 aa, Zea mays
  Clone ID: PAT_MRT4577_85749C.1.pep
MNSRRSLLSSPLFASSSPNLRSSASVYSSPSPSRTTVPMIHDTSSRRAFTACHYW

SEQ ID NO: 6366 - protein, 162 aa, Zea mays
  UNSURE (1)..(162): unsure at all Xaa locations
  Clone ID: PAT_MRT4577_85964C.1.pep
  unsure (1)..(162): unsure at all Xaa locations
LSPMVCSVCENPILXPYTIQQAIAAVILPLSPLFLQHSSDLLQKIPLGHLXSXNIRAQQLQQLVLSNLVVYSQKQKILSFNQLYALNSAFYLRQQQLPFRQLYVVYTQQFFLFYQLTALNSPAYLQQQQLLSFSHLSVVRPAIFLTQTHMLSLYQNAVPIAV

SEQ ID NO: 6367 - protein, 88 aa, Zea mays
  UNSURE (1)..(88): unsure at all Xaa locations
  Clone ID: PAT_MRT4577_85988C.1.pep
  unsure (1)..(88): unsure at all Xaa locations
LFPIRRVHTSASLRSRWRAAGEKKMITLKSSDGEEFEVXEEAVAMDSQTIRHMIEDDCADNGIPLSNVNFKILSKVIEFCNKHVHCLV

SEQ ID NO: 6368 - protein, 62 aa, Zea mays
  UNSURE (1)..(62): unsure at all Xaa locations
  Clone ID: PAT_MRT4577_86049C.1.pep
  unsure (1)..(62): unsure at all Xaa locations
RKKLKASSRRGGRACGRXRRRRGRYCRGRRSRPRGTRGPWCARGGRXGRXRGRARGGCWWWA

SEQ ID NO: 6369 - protein, 348 aa, Zea mays
  Clone ID: PAT_MRT4577_8623C.1.pep
MVTPYLPSSHNHRRRLPILLKIGFLLMMGENKLMGKRWEDMDTDVLVKIFKELNLVELSPVSQVCRLWRLACSDPLIWGTLDFGLLKSNFIQTRASPYIWVDDRSDRRLARILRVAMAISCGNVNCMIFHYNLFMKDEHLHFISERSPHLKRLVMPAWNRITKVGICNAIQRWQALESLTMPTIGHPPYIMEEIARSCKNFTELKIMGSFDQQFASAILQFLPKLKVLSLRCSKVSMDALQCLLNSMEYLEVLNISHCLLLVVAANGRKQVVHELDSQILERASRLREFHYCQSRLCVACQRMVVDEGIMRWYRYEDWFWRRDEVRSLDLQDYGKLFDVGCERLTSVD

SEQ ID NO: 6370 - protein, 191 aa, Zea mays
  UNSURE (1)..(191): unsure at all Xaa locations
  Clone ID: PAT_MRT4577_86264C.1.pep
  unsure (1)..(191): unsure at all Xaa locations
MSLLRRLLLDPAEPVIIMCGLARSTTFKSKGDAAACMRXPQNAGTARNNGFIVIKNRPXKGVEVSTSXTGKNGHAKCHFVGIDIFNGQELEDIDPSSHNXDIPHAHRTEYQLXIDISHDGLDILLTSNGNTKEDLRLPTDDTLGCQIDERFASVHDPGENVQTAMEEEHICALNDEVPDQLPCLGILYLLT

SEQ ID NO: 6371 - protein, 86 aa, Zea mays
  UNSURE (1)..(86): unsure at all Xaa locations
  Clone ID: PAT_MRT4577_86377C.1.pep
  unsure (1)..(86): unsure at all Xaa locations
PISTHAYGEHTKHISVLTFSAKIFCFRMVLDLSASAATATILPQCSQAPIASFLSPYLSPSVSSVCANPILXPYSIQQAFXARILP

SEQ ID NO: 6372 - protein, 253 aa, Zea mays
  UNSURE (1)..(253): unsure at all Xaa locations
  Clone ID: PAT_MRT4577_86526C.1.pep
  unsure (1)..(253): unsure at all Xaa locations
WLVEVSDEYKLVADTLYLTVYLIDQFLSQNCIQTHKLQLLGITSMLIASKYEEYSAPSAEEFCNITAGTYAKAEVLEMEQQVLNDLGFHLSVPTTNTFLRRFLRAAQASRTVRSVPKPHCNESFQSICIVLNTKLAXHFQAHLTTLNYLASYLAELTLISYDFMKFLPSEVAASSIFLAKWTLDQSDHPWNPTLEHYTSYKSFDIRTCVRALQELQHNTSNCPLNAIREKYGQQKFECVANLRSPELLRSLFS

SEQ ID NO: 6373 - protein, 649 aa, Zea mays
  UNSURE (1)..(649): unsure at all Xaa locations
  Clone ID: PAT_MRT4577_86577C.1.pep
  unsure (1)..(649): unsure at all Xaa locations
MSRDLDCPVQTQMAVAVLDRSFSSEYPGGSRIEGRQLSWKRVFVQTDNGSVLGIELERGENVQTVKKKLQIALNVPTDESSLTFGDLVLNNDLSSIRNDSPLFLKRNQIHRSNSTPCLSPTGKNVLQRDRSGPIEILGCSSPSSRMKQLAKDVIKAIMNDVDPVAVNSGMGGAYYFKNIWGERVAIVKPTDEEPFAPNNPKGFVGKALGQPGLKRSVRVGETGFREVAAYLLDYGHFANVPPTMLVKITHTIFNVNDCVGCKSKVFCNKSEAVSKIASLQEFIPHDFDASDHGTSSFPVSAVHRIGILDIRIFNTDRHAGNLLVKKLGPGADNFGEQTELIPIDHGLCLPECLEDPYFEWIHWPQASVPFSEEELEYIARLDPVKDAEMLRMELPMIRDACLRVLVLSTVFLKEAAASGLCLSEIGDMMSRQFTAKEEEPSQLELLCMEARKWVEERESFLPNEAGVEDDDDDFTQFLIDDEDDYPDALEPSAFCKFGSMKASSRNPLSKLDERDEEDGDGTEEDDDDDILTGALPQRISSISKLSSSMKGLXSLGNPSPTARAFGRVKRQAELSXGKASEHQSGSRSANELLPPSASFVKLSDMSPKQWSAFLDKFQELLPGALSARKHAAGVVGQRSMPRLGTSCQF

SEQ ID NO: 6374 - protein, 588 aa, Zea mays
  Clone ID: PAT_MRT4577_86650C.1.pep
MQAPEQQQQHQQRQRKGSSEMDFFSEYGDANRYKIQEVIGKGSYGVVCSAVDQHTGDKVAIKKIHNIFEHLSDAARILREIKLLRLLRHPDIVEIKHIMLPPSRRDFKDIYVVFELMDTDLHQVIKANDDLTREHHQFFLYQMLRALKYIHTANVYHRDLKPKNILANANCKLKICDFGLARVAFNDTPTTVFWTDYVATRWYRAPELCGSFFSKYSPAIDIWSIGCIFAEILTGKPLFPGKNVVHQLDLMTDLLGTPSLDTVSRIRNEKARRYLSSMRKKQPVPFTEKFPKADPAALKLLQRLLAFDPKDRPTAEEALADPYFKGLAKVEREPSCQPITKMEFEFERKKATKEDVKELIFREILEYHPQLLKDYMNGTEKTNFLYPSAVDNFRRQFANLEENGGKSGAHAASSDRKHVSLPRTTTVHSNPIPPNGTSQVPQKIPTGRPGRVVGPVIPFENAAAVDPYSQRRVSRNPVLPPTTSNMSAYAYHRKSDNSDRELQQELEKDRMQYQPAQRFMDAKVVSQMSPDLRSSYYIPKGVPKADPADRTALHSSMIHGIAPFSGIAAVGGGYNKVNAVQYGVSRMY

SEQ ID NO: 6375 - protein, 70 aa, Zea mays
  Clone ID: PAT_MRT4577_8668C.1.pep
KAPGDSLRVQRPIKIQFGDLPETRGGFIGYYVPQFRVQLLRKKKRSLCLEILGNPNHARIFFQSPPHTLF

SEQ ID NO: 6376 - protein, 121 aa, Zea mays
  UNSURE (1)..(121): unsure at all Xaa locations
  Clone ID: PAT_MRT4577_86803C.1.pep
  unsure (1)..(121): unsure at all Xaa locations
MSDSEEHYFESKTDAGEFKTYPXQADTVRKNDFIVIKTRPCKAVQVSTSKTGKHGHDKCHFVAIYIFDGKKLEDSVPSSHNXEVPHANRTEHTVIDISEDGLLSLLTSDVHTKDDLTLASD

SEQ ID NO: 6377 - protein, 107 aa, Zea mays
  UNSURE (1)..(107): unsure at all Xaa locations
  Clone ID: PAT_MRT4577_86949C.1.pep
  unsure (1)..(107): unsure at all Xaa locations
QPTRPRTRPLLPPIFASDESTSCSQWNTAMEKRTRWTRQEVVGNFRIGDVFGNCCRLNGLHALTXFTVVTHNAIDRHDSEKFPFSIFDKNGKXVHALSTATTLSNTD

SEQ ID NO: 6378 - protein, 364 aa, Zea mays
  Clone ID: PAT_MRT4577_87182C.1.pep
MASMESLIGMMNRIQRACTALGDHGGGSDLPTLWESLPTIAVVGGQSSGKSSVLESIVGTDFLPRGSGIVTRRPLVLQLQQTEDGSQEYAEFLHMPKRRFSDFALVRQEIADETDRLTGKTKQISPVPIHLSIYSPKVVNLTMIDLPGLTKVAVEGQSESIVQDIENMVRSYVDKPNCIILAISPANQDIATSDAIKLSKEVDPTGERTFGVLTKLDLMDKGTNALDVLEGRAYRLQNPWVGIVNRSQADINRKVDMISAREKEREYFETSPDYAHLSSRMGSGYLAKLLSQHLESVIKAHIPSITATINKTIDELESELDIIRRAVAADPGAQLDTILDLCRAFDRVFKEHLDGGRSGGDRIY

SEQ ID NO: 6379 - protein, 130 aa, Zea mays
  UNSURE (1)..(130): unsure at all Xaa locations
  Clone ID: PAT_MRT4577_87375C.1.pep
  unsure (1)..(130): unsure at all Xaa locations
DLLCRHALTLHVGMQMLVYHIVGGTLMARQLWTSGVGXDVXRSNAWVLALCICLYFAWLAWSWRPLGWLIPSEVLVLXVRSAGQSMRLCVNRLLTFMIGHALLSMLGSLKFRLFYVLPGWMFIMTTFNRH

SEQ ID NO: 6380 - protein, 146 aa, Zea mays
  UNSURE (1)..(146): unsure at all Xaa locations
  Clone ID: PAT_MRT4577_87463C.1.pep
  unsure (1)..(146): unsure at all Xaa locations
LVAQYIRALRLQHRVLANLAAYSQXQHQFLPLVQLAALTCAAYLQQPVPFSQVPAAYPQQFLPFNPLAAFSSAAYXHHHQLLPFSQLTDVNPPAFLTQRQLFPFYHLAMPNAGPLIQLHQLLPFNQLALANPPVFCQRPIIGGALF

SEQ ID NO: 6381 - protein, 298 aa, Zea mays
  Clone ID: PAT_MRT4577_87571C.1.pep
MPRSGGGGNGGGISSSSRVMPNLPAGFRFHPTDEELMVHYLMRQAASMPCPVPIIAEVNIYQCNPWDLPAKALFGDKEWFFFSPRDRKYPNGARPNRAAGSGYWKATGTDKAILSSSTPTSHGGANIVVGVKKALVFYGGRPPKGTKTDWIMHEYRLSGAADDDCKGSTRRRVSSSSSSSMRLDDWVLCRIHKKSNDFQLSSSSEHEHEQEEPAAGGSATTVEELDALVVVDNSSSSDTTTTTITTNDNNSTETAATHHDPQTMMMLSKSCSLTDLLDSIDYAALLADAPPRRAPPPR

SEQ ID NO: 6382 - protein, 208 aa, Zea mays
  UNSURE (1)..(208): unsure at all Xaa locations
  Clone ID: PAT_MRT4577_87573C.1.pep
  unsure (1)..(208): unsure at all Xaa locations
MPSGGNGGGSGSSRSRVMPNLPAGFRFHPTDEELMVHYLMRHAASMPCPVPIIAEVNIYQCNPWDLPAKALFGDKEWFFFSPRDRKYPNGARPNRAAGSGYWKATGTDKAILXRRRRPRPRATAAPNVVVGVKKALVFYGGRPPKGTKTDWIMHEYRLSGAADDDCKGSTRRRAPSLLVVLHEAGTNWVAVQDPQEEHGFPCRSSEHE

SEQ ID NO: 6383 - protein, 510 aa, Zea mays
  Clone ID: PAT_MRT4577_87628C.1.pep
MAQLAVRSLLLSLLLVSPVVASPGIVKLNSSSTLFGIEFPPFNTAVAATGCDSKLVAADEAGDEQKQPASSSPSLQLRMKHRSAEGGRTRKESFLDKAEKDAVRIETMHRRAARSGVARMPASSSPRRALSERMVATVESGVAVGSGEYLIDVYVGTPPRRFRMIMDTGSDLNWLQCAPCLDCFEQRGPVFDPAASSSYRNVTCGDQRCGLVAPPEAPRACRRPAEDSCPYYYWYGDQSNTTGDLALESFTVNLTAPGASRRVDGVVFGCGHRNRGLFHGAAGLLGLGRGPLSFASQLRAVYGHTFSYCLVEHGSDAGSKVVFGEDYLVLAHPQLKYTAFAPTSSPADTFYYVKLKGVLVGGDLLNISSDTWDVGKDGSGGTIIDSGTTLSYFVEPAYQVIRQAFVDLMSRLYPLIPDFPVLNPCYNVSGVERPEVPELSLLFADGAVWDFPAENYFVRLDPDGIMCLAVRGTPRTGMSIIGNFQQQNFHVVYDLQNNRLGFAPRRCAEV

SEQ ID NO: 6384 - protein, 134 aa, Zea mays
  UNSURE (1)..(134): unsure at all Xaa locations
  Clone ID: PAT_MRT4577_87657C.1.pep
  unsure (1)..(134): unsure at all Xaa locations
AIAAGMLPLSPLLLQQSSVLLQQLPGAHXLAQNIMAQQLQQLELANLAGYSXKQQTIPFNQLGSWNSACYVQQQQLPFSQIPAGYRQQFXLPSNQIAGLNFPAYIQQQQLLPFSQLAGVSHDAFLTQPQVVPCY

SEQ ID NO: 6385 - protein, 285 aa, Zea mays
  UNSURE (1)..(285): unsure at all Xaa locations
  Clone ID: PAT_MRT4577_87713C.1.pep
  unsure (1)..(285): unsure at all Xaa locations
AFAPVSAHSDASLLESQEALDVSSTLSNEEDERATHGTVSIECDGDEAETVSKRRKLELDALEATLTATTSTTSTIDMGPAASRAVREPRVVVQTTSEVDILDDGYRWRKYGQKVVKGNPNPXVRKHVERASHDLKSVITTYEGKHNHEVPAARNSGQGSSSAPSASQAGGSHRRQEPAQASFAHFGTASFSSFGLPPXWSVGTNNWQFRLRDGSPRHDDPSXSLGSLAPVKMVGNSSAMQGYPGLMVPGEPKVEPVSQPLIQMANASPPAYQQILSRPPFGHQM

SEQ ID NO: 6386 - protein, 222 aa, Zea mays
  Clone ID: PAT_MRT4577_87716C.1.pep
SVPASSRAVREPRVVVQTTSEVDILDDGYRWRKYGQKVVKGNPNPRSYYKCTHPGCSVRKHVERASHDLKSVITTYEGKHNHEVPAARSSGQGSSGSGSGPSAPQAGGSHRRQEPAQASFAHFGTSPFSSFGLAPSGQLGPTTGNFRFGMVPPGATIPMPSLGSLAPTKMIGNPSAMQGYPGLMMPGEPKVEPFSRPHFPTSIAPPPAYQQILSRPPFGHQM

SEQ ID NO: 6387 - protein, 250 aa, Zea mays
  UNSURE (1)..(250): unsure at all Xaa locations
  Clone ID: PAT_MRT4577_87719C.1.pep
  unsure (1)..(250): unsure at all Xaa locations
MGPASSRAVREPRVVVQTTSEVDILDDGYRWRKYGQKVVKGNPNPRSXSLPFLTLNDXCIPPSPEASNIDSLACRSYYKCTHPGCSVRKHVERASHDLKSVITTYEGKHNHEVPAARSSGQGSSGSGSGPSAPXLVVLTVGKNLHKPASLTLVHLLSXFGLAPSGQLGPTTGNFRFGMVPPGATIPMPSLGSLAPTKMIGNPSAMQGYPGLMMPGEPKVEPFSRPHFPTSIAPPPAYQQILSRPPFGHQM

SEQ ID NO: 6388 - protein, 567 aa, Zea mays
  UNSURE (1)..(567): unsure at all Xaa locations
  Clone ID: PAT_MRT4577_87724C.1.pep
  unsure (1)..(567): unsure at all Xaa locations
MSGASNYGSLIDEWLPPPTPSPRTLMSSFLNEEFSSAPFSGPHDQSEKSREVLNSSDEVPSHAVKGLFQNGFSNLFSAKSNSNGGLAERRAARAGFSVPKIDTSRVGSSTVIRSPVSIPPGLSPTTLLESPVFLYNKMAQPSPTTGTLPFLMATNDKSTISPAAKITEDSTFDNDVFSFQPHLGSEQTGFSTAEKKKRKSPKKQSLSNIHQQESSLQSSFTAVKDNTSATIVKAKPSSSSMFSDSHYSADQQQADETNIKVQGKGVEARSAAFAPVSAHSDASLLESQEALDVSSTLSNEEDERATHGTVSIECDGDEAETVSKRRKLELDALEATLTATTSTTSTIDMGPAASRAVREPRVVVQTTSEVDILDDGYRWRKYGQKVVKGNPNPRSYYKCTNPGCSVRKHVERASHDLKSVITTYEGKHNHEVPAARNSGQGSSSAPSASQAGGSHRRQEPAQASFAHFGTASFSSFGLPPXWSVGTNNWQFRLRDGSPRHDDPSXSLGSLAPVKMVGNSSAMQGYPGLMVPGEPKVEPVSQPLIQMANASPPAYQQILSRPPFGHQM

SEQ ID NO: 6389 - protein, 67 aa, Zea mays
  Clone ID: PAT_MRT4577_87804C.1.pep
LHILLRFGARMVLELWEQATHGCHRDGTGRRRGSKAGPGRDTHWKFQCELLSLYYVIGEECCWLIVS

SEQ ID NO: 6390 - protein, 232 aa, Zea mays
  UNSURE (1)..(232): unsure at all Xaa locations
  Clone ID: PAT_MRT4577_87810C.1.pep
  unsure (1)..(232): unsure at all Xaa locations
EPAGLLPGGYXAVSEMTNLGGATIAPPGGMMMDGPPTPIVKTRLCNKYNTAEGCKWGDRCHFAHGERELGKSMMDNYMPPPIGPPPTGYFAPPPMAPPPMAPPPMAPPPMAPPPMAPPPMAPPPMAPPPMAPLPMAPPPMAPPPMAPPPMAPPPMAPLPMAPPPMAPPPMAPPPMAPPPMAPPPMAPPPMANPGLATPASFGAYATAKISVDASLAGGIIGKGGANIKQISS

SEQ ID NO: 6391 - protein, 358 aa, Zea mays
  Clone ID: PAT_MRT4577_87811C.1.pep
MDGSRKRVDAEDVKGDSTGGKRLRASESFQSGVGSKVKLCTNFFSTYGCPFGEGCHFVHYFPGDYRAVSEMTNLGGATIAPPGGMMMDGPPTPIVKTRLCNKYNTAEGCKWGDRCHFAHGESELGKSMMDNYMPPPIGPPPTGYFAPPPMAPPPMAPPPMAPPPMAPLPMAPPPMAPPPMAPPPMAPPPMAPLPMAPPPMAPPPMAPPPMAPPPMAPLPMAPPPMAPPPMANPGLATPASFGAYATAKISVDASLAGGIIGKGGANIKQISSVTGAKVVIQEDRHESDTSLKNIEFEGTFDQIRNASAMVIELIVSISGIGSNFKTKMCENFAKGSCSYGGKCHFAHGESELRKPAAA

SEQ ID NO: 6392 - protein, 65 aa, Zea mays
  Clone ID: PAT_MRT4577_88005C.1.pep
MALFVEKTLSGPEYKVKDLLQADFGRLEIELAEVEMPGLMACRAQFGPFKPFAGARILGAFYMTH

SEQ ID NO: 6393 - protein, 158 aa, Zea mays
  UNSURE (1)..(158): unsure at all Xaa locations
  Clone ID: PAT_MRT4577_88118C.1.pep
  unsure (1)..(158): unsure at all Xaa locations
GLSASADTAAIFAQCSQASIAFFVAPYLXPAVFSVCENPILQPYRIQQAVASGILPXQPXLLQERSDLLQELPLVHTWAHNIKAQQLQQLVLGNLADYSQKQQFLAFNQLAALNSAAYLQQQLPFSQVAAAYPQQFLPFNQLAALNYAAYIQQQQLPP

SEQ ID NO: 6394 - protein, 58 aa, Zea mays
  Clone ID: PAT_MRT4577_88143C.1.pep
SCLLTYSDRSSGGHPGKFTCLRTTNFHNNSWGGVLHRKPKRHPRNCDDLKSHPSEAPW

SEQ ID NO: 6395 - protein, 148 aa, Zea mays
  UNSURE (1)..(148): unsure at all Xaa locations
  Clone ID: PAT_MRT4577_8821C.1.pep
  unsure (1)..(148): unsure at all Xaa locations
LPEVPLVHLYGAKMRAQQLQQLVLANLGAYFXQQEFLPFNQLGSLNSGSYLQQQQLPFSQVPGGYPQQFLPFNQLAALDSPAYLQEQPLLPFSQLAGVSPGSFLTQPQLVAVYQDGGPKACPLLQLXQLLALKQHGLAKPEGGTDDSS

SEQ ID NO: 6396 - protein, 116 aa, Zea mays
  Clone ID: PAT_MRT4577_8822C.1.pep
RRSSLLLTPTARRIHADVACGVLILVVQDFFSDTQILTNHSGLLLPDDRPAYPFLLIALLPPSTALGSDPPAPMAALTAADASPGSDIDGEGYENRLEITFCDAPVFADPHGRGLR

SEQ ID NO: 6397 - protein, 527 aa, Zea mays
  Clone ID: PAT_MRT4577_88255C.1.pep
MHSTNLLLEEPIRMASILEPSKPSYFPAMTKIVGTLGPKSRSVDTISACLKAGMSVARFDFSWGDAAYHQETLENLKLSIKSTKKLCAVMLDTVGPELQVVNKSETPISLEENGTVVLTPHRGQDASSSLLPINFSGLAKAVTPGATIFVGQYLFTGSETTSVWLEVSEVKGDDVVCIIKNTATLAGSLFTLHCSQIHIDLPTLSDEDKDVIRKWGTPNKIDFLSLSYTRHAEDVRQAREFLSKLGDLSQTLIFAKIENVEGLNQFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKQTVKYVGEPMTHLESIASSAVRAAIKVKASVIICFTSSGRAARLIAKYRPTMPVLSVVIPRLKTNQLRWSFTGAFEARQSLIVRGLFPMLADPRHPAESTSNTNESVLKVALDHGKACGVIKSHDRVVVCQKVGDSSVVKIIELDD

SEQ ID NO: 6398 - protein, 528 aa, Zea mays
  UNSURE (1)..(528): unsure at all Xaa locations
  Clone ID: PAT_MRT4577_88257C.1.pep
  unsure (1)..(528): unsure at all Xaa locations
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEASSTLLPINFDGLAKALTPGATIFVGQYLFTGSETTSVWLEVSEVKGDDVVCIIKNTATLAGSLFTLHCSQIHIDLPTLSDEDKDVIKKWGAPNKIDFLSLSYTRHAEDVRQAREFLSKLGDLSQTQIFAKIENVEGLNHFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYYKRTVKYVGEPMTHLESIASSAVRAAIKVKASVIICFTSSGRAARLIAKXYRPTMPVLSVVIPRLKTNQLRWSFTGAFEARQSLIVRGLFPMLADPRHPAESTSNTNESVLKVALDHGKACGVIKSHDRVVVCQKVGDSSVVKIIELDD

SEQ ID NO: 6399 - protein, 73 aa, Zea mays
  UNSURE (1)..(73): unsure at all Xaa locations
  Clone ID: PAT_MRT4577_88302C.1.pep
  unsure (1)..(73): unsure at all Xaa locations
MAGRGKAIGAGAAKKATSRSSKAGLQFPVXRIARFLKAGKYAERVGVGAPVXLXAVLEYHAXEVLXLAGNAAR

SEQ ID NO: 6400 - protein, 132 aa, Zea mays
  UNSURE (1)..(132): unsure at all Xaa locations
  Clone ID: PAT_MRT4577_88348C.1.pep
  unsure (1)..(132): unsure at all Xaa locations
SFLGLGMTTYTGWYLTIAAAVHGQVPGVTHSGPSKLVPYFTGATNILYTFGGHAITVEIMHAMWKPRKFKYIYLLATLYVFTLTLPSAAAMYWAFGDQLLTHSNAFSLLPRTPWRDAXVVLMLVHQFITFGF

SEQ ID NO: 6401 - protein, 63 aa, Zea mays
  UNSURE (1)..(63): unsure at all Xaa locations
  Clone ID: PAT_MRT4577_88697C.1.pep
  unsure (1)..(63): unsure at all Xaa locations
MSCSCGSSCNCGSSCKCGKKYPDLEEKSTAAQATVGGGGAPEKTAAAEFEAGAESXAETSHGC

SEQ ID NO: 6402 - protein, 119 aa, Zea mays
  Clone ID: PAT_MRT4577_88720C.1.pep
QLAGGGSGESPEFSEATVSEVVSTGQTECGEYKKEGQQHKHKQHLGEAGAIAAGAFALYEKPGAKKDPERAPRLKIEQEVAEAAAVGSGGFAFREHHPQNKGRKDAQEAVGAKKLHFLG

SEQ ID NO: 6403 - protein, 450 aa, Zea mays
  UNSURE (1)..(450): unsure at all Xaa locations
  Clone ID: PAT_MRT4577_88792C.1.pep
  unsure (1)..(450): unsure at all Xaa locations
VNGQALQFVYGSKQVFTQGGILAATXTTNLYRSQRFKEAMKDVMTQCCSPDEVIFGPDFHQSLYCHLLCGLIYSDEIQFVFSPFAHSLVHAFHSLEEVWEDLCADIRDASLSERARRSSTTTSASAAXVPNPELASSIYIKCQSLSNWYGVIPTLWPNVKYIYGIMTGSMEPYLKKLRHYAGHLPLLSADYGASEGWVGSNVNPTLPPEEVTYAVLPNIAYFEFIPLEKPXGGNGXCSSVHYIESEPVGLTEVEVGKIYEVVITNFAGLYRYRLGDIVKIAGFRNATPELQFICRRSLVLSVNIDKNTEKDLQLAVEAAEKLLAAEKLEVVDFTSLVDRSSEPGHYVVFWELSSDDGASEDVLSGCASCMDLAFADAGYVGSRKTQTIGALELRVLRKGAFAQVMNHYLSLGGAVSQFKTPRFVSQSNSKVLQILSRNVTRSYFSTAYGL

SEQ ID NO: 6404 - protein, 97 aa, Zea mays
  UNSURE (1)..(97): unsure at all Xaa locations
  Clone ID: PAT_MRT4577_88848C.1.pep
  unsure (1)..(97): unsure at all Xaa locations
MAAADVEYRCSDGGLAWATSNESLENAFVYYGEILDSKVITDRQTERSRRLXLVTFSCENSMLDAIENMNGKELYGLNITVNHAHTSDGSGRSCCRG

SEQ ID NO: 6405 - protein, 87 aa, Zea mays
  UNSURE (1)..(87): unsure at all Xaa locations
  Clone ID: PAT_MRT4577_88850C.1.pep
  unsure (1)..(87): unsure at all Xaa locations
MSGRGGGGMGLGEGGANRHRKVLHDNIQGITKPAIRRLARQGGVKRISELMYKETRDVLKIFLXNFMLDVVSYTEHARRKTVTAMYV

SEQ ID NO: 6406 - protein, 131 aa, Zea mays
  UNSURE (1)..(131): unsure at all Xaa locations
  Clone ID: PAT_MRT4577_88950C.1.pep
  unsure (1)..(131): unsure at all Xaa locations
MSEEKYHHFFDHHQXDEEQPAGEYGYSETEVVTVTVEGXYKRYKKEEKEYEHXQHLGEGGAIXAAGAFALYEKHEAKKDLEYACRYKIREEVAGAVVVVVGEYVFHEHHEKKKDHKDAEEASGEKKHRHLF

SEQ ID NO: 6407 - protein, 663 aa, Zea mays
  Clone ID: PAT_MRT4577_88994C.1.pep
MQGQRNSMEHFADVFGFDVASSSGNPVMDQQSYWNNVLGSVESHNLQGYQMAHSDAAMPYGNEPQQDGTFLGFWESGEASSSASALNYGSSNNVKTEHLNIGGGGGLRIGESRLVADNGISLDVDINLNANVNDLCGQSSNVNCASQGPEQYCGSDRNAINSQPTDLGLHPFRTFLLDAQQAESFTLNPSENPLGDFSSMQESIEQRPGGSLDGRRLACKRKNIEGANGQSSAGASTSFPHRNDNAFHNIASSSYNPAPIRNSSSPKCLPVPSSIEDQLPRYGTNVGLSAGTYDLHGGVNNAVNSQRSFRARTTTSQQVAPCSVWPSSNAIRLSNSWNHQPPHFQSAFDDPQEVIPVVSSLNLQYQHPMNVPGVPQAANRFTDHGASSSRAGSLENRIIGSEEAPRRYAAPTNYSDLVPPPAVDPRRLLPEPSNWSSDVRGTAISGSIPPVSRANNSATVNPPAGFSHQNLTRRHPRNLSEEIGRLSGALRGHQPPRLRPGFLLERQGDGVWGVPLSTRGREGRRLMEIRNALEMIHRGENVRLESIFYGGVDIHDRHRDMRLDIDNMSYEELLALEERIGNVGTGLSEEAVIRLLKQRKFSSWTLKASLDPEPCCICQEEYADGDDLGRLDCGHDFHAGCIKQWLVVKNVCPICKSTALKKT

SEQ ID NO: 6408 - protein, 94 aa, Zea mays
  Clone ID: PAT_MRT4577_88998C.1.pep
YEELLALEERIGNVGTGLSEEAVIRLLKQRKFSSWTLKASLDPEPCCICQEEYADGDDLGRLDCGHDFHAGCIKQWLVVKNVCPICKSTALKKT

SEQ ID NO: 6409 - protein, 176 aa, Zea mays
  Clone ID: PAT_MRT4577_89080C.1.pep
MGGCCCCSSRTSEADRAPIDIYRQQNLEEHEPLSSAFDGSSPPSSIVAVDTNLDTSTPDTYRAPPAPLPYDVVLAVPTTPGLEKLDNKSKTDDQQESINDQESLKVDESCKKNVTEDKAEEEDVCPICLEEYDEENPRSVTKCEHHFHLCCILEWMERKDTCPVCDQTILVDEMSE

SEQ ID NO: 6410 - protein, 199 aa, Zea mays
  Clone ID: PAT_MRT4577_89293C.1.pep
MAATAMDHDGGDDVVTPGELLGNSLTLAAGRGAYADGRSVRASVTGRRRIVPPAPASDDQRSTVEVVGHKAHGAVPQPGSVVIARVTKVMARMASADIMCVDSKAIREKFTGMIRQQDVRATEIDKVDMYQSYRPGDIVKAMVLSLGDARAYYLSTAKNELGVVSAQSIAGGTLVPISWTEMQCDLTGQIEQRKVAKVE

SEQ ID NO: 6411 - protein, 129 aa, Zea mays
  Clone ID: PAT_MRT4577_89333C.1.pep
GRVGSPSLVAEEQLHGSKDTLTLKGEKALLELLLGMALDQHVDGRKLITQQEAEDSDFESYLREATSRVLYQPTFIEEDDDDDSVSESSSASLAKPAGTLDLGKLTEEPQPHRSVDPNHSYDQVFIRST

SEQ ID NO: 6412 - protein, 42 aa, Zea mays
  Clone ID: PAT_MRT4577_89355C.1.pep
KKKKKKKKKKKKKKKKKKKKKKIKKIKKKKKKKYKKKRGGPF

SEQ ID NO: 6413 - protein, 83 aa, Zea mays
  Clone ID: PAT_MRT4577_89477C.1.pep
YAEAGARTRDLPIIDGRLYRCTRPALPLQHSTNESAFFIISLNCTFPRFPPCIRRFPLDEERGRGPAARGGEAKRPHASADAG

SEQ ID NO: 6414 - protein, 61 aa, Zea mays
  Clone ID: PAT_MRT4577_89488C.1.pep
SAAGGSVGALEGAGYGGGGPPYGGGGYGGGGGSGGGGGYGGGGGGFGGGNRGGGFGNSPGN

SEQ ID NO: 6415 - protein, 150 aa, Zea mays
  Clone ID: PAT_MRT4577_89553C.1.pep
IRHEGEENRGLSFMYDGVPLLAMLDEYVMLRQEREEEKKRMREQKRYIEQQLNTDHEGPFGSRVSPNRPASSKKAVGVKVNGSVSNGTPPNRRLSISGQQNGGGHGVRSGGKDSKKDTAKTASPGNNAVAAAPVDAVSQISVTDPVPSTP

SEQ ID NO: 6416 - protein, 90 aa, Zea mays
  UNSURE (1)..(90): unsure at all Xaa locations
  Clone ID: PAT_MRT4577_89796C.1.pep
  unsure (1)..(90): unsure at all Xaa locations
FAWGPNEYSTGMGYFSTATGLATFTMMLLGRVILRKFGWGVADTITPVVLLLTGVGFSSLTLFGEPXTPLMTXLGRHPLLAAVXYVGSNA

SEQ ID NO: 6417 - protein, 197 aa, Zea mays
  UNSURE (1)..(197): unsure at all Xaa locations
  Clone ID: PAT_MRT4577_89874C.1.pep
  unsure (1)..(197): unsure at all Xaa locations
VGIVILLFINSTISFIEENNAGNAAAALMASLAPQTKVLRDGKWSEQEAAILVPGDIISIKLGDIIPADARLLEGDPLKIDQSALTGESLPVNKMPGDSIYSGSTCKQGEIEAVVIATGVHTFFGKAAHLVDSTNNVGHFQKVLTAIGNFCICSIAVGMLVEIIVMYPIQHRQYREGIDNLLVLLIGGIPIXMPTVL

SEQ ID NO: 6418 - protein, 94 aa, Zea mays
  Clone ID: PAT_MRT4577_8991C.1.pep
GGTANSYGNWRNLTVGPARPSYPVCPRDVFPSPKGLSSFVPFGVAPLCFLLQGPSVSVVNAGFIPGSSRPMHQPARVSGRWMLLPPSGFFFSFF

SEQ ID NO: 6419 - protein, 141 aa, Zea mays
  Clone ID: PAT_MRT4577_89934C.1.pep
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGYGGRREGGGGGYGGGGGYGGRREGGGGGYGGGGGGGWRD

SEQ ID NO: 6420 - protein, 137 aa, Zea mays
  Clone ID: PAT_MRT4577_8997C.1.pep
MAGKGGKGLLAAKTTAAKTAEKDKGKKAPISRSSRAGLQFPVGRIHRQLKQRTQANGRVGATAAVYSAAILEYLTAEVLELAGNASKDLKVKRITPRHLQLAIRGDEELDTLIKGTIAGGGVIPHIHKSLINKSSKE

SEQ ID NO: 6421 - protein, 118 aa, Zea mays
  Clone ID: PAT_MRT4577_90005C.1.pep
FPFNPLSAINSGSYLQQQQLPFRQLFVAYPQQFFPFNQMTALNFPAFLQQPQQLPFNQLVGVSPATFFTQPQLFPFYQHGAPNAGTLFQLQQLGPFNQLALTNPTAFYQQPIIGGALF

SEQ ID NO: 6422 - protein, 97 aa, Zea mays
  UNSURE (1)..(97): unsure at all Xaa locations
  Clone ID: PAT_MRT4577_90066C.1.pep
  unsure (1)..(97): unsure at all Xaa locations
MGGAHESLYLGGTMRGHNREVTGIATPIDSLPCIVLCSRDKSLLEWDLTNPVHSTPEXGATGHYRVPLRRLTGHCHLVQDVFLSSDRQIALSGSWDG

SEQ ID NO: 6423 - protein, 50 aa, Zea mays
  Clone ID: PAT_MRT4577_90173C.1.pep
NVWAHPGFARVILSIYRIVLPFVFSPPDSARSPFGLGVGTPVVPFVCSPL

SEQ ID NO: 6424 - protein, 34 aa, Zea mays
  Clone ID: PAT_MRT4577_90388C.1.pep
TVATFTNCATDINLHSWQLCIYSMQILKSCTRST

SEQ ID NO: 6425 - protein, 55 aa, Zea mays
  Clone ID: PAT_MRT4577_90405C.1.pep
NRGPSRTCPPHQLKHHAFIRVHLALYLVHSRLAALAALVRAGVPVRQAQLYAHRA

SEQ ID NO: 6426 - protein, 506 aa, Zea mays
  Clone ID: PAT_MRT4577_90458C.1.pep
MLPSFVSPTASAAASVTPPPRPIPGSYGPPVLGPLRDRLDYFWFQSQDEFFRKRAAAHRSTVFRTNIPPTFPFFVGVDPRVVAIVDAAAFTALFDPDLVDKRDILIGPYNPGAGFTGGTRVGVYLDTQEEEHARVKTFAMDLLHRSARTWSADFRASVGAMLDAVDAEFGKDDGSDKKPSASYLVPLQQCIFRFLCKAFVGADPSADWLVDNFGFTILDIWLALQILPTQKIGLVQPLEELLIHSFPLPSFLIWPGYYVLYRFIEKHGAEAVAYAEAQHGIGKKDAINNILFVLGFNAFGGFSVFLPFLVAKVGGAPALRERLRDEVRRAMVGKDGDGDGEFGFATVREGMPLVRSTVYEMLRMQPPVPLQFGRARRDFVLRSHGGAAYQVTAGEVLCGYQPLAMRDPEVFERPEEFVPERFLGDEGARLLQHLFWSNGPETAQPGPGNKQCAAKEVVVDTACMLLAELFRRYDDFEVEGTSFTKLVKRQASPSVAQAAAAAGAQQ

SEQ ID NO: 6427 - protein, 37 aa, Zea mays
  Clone ID: PAT_MRT4577_90583C.1.pep
GWLLLPLLSSPPRVRAPYGFVDGRCRRLMCSTVGSSA

SEQ ID NO: 6428 - protein, 163 aa, Zea mays
  Clone ID: PAT_MRT4577_90667C.1.pep
LIEVKHTRPIAITGRRERRTVCCVGLSCHRRLFLSSLATTAAFLACQASPIVVGAAPAEAASYAAKSLMPMPMPMPSCMPLAACKLQTLHANQFALLSGITQTGRVDEPPAAGCRRQDGSIRMNTTAATLLFPGKRIAAAVLLLWSFPVLIGWRHSFHTSMGC

SEQ ID NO: 6429 - protein, 62 aa, Zea mays
  UNSURE (1)..(62): unsure at all Xaa locations
  Clone ID: PAT_MRT4577_90691C.1.pep
  unsure (1)..(62): unsure at all Xaa locations
FPPRRRRRRPPSCAPTTSRIQIEVLLLPRXXLNSKSANPLSHRSQXGSXYAXRDGVEXSRIC

SEQ ID NO: 6430 - protein, 228 aa, Zea mays
  Clone ID: PAT_MRT4577_90705C.1.pep
SEFISYPISLWTEKTTEKEISDDEDEDEKKDTEEGKVEEIDEEKEEKEKKKKKIKEVSHEWNLINKQKPIWMRKPEEITKEEYAAFYKSLTNDWEEHLAVKHFSVEGQLEFKAVLFVPKRAPFDLFDTRKKLNNIKLYVRRAFIMDNCEELIPEWLSFVKGIVDSEDLPLNISRETLQQNKILKVIRKNLVKKCIELFFEIAENKEDYNKFYEAFSKNLKLGVHEDST

SEQ ID NO: 6431 - protein, 160 aa, Zea mays
  Clone ID: PAT_MRT4577_90817C.1.pep
MDARMFGLENPLVAALHHLLDVPDGDAGAGGDKAGGGATRTYVRDARAMAATPADVKELAGAYAFVVDMPGLSTGDIRVQVEDERVLMISGERRREEREDAKYLRMERRMGKFMRKFVLPDNADVDKVAAVCRDGVLTATVEKLPPPEPKKPKTIEIKVA

SEQ ID NO: 6432 - protein, 154 aa, Zea mays
  Clone ID: PAT_MRT4577_90818C.1.pep
MDARMFGLETPRVAALHHLLDVPDGDKAGGGATRTYVRDARAMAATPADVKELAGAYAFVVDMPGLSTGDIRVQVEDERVLVISGERRREEREDAKYLRMERRMGKFMRKFVLPDNADVDKVAAVCRDGVLTVTVEKLPPPEPKKPKTIEIKVA

SEQ ID NO: 6433 - protein, 123 aa, Zea mays
  UNSURE (1)..(123): unsure at all Xaa locations
  Clone ID: PAT_MRT4577_90897C.1.pep
  unsure (1)..(123): unsure at all Xaa locations
GFRFFRKAVGKKGPGARAPPQVQEEVCGAGARRLRGFRLPRAPRKKEGPQGARGARRPKKAPLFRLIDPPVLSSLPXATRACXRXIERPPCCARVRMYALVSCPNKGGPVILSYVNVCVCMGL

SEQ ID NO: 6434 - protein, 170 aa, Zea mays
  UNSURE (1)..(170): unsure at all Xaa locations
  Clone ID: PAT_MRT4577_90917C.1.pep
  unsure (1)..(170): unsure at all Xaa locations
MAAKXFCFLMLLGLSASVATATIFPQCSQAPIASLLPPYLSPAVSSMCETPIVQPYRIQQAIAXASLPLSPLFLQQPAHLLQQLPXVHFVAHNITAQQLQQLVLAXNLALYFQKHPVLPFNQLSALNYTAYLQQQLPSIQLGAAYPPHFLAFNXQLACLNSAAYVQHSQL

SEQ ID NO: 6435 - protein, 64 aa, Zea mays
  UNSURE (1)..(64): unsure at all Xaa locations
  Clone ID: PAT_MRT4577_9092C.1.pep
  unsure (1)..(64): unsure at all Xaa locations
MASYTMALSFMAFSGTAVNVLSSSAFGDARVTMRKTAVXAKPAAVIVSPLYGSDRVLYLWPLSV

SEQ ID NO: 6436 - protein, 87 aa, Zea mays
  UNSURE (1)..(87): unsure at all Xaa locations
  Clone ID: PAT_MRT4577_90935C.1.pep
  unsure (1)..(87): unsure at all Xaa locations
GSPGFRFVGERIDMGASDVEYRCFVGRLDWATDDHSLHKGLRTYREVLKFKIMLERETHRSHXLSFVTFSTEEEMPNALQGMNGKEL

SEQ ID NO: 6437 - protein, 110 aa, Zea mays
  UNSURE (1)..(110): unsure at all Xaa locations
  Clone ID: PAT_MRT4577_91008C.1.pep
  unsure (1)..(110): unsure at all Xaa locations
QLLEVDPEKELECGICLQVSPKVVLPDCGHKLCIRCFXDWNPKLKSCPFFWACLEKVKPGSLWIYTHGNHVVDMDTFSRENIRRLFMYINKMPLVVLQVVDLDVFKYRLK

SEQ ID NO: 6438 - protein, 77 aa, Zea mays
  Clone ID: PAT_MRT4577_91098C.1.pep
MGGPGMARAGTPAFRWPLSNVQTWCSPALTDEDTCLEGLLSRAVDAGTRPPIRGKVVEVAQVTSNALALVNKVGPGY

SEQ ID NO: 6439 - protein, 216 aa, Zea mays
  Clone ID: PAT_MRT4577_91099C.1.pep
MARPRSVAAAAAAPLLLLAAAAAAAAGLVSAASPAASDFVRKSCRTTQYPSVCEQSLASYGGSPPPRSPRELARAALSVSADRARAASAYVGRLCGASNGKGAKKGSGSGSGSASAGPVRDCLDNLADSVGHLRDAAQEMGGAGMGRAGTPAFRWHLSNVQTWCSAALTDEDTCLDGLSSRAVDAGTRAAIRGKVVEVAQVTSNALALVNKVGPGY

SEQ ID NO: 6440 - protein, 219 aa, Zea mays
  Clone ID: PAT_MRT4577_91100C.1.pep
MARPRSVAAAAAAPLLLLLLLAAAAAAAAGLVSAASPAASDFVRKSCRTTQYPSVCEQSLASYGGSPPPRSPRELARAALSVSADRARAASAYVGRLCGASNGKGAKKGSGSASASASAGPVRDCLDNLADSVGHLRDAAQEMGGAGMGRAGTPAFRWHLSNVQTWCSAALTDEDTCLDGLSSRAVDAGTRAAIRGKVVEVAQVTSNALALVNKVGPGY

SEQ ID NO: 6441 - protein, 48 aa, Zea mays
  Clone ID: PAT_MRT4577_91134C.1.pep
TISALKEVVSSGERDKICTDIISNGSERASEGIDYAVMATVIRLTIES

SEQ ID NO: 6442 - protein, 974 aa, Zea mays
  Clone ID: PAT_MRT4577_91136C.1.pep
MVSGHIFHCRKNSWPAEEYVGRTALQLLDFDGGAPPEQAWRRRLNSHANILKEFSVTFMEAMRMMSLGLRLWSYVREEASHGRKAPIDPFTKERCKPSASQGVPLGGMGSGSISRGFRGEFKNWHIIPGLCESSPVMENQFSIFVSRDGGNKKYSSVLAPGHHEGLKKNSDSGISSWDWNLSGQHSTYHALFPRAWTVYDGEPDPDLKISCRQISPFIPHDYKDSSLPTSVFVYTLVNTGRDRAKVSLLMTWANSIGGFSHNSGGHYNEPFIAEDGVSGVLLHHKTAKDNPPVTFAVAACETQNVNVTVLPVFGLSGENHVSAKEMWNTMLQNGHFDRENFSAGPSMPSSPGQKLCAAVSASTWVEPHGRCTVVFALAWSSPKVKFQKGCTYNRRYTQFYGTSEKSAVNLVHDALTKYKLWEEEIEKWQNPILKDERLPEWYKFTLFNELYFLVAGGTVWTDGQPPAIDEKKSPGFNHQKSSKRGTKDTNQGSVKDRHVNLAVEQVPHGGYMANGDDHSVSKFAAVHGSELQEQTNGLKSEEPIPYLISKDGPEHVGKFLYLEGVEYIMWNTYDVHFYASFALLDLFPKIELSIQRDFANAVLYEDRRKVKFLADGTSGIRKAKGAVPHDLGTHDPWHEMNAYNIHDTSKWKDLNPKFVLQIYRDFAATGDMQFGRDVWPAVCAAMDYMDQFDRDGDGLIENDGFPDQTYDAWTVHGISAYCGCLWLAALQAAATMAHRLGDRHFAEKYKLKFIKAKAVYEAKLWNGSYFNYDSGTSSNSRSIQADQLAGQWYAASSGLPPLFDEHKIRTALQKIFEFNVMKVKGGRMGAVNGMTPKGKVDETCMQSREIWTGVTYAVAANMLLHGMEHQGFTTAEGIFTAGWSEEGYGYWFQTPEGWTTDGHYRSLVYMRPLAIWAIQYAVSPPKAILEAPKVNLMDRIHISPHMVRAISEISIRKVAPDNRCLPSSAFHCEC

SEQ ID NO: 6443 - protein, 378 aa, Zea mays
  Clone ID: PAT_MRT4577_91254C.1.pep
MLHLLSSMMSCILLLLTWESMHISLFNHSALLTPFVSVQAGRIWRMTEAAVTRYWCHGCVRVVEEAMGEEIKCPFCGGGFIEEMIGEEFDGLASQQSERDSSQWGASNNPFEQPRAEADSEDEEDDDDYDDDIGRAFESFIRRHGRPSALRRAFDSIQDDLRADRDSDFSILINAFNQALALQRSVLDADEARDDQGGSSNDDGLMEEYVLGAGLTLLLQYLTENDPSQYGTPPANKEAVDALPTVQIAEAVSCSVCLDDLELGSQAKQMPCEHKFHSPCILPWLELHSSCPVCRFELPSEETEDLDEPSNVDRTENTHEEVRADGPEDDSESSNRAWALVPWFSGLFSTPEPQTVRGAFTDQQTRSTSGTNMNAGES

SEQ ID NO: 6444 - protein, 73 aa, Zea mays
  Clone ID: PAT_MRT4577_91282C.1.pep
TPAGKNEARTGLQEHPFFDVAPRPPPFFPQSHTFTHQKQAATKGRRGTHYWEPSNYTPLQYKIKQGCGCVPPN

SEQ ID NO: 6445 - protein, 160 aa, Zea mays
  UNSURE (1)..(160): unsure at all Xaa locations
  Clone ID: PAT_MRT4577_91378C.1.pep
  unsure (1)..(160): unsure at all Xaa locations
ITAGILPLSPWFXQQSSALLHQLPLVXFIAQXIRXQQLQQLVLANXLAAYILKQQQSFFPFNQXXAALNSASYLQQQQPPFXSQLFLAYPQQFXPFNQLTALNSPAYLQQKQLLPFSQLAGVXSPATHLXTKPQLVPIYQXHAAHNAGTXLQLKQLLPDQ

SEQ ID NO: 6446 - protein, 82 aa, Zea mays
  Clone ID: PAT_MRT4577_91459C.1.pep
QHTKHNSVPTMLAKIFCLLMLDGLSASAATYYHLTVMLISSYSFSFYPIPLTNFVFSMLKPNSLTLHDPTCNLIIAFLPLSS

SEQ ID NO: 6447 - protein, 447 aa, Zea mays
  Clone ID: PAT_MRT4577_91500C.1.pep
MDEEYDVIVLGTGLKECIISGLLSVDGLKVLHMDRNDYYGGESSSLNLTKLWNRFKGNDSPPEHLGVSKEYNVDMVPKFMMANGALVRVLIRTSVTKYLNFKAVDGSFVYNNGKIHKVPATDVEALKSNLMGLFEKRRARKFFIYVQDYEEDDPKSHEGLDLNKVTTREVISKYGLEDDTVDFIGHALALHRDDSYLDEPAIDTVKRMKLYAESLARFQGGSPYIYPLYGLGELPQAFARLSAVYGGTYMLNKPECKVEFDESGKAYGVTSEGETAKCKKIVCDPSYLPDKVKKVGRVARAICIMKHPIPDTKDSHSVQIILPKKQLKRKSDMYVFCCSYAHNVAPKGKFIAFVSTEAETDKPEIELKPGIDLLGPVEETFFDIYDRYEPVNNPDDDCCFLTNSYDSTTHFETTVKDVLALYNKITGKELDLSVDLNAASATEQEAA

SEQ ID NO: 6448 - protein, 502 aa, Zea mays
  Clone ID: PAT_MRT4577_91548C.1.pep
MRKLLFISFVLSLSAAAVHGEDGAYIGVNIGTAMSSVPAPTQITTLLRSQNIRHVRLYDADPAMLAALSNTGIRVIVSVPNEQLLAIGNSNATAANWVARNVAAHFPAVNITAIAVGSEVLSAQPNAAPLLMPAMRYLQNALVAAALDRYIKVSTPHSSSIILDSFPPSQAFFNRSLDGVLVPMLRFLQSTGSPLMLNVYPYYDYMRSNGVIPLDYALFRPLPPNKEAVDANTLLHYTNVFDAVVDAAYFAMAYLNVTNVPVMVTETGWPHKGDSSSEPDATSDNADTYNSNLIRHVMNSTGTPKHPGVAVPTYVYELYDEDTRPGSTSEKYWGLFDMNGVPAYTLHLTGSGVLLANDTTNQTYCVAREGADPKMLQAALDWACGPGKVDCSVLMQGQPCYDPDTVDAHATYAFNAYYHGMGMGSGTCYFSGVAVVTTTDPSHGSCVYAGKNGTSLMNGTSLAPSSNSTEGGSGAHRAFGDVSSLVRIVSTALLFSVVLLLL

SEQ ID NO: 6449 - protein, 172 aa, Zea mays
  UNSURE (1)..(172): unsure at all Xaa locations
  Clone ID: PAT_MRT4577_91549C.1.pep
  unsure (1)..(172): unsure at all Xaa locations
MRKLLFISFVLSLSAAAVHGEDGAYIGVNIGTAMSSVPAPTQITTLLRSQNIRHVRLYDADPAMLAALSNTGIRVIVSVPNEQLLAIGNSNATAANWVARNVAAHFPAVNITAIAVGSEVLSAQPSAAPLLMPAMRYLQNALVAAALDRYIKXVSTPHSASIILDSFPPSQP

SEQ ID NO: 6450 - protein, 218 aa, Zea mays
  Clone ID: PAT_MRT4577_91553C.1.pep
MRKLFFVYFVLLLAAAVVHGEDGAYIGVNIGTAMSSVPAPTQITTLLRSQNIRHVRLYDADPAMLAALSNTGIRVIVSVPNEQLLAIGNSNATAANWVARNVAAHFPAVNITAIAVGSEVLSAQPNAAPLLMPAMRYLQNALVAAALDRYIKISTPHSSSIILDSFPPSQAFFNRSLDSVLVPMLKFLQSTGSPLMLTVYPYYDYMRSNGVIPLDYAL

SEQ ID NO: 6451 - protein, 221 aa, Zea mays
  Clone ID: PAT_MRT4577_91585C.1.pep
MGPYSTAVAVSASPVLQASSLLTRARGSWRPTVAALRLSASVKCRRRALTVTCALPEKERPAAFNIPPTALLCPVPPPDGKERWDIKEEDDRVTLWLQVPGLSASDIEVTTSEDVLEIKRRVVAPQQPAPVDAHGVGAFHIRLLLTKEYDGSNVTADLKAGMLEVTVHKNPQRPGERAVMMGATKPPPEPRQNEESSTNQRSSTARKETGTPMGRQNPNGV

SEQ ID NO: 6452 - protein, 92 aa, Zea mays
  UNSURE (1)..(92): unsure at all Xaa locations
  Clone ID: PAT_MRT4577_91680C.1.pep
  unsure (1)..(92): unsure at all Xaa locations
QYLSPEVYTLCENPLLQPYKIQQAMTAGIVPLSPLILQQSSDLLHQIPLVHXLLTQNIVAHQLQQLVLANLGVYSEQQQLLSFNQLAALNSA

SEQ ID NO: 6453 - protein, 472 aa, Zea mays
  Clone ID: PAT_MRT4577_91692C.1.pep
MGRSGGGDGDGDGDRLLLGKPLESSSSCSSSDESLVKRTGTVWTAMAHIITAVIGSGVLSLAWSVAQLGWVGGPAAMVFFAGVTAVQSTLIADCYICHHPERGVVRNRSYVDAVRIYLGDKSHLFCGFFLNLSLFGTGVVYTLTSATSMRAIRKANCYHREGHDAPCSVGGDGYYMLLFGLAQVLLSQIPNFHEMAGLSIFAAVMSCFYAFVGVGLGVAKVIANGVIMGGIGGIPLVSTTQKVWRVSQALGDILFAYPFSLVLLEIEDTLRSPPPESETMKKATRASIAITTLFYLCCGCFGYASFGDGTPGNLLTGFGFYEPYWLIDLANLAIVLHLLGGYQVYTQPVFAFADRKFGGGATVVEAPLLPVPGARRVNANVFRLCFRTAYVAATTALAVWFPYFNQIIGLLGSFTFWPLAVYFPVEMYLTRNKVAPWTNQWLAIHAFSLVCLLISAFASVGSAVGVFGSETS

SEQ ID NO: 6454 - protein, 116 aa, Zea mays
  UNSURE (1)..(116): unsure at all Xaa locations
  Clone ID: PAT_MRT4577_91694C.1.pep
  unsure (1)..(116): unsure at all Xaa locations
LCLSKDTLRGGPPVSETMKKXXRASIAITTLFYLCCGCFGYASFGDGTPGNLLTGFGFYEPYWLIDLANLAIVLHLLGGYQVYTQPVFAFADRKFGGGATIVEAPLLPVPGARRVN

SEQ ID NO: 6455 - protein, 762 aa, Zea mays
  Clone ID: PAT_MRT4577_91710C.1.pep
MAILSALATEVLIPVAAVIGIAFAVVQWVVVSRVKLSPAASGGSGGKAGYADSLIEEEEGLNDHNVVVKCAEIQNAISEGATSFLFTEYQYVGIFMAIFAVVIFLFLGSVEGFSTKSQPCTYSKDKYCKPALFTALFSTVSFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGIDHDFTGMCYPLLVSSVGIIVCLITTLFATDFFEVKAVKEIEPALKKQLIISTVLMTFGIALISWLALPAKFTIYNFGTQKEVSNWGLFFCVSIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLRDTSGPSLNILIKLMAVESLVFAPFFATQGGLLFKYL

SEQ ID NO: 6456 - protein, 762 aa, Zea mays
  Clone ID: PAT_MRT4577_91711C.1.pep
MAILSALATEVFIPVAAVIGIAFAVVQWVLVSRVKLSPAAAASGGSKNGYGDYLIEEEEGLNDHNVVVKCAEIQTAISEGATSFLFTEYQYVGIFMSIFAVVIFLFLGSVEGFSTKSQPCTYSKDKYCKPALFTALFSTVSFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSVGIIVCLITTLFATDFFEVKAVKEIEPALKKQLIISTVLMTVGIAVISWLALPAKFTIFNFGTQKDVSNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATHGGLLFKYL

SEQ ID NO: 6457 - protein, 87 aa, Zea mays
  UNSURE (1)..(87): unsure at all Xaa locations
  Clone ID: PAT_MRT4577_91728C.1.pep
  unsure (1)..(87): unsure at all Xaa locations
KRAKPPPGRTXGGASQPTTHQRSPKGTPPKNXRTTKGRPVSLKGSTNSTPRAAQMXPMRMPSKVWSHRRSAILCGDQYLCYGIYRPR

SEQ ID NO: 6458 - protein, 366 aa, Zea mays
  Clone ID: PAT_MRT4577_91807C.1.pep
MGKEKNGDSLPPFPFTIVETLAPPRRRHAGSVGAMSKARVYADVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYRIELDPQLEALVGRHSRKPWLKFMNADNQHLVSPEAIDFLDKLLRYDHQERLTALEAMTHPYFQQVRAAENSRTRA

SEQ ID NO: 6459 - protein, 127 aa, Zea mays
  Clone ID: PAT_MRT4577_91808C.1.pep
MAEGRGSARAIGAMAFAVACCYCCVAIADAATTYYVGDSNGWSFSSPSWPNGKHFRAGDTLVFRYIPWIHNVVAVDEDGYNGCTTPPGSRTYTSGADSVTLARGDNFFICTRFGHCNLGMKLVVYAA

SEQ ID NO: 6460 - protein, 332 aa, Zea mays
  Clone ID: PAT_MRT4577_91809C.1.pep
MSKARVYADVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNVYLNKYRIELDPQLEALVGRHSRKPWLKFMNADNQHLVSPEAIDFLDKLLRYDHQERLTALEAMTHPYFQQVRAAENSRTRA

SEQ ID NO: 6461 - protein, 99 aa, Zea mays
  UNSURE (1)..(99): unsure at all Xaa locations
  Clone ID: PAT_MRT4577_91841C.1.pep
  unsure (1)..(99): unsure at all Xaa locations
WVGFSSPSGSFSGSRGSPDFGFGGQRIEISASDAEYRYFISGLYXATDYHFLHNAFITYSDVLXSKIILDRYTHRSRGFCFITFYTDDAMRNAIKGMNC

SEQ ID NO: 6462 - protein, 335 aa, Zea mays
  Clone ID: PAT_MRT4577_91890C.1.pep
MRKAGVTSASSGGGEGWPCGGGLNLGVKLNVLLLLSVVATNRAVPCHHSSPSCVLHSVPIGSLEAGRGNTNCHFAPSRTTARVIVAFPSLHTPNANSRAVTSRSPAMAARRLGSPASRWLRPSALLLLVASALLSAPSPARALRFDLESGHTKCISDEIKVNAMAVGKYHIVSPDPNFPDAQLPESHRISLRVTSPYGNSMHYAENVQSGHFAFTAAEAGDYLACFWAPDHKPPVTIGFEFDWRSGVSAKDYPSVAKKGKVDMMELELKKLEETIKNIHEEMFYLREREEEMQDLNRRTNSRMAWLGFLSLGVCLSVAGLQLWHLKTFFERKKLL

SEQ ID NO: 6463 - protein, 229 aa, Zea mays
  Clone ID: PAT_MRT4577_91891C.1.pep
MVARRLGSPACRWLRPSALLLLVASALLSAPSPARALRFDLESGHTKCISDEIKVNAMAVGKYHIVSPDPNFPDAQLPESHRISLRVTSPYGNSMHYAENVQSGHFAFTAAEAGDYLACFWAPDHKPPVTIGFEFDWRSGVSAKDYPSVAKKGKVDMMELELKKLEETIKNIHEEMFYLREREEEMQDLNRRTNSRMAWLGFLSLGVCLSVAGLQLWHLKTFFERKKLL

SEQ ID NO: 6464 - protein, 229 aa, Zea mays
  Clone ID: PAT_MRT4577_91892C.1.pep
MAARRLGSPASRWLRPSALLLLVASALLSAPSPARALRFDLESGHTKCVSDEIKVNAMAVGKYHIVGPDPNSPDAQLPESHRISLRVTSPYGNSMHYAENVQSGHFAFTAAEAGDYLACFWAPDHKPPVTIGFEFDWRSGVSAKDYPSVAKKGKVDMMELELKKLEETIKNIHEEMLYLREREEEMQDVNRRTNSRMAWLGFLSLGVCLSVAGLQLWHLKTFFERKKLL

SEQ ID NO: 6465 - protein, 117 aa, Zea mays
  Clone ID: PAT_MRT4577_91971C.1.pep
PRVRGRVGSAESTMVAYKAAQDIALAELAPTHPIRLGLALNFSVFYYEILNSPDKACNLAKQAFDEAISELDTLGEESYKDSTLIMQLLRDNLTLWTSDITEEGIEEGKEASKGDAE

SEQ ID NO: 6466 - protein, 63 aa, Zea mays
  Clone ID: PAT_MRT4577_92095C.1.pep
SDKQSEQAKTVSGNAHRLTPADYPIFLKQKRTGASLPLSLRDNHKETWYATGYMIMHMHAKDN

SEQ ID NO: 6467 - protein, 92 aa, Zea mays
  Clone ID: PAT_MRT4577_9211C.1.pep
PPVALGNYPSTVLVTMVPPIPPRHGRIGWIPENPNPGPPDYFFWLLPVVSPPNFLAYLVIPSWYKYKKTPHYSPGPQGEPGPNPLWAKNGGN

SEQ ID NO: 6468 - protein, 548 aa, Zea mays
  UNSURE (1)..(548): unsure at all Xaa locations
  Clone ID: PAT_MRT4577_92205C.1.pep
  unsure (1)..(548): unsure at all Xaa locations
MVGGGEGDRVGGGVGVGGGQQFVDRSKVRILLCDGDASSSREVLRLLCNCSYHVTCAKSPRQVINILNYEGGEIDIILAEVDLPVSKCFKMLKYIARNKDLRHIPIISRQPSYSEPCAVVPITVMXSVTVLPVLWNCAVMSNRDEVSVVVKCLRLGAAEYLVKPLRTNELLNLWTHVWRRRRMLGLPEKNFFNDNFELVLSEPSDANTNSATLLSDETDDRPKENTNQETGTSNQLEYESNPSVAERDQRDKIGAPGSALDASQSSTPGRMFSRPIKTNLKVAESSAFLAYVKSSTPATSSFDSGLQRGDSRLDSLDNHGNCSSATDRSDTGTDVNIRNKEAFEMPVQYPMVCFSSSSMHMERSNEGHNDTSGTPPAYHFPFYYPGMVEHNMALSSVQNFQANINSAQAHTPPAMLHQYNVFSQCHSLPMISSFQFNTSGMSMHSSHLPTQNVWSSASSTPTPDETCNRSERRAAALAKFRQKRKERCFDKKVRYVNRKKLAETRPRVRGQFVRHASNMDIISTGDDISEDEDDDPTSREVDMISSPE

SEQ ID NO: 6469 - protein, 425 aa, Zea mays
  UNSURE (1)..(425): unsure at all Xaa locations
  Clone ID: PAT_MRT4577_92370C.1.pep
  unsure (1)..(425): unsure at all Xaa locations
AGLEAGRRHLIFLFTPTHSPAAAIPSLPSPGTASSNPLXSSAAAAAMDSTPAHEAAPGASSSATAAAEDLAGGVAAMTLDERFALLRGIGEECIQEDELRRLLENKPVPICYDGFEPSGRMHIAQGIVKTINVNKMVRAGCKVKIWIADWFAQLNNKMGGDLKKIQTVGRYMIEIWKAAGMNLDGVEFLWSSEEINRRAHEYWPIVMDIARKNNVKRIMRCCQIMGRSDQDDLTAAQIFYPCMQCADIFFLKADICQLGMDQRKVNVLAREYCDDIKRKNKPIILSHHMLPGFKEGQEKMSKSDPSSAIFMEDDEAQVNVKIKQAFCPPKIVEGNPCLEYIKYIVFPWFGRFEVARKESNGGNKTFTSMDELISDYETGALHPADVKPALAKAINEILQPVRDHFNNNNEAKVLLNTVKKYRVTS

SEQ ID NO: 6470 - protein, 44 aa, Zea mays
  Clone ID: PAT_MRT4577_92522C.1.pep
STCGCGSSCKCGKKYPDLVETSTAAQPTSFLGVVPVNNADPLLL

SEQ ID NO: 6471 - protein, 156 aa, Zea mays
  Clone ID: PAT_MRT4577_9275C.1.pep
MDASAAGAGGKAKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLSGVTIAHGGVLPNINPVLLPKKTAEKAAAKEAKSPKKAAKSPKKA

SEQ ID NO: 6472 - protein, 231 aa, Zea mays
  Clone ID: PAT_MRT4577_92814C.1.pep
MASRQQHPTSYHAGETKARAEEKTGQVMGATQEKGREAKHKASDASDRAMGMGHDAMEATREKARAAADRTMGMGHDAGEAAKDRAYRAKDAASGAAGRARDTASDAAGAAGDRARDGAQQTGSYVAQTAEAARQKAAGAALYAKDTVVAGKDKTGALLQQAGEKVMSTAVGAKDTVVSTAVGAKDTVVSTAVGAKDAMMNSLGMAGEDKDGTTTTDAGKDTSTRKPGRDY

SEQ ID NO: 6473 - protein, 905 aa, Zea mays
  Clone ID: PAT_MRT4577_92835C.1.pep
MMNLNLKQPLVLPAHHSNVVGSRLSSSSPSAAAASRRTGGGVSSRSGSRRHVRLPRISCSATEEVSGAVSSVTVERMLTVTASVEASPAIGQMYFQRAVDDIGDLLGKTLLLELVSSELDAKSGVEKTRVTAYAHKTLREGHYEAEFKVPASFGPVGAVLVENEHHKEVFIKEIKLVTGGDSSTAVTFDCNSWVHSKFDNPEKRIFFTLKSYLPSDTPKGLEDLRKKDLQALRGDGHGERKVFERVYDYDVYNDLGDPDKNPAHQRPVLGGNKQYPYPRRCRTGRPRTKKDPETEMREGHNYVPRDEQFSEVKQLTFGATTLRSGLHALLPALRPLLINKKDLRFPHFPAIDELYSDGIPLPPQTGFDAIRTVVPRMVKLVEDTTDHVLRFEVPEMIERDRFSWFKDEEFARQTIAGLNPLCIQLLTEFPIKSKLDPEVYGPAESAITKEILEKQMNGALTVEQALAAKRLFILDYHDVFLPYVHKVRELQDATLYASRTIFFLTDLGTLMPLAIELTRPKSPTRPQWKRAFTHGPDATDAWLWKLAKAHVLTHDTGYHQLVSHWLRTHCCVEPYIIAANRQLSRLHPVYRLLHPHFRYTMEINALAREALINADGIIEESFWPGKYAVELSSVAYGATWQFDTEALPNDLIKRGLAVRGEDGELELTIKDYPYAHDGLLVWDSIKQWASEYVNVYYKSDEAVAADPELRAFWDEVRNVGHGDKKDEPWWPVLDTRDSLVETLTTIMWVTSGHHSAVNFGQYHFAGYFPNRPTTIRKNMPVEEGGPGEEMEKFLKQPETTLLDMLPTQMQAIKVMTTLDILSSHSPDEEYMGEFAEPSWLAEPMVKAAFEKFGGRMKEIEGFIDECNNNLDLKNRCGAGIVPYELLKPFSKPGVTGRGIPSSISI

SEQ ID NO: 6474 - protein, 317 aa, Zea mays
  UNSURE (1)..(317): unsure at all Xaa locations
  Clone ID: PAT_MRT4577_92931C.1.pep
  unsure (1)..(317): unsure at all Xaa locations
MWDQKVEAYIIHVQVEVAMFCPMICQEIVKNGTGSSKNHAIALPERVNPASLSLILDYCRFHQVTGRSNKERKSFDEKFVRIETERLCELTSAADSLQLKPLVDLTSRALARIIEGKTPEEIRDIFHLPDDLTEEEKLEPLKNVNDDPRIRLLNRLYAKKRKELQERQKLKDVQVQKEEKDERSLDELLCFINGDGGSGGGESSTKSKKKNKRRKDHAKNPAKADSESVNVEGAACVVPCKVDSSNVSRLPXKVGTMQDDAEYPFEDADLDDGLDPAMKEELDREVEDFARRLNSVWSESHIGGNGSVQRFPGFNHR

SEQ ID NO: 6475 - protein, 139 aa, Zea mays
  Clone ID: PAT_MRT4577_93131C.1.pep
MAGKGGKGLLAAKTTAAKGAADKDKDKKKAPVSRSSRAGIQFPVGRIHRQLKQRVSANGRVGATAAVYSAAILEYLTAEVLELAGNASKDLKVKRITPRHLQLAIRGDEELDTLIKGTIAGGGVIPHIHKSLINKTSKE

SEQ ID NO: 6476 - protein, 305 aa, Zea mays
  Clone ID: PAT_MRT4577_93177C.1.pep
MPQRHSKNNNDLAFFTYEEKRKLGYGTQRERLGKDSIKPFDACCLCLKPLIDPLCCPKGHTFCKECILECLLAQKKDIKRKLAAHEAQKKQEKEEEEEKLILQKAKELDAFDQQNHGAVPQYHDRSGSQGKNGFHGANSVKVTSFEEEALRNMKAFWLPSATPEATVKVDAPSADTVCPEGQEKLKLKSLFPISFMEETADPKRKKAMEKSYMCPSCKSTLTNTMSLVAVSACGHVFCKKCSDKFLVKDKVCLECSKSFKERNLVPLEKGGTGFAAHDERLEARDFKHLGSGSGLGLVKPAPKAY

SEQ ID NO: 6477 - protein, 177 aa, Zea mays
  UNSURE (1)..(177): unsure at all Xaa locations
  Clone ID: PAT_MRT4577_93262C.1.pep
  unsure (1)..(177): unsure at all Xaa locations
HSTAMPAGMLPLXPLVLQQSSGLFXQLPLVHLLAQNMRAQQLQQLVLANLAAYSDHQQWLPFNPLSALNSGWYWQQQQLPFTQLPAAYPQQFLPFNQLAALNSCAYLQXRHLLPFIQLAGVSPATFXTQPQLLPCYQHVAPNAGTLLQLSQLLPFNQLALSNPVSFYQQPIIGGALF

SEQ ID NO: 6478 - protein, 65 aa, Zea mays
  UNSURE (1)..(65): unsure at all Xaa locations
  Clone ID: PAT_MRT4577_93337C.1.pep
  unsure (1)..(65): unsure at all Xaa locations
MAASEGALLGMGTPLLDIFAVDDDAFLGERDIQLSSALLAEDNHLPMYDELASICPVXYIGRGAT

SEQ ID NO: 6479 - protein, 66 aa, Zea mays
  UNSURE (1)..(66): unsure at all Xaa locations
  Clone ID: PAT_MRT4577_93415C.1.pep
  unsure (1)..(66): unsure at all Xaa locations
MAAKILCCLMLLGLSASVATETIFPQSXQPPIPSFLPPYLXPPVSSMLETPFVQPYRIQQPFAPGI

SEQ ID NO: 6480 - protein, 189 aa, Zea mays
  UNSURE (1)..(189): unsure at all Xaa locations
  Clone ID: PAT_MRT4577_93511C.1.pep
  unsure (1)..(189): unsure at all Xaa locations
VCDNPILRPYRIXQAITAGILLLSPLFLQQSSAYSXQLPLVHLLAHNIRAQLLXQQLVLANLSAYSQHQQFLPFNQLVALSSASYLQQQQLPFSQLFAAYPQQFLPFRXLTALISPAYIQQHQLLPFSQLAGVRRATFLTQPQLLPFYQHAALIAGTLFHLXQLLPFNQLALXSCSAFYHRAIFGGALF

SEQ ID NO: 6481 - protein, 61 aa, Zea mays
  Clone ID: PAT_MRT4577_93522C.1.pep
GGYVGAREDGGYGGGGPRNDGGGYGGGGGYGGGDEYGGGGGGYGGGNRGGGYGNSHGNWRN

SEQ ID NO: 6482 - protein, 178 aa, Zea mays
  UNSURE (1)..(178): unsure at all Xaa locations
  Clone ID: PAT_MRT4577_93624C.1.pep
  unsure (1)..(178): unsure at all Xaa locations
MLLVLSESAGTGTILPQCXRAPIAFLHAANLSPTVLSEWEHPSLRPYRIQQATRYVIVPLSPLLLQQSSAVLRQLPLERILSQNIRAQQLHQRELANLAAYSQHQEFLPFNQLAGWNSASYLRQHQLPCSQLSAVYPQQFLAFNQLTALNSPAYLQQRQLLPFSQLASVSPATFLTHH

SEQ ID NO: 6483 - protein, 82 aa, Zea mays
  UNSURE (1)..(82): unsure at all Xaa locations
  Clone ID: PAT_MRT4577_9367C.1.pep
  unsure (1)..(82): unsure at all Xaa locations
DGIRQIVSVYGDKTIKLWNTLCECKYTIGCDLSGREGHNGWVFXARFSPNTLQTTIACGCXDRTVKVWYLTNCKLSCTLDGH

SEQ ID NO: 6484 - protein, 101 aa, Zea mays
  Clone ID: PAT_MRT4577_93858C.1.pep
MFLRGSDSTGERIEMAASDVDYRCFDGGLTWATDDHSLHNAFSTYGEVLECRIILYRETHRHRGIGYATFSTEEAMRNAIDGMNGTELDGRNITVNEAQSL

SEQ ID NO: 6485 - protein, 254 aa, Zea mays
  Clone ID: PAT_MRT4577_9400C.1.pep
MAKRRRHELAPVVEELISPMNSLDDGCLMHIFSFLSPIPDRYNTALVCHRWRFLACHPRLWLRVERPIRDAMEPGVYPDLEAAVSAARPGDTILIAAGGSHVACNIQIKKPICIIGGGDLPDDTVLTCSRGFDNALEFLSTCKIANLTIRAELGCCLLHRGGRLTIQECLLQCEQNPLDHLSFPIISTAIEYDPFSSLKEQGHGVTVVRTRIEGGARAVRTNGTLALRHVRAIYSRSSVFFWFEVGEKVEAPVH

SEQ ID NO: 6486 - protein, 306 aa, Zea mays
  Clone ID: PAT_MRT4577_94022C.1.pep
MPQRHSKNNNDLAFFTYEEKRKLGYGTQRERLGKDSIKPFDACCLCLKPLIGPLCCPKGHTFCKECILECLLSQKKDIKRKLAAHEAQKKQEKEEEEEKLILQKAKELDAFDQQNHGAVPQYHDRSGSQYKNGFHGANSVKVTSFEEEALRNMKAFWLPSATPEATVKVDLPSTDTVCPEGQEKLKLKSLFPISFTEETADQKSSKAGNSCSYMCPSCKSTLTNTMSLVAVSTCGHVFCKKCSDKFLVKDKACLECSKPFRERNLVPLEKGGTGFAAHDERLEARDFKYLGSGSGLGLVKPAPKTY

SEQ ID NO: 6487 - protein, 342 aa, Zea mays
  Clone ID: PAT_MRT4577_94028C.1.pep
CGTAFTCWVSRSVSTVRPFYILRRCRCYRATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQHKNTEVSPQQVKESEAAPLISDSLSKVENGGGVVDDEPLKVPMWSSKYSRE

SEQ ID NO: 6488 - protein, 293 aa, Zea mays
  UNSURE (1)..(293): unsure at all Xaa locations
  Clone ID: PAT_MRT4577_94125C.1.pep
  unsure (1)..(293): unsure at all Xaa locations
MSFVFRGSRTDIEAGGFPGFAPERRAMRIHAGSRPVNSNSLAFLLTVLVLFMVLNSHQISPNLLLWLVLGVFLMATSLRMYATCQQLAHAAAANSFLGHTELRVHVPPSITLATRGRLQSLRLQLALLDREFDDLDYDTLRALDADNSPHAPSMSEEEINSLPVFKYKVQAQQRHPPARKSDGPSQLSVSSTGSGNEEKQDGLKADGTSKTSEDELTCSVCLEPLRVGDLLSSLPXLTXFHVRWNGQKLRHQGTCTICKHQVSDGWQSTGKAGQDASYMVRATDYESATVNYQ

SEQ ID NO: 6489 - protein, 280 aa, Zea mays
  Clone ID: PAT_MRT4577_94132C.1.pep
MSFVFRGSRTDIEAGGFPGFAPERRAMRIHAGSRPVNSNSLAFLLTVLVLFMVLNSHQISPNLLLWLVLGVFLMATSLRMYATCQQLAHAAAANSFLGHTELRVHVPPSITLATRGRLQSLRLQLALLDREFDDLDYDTLRALDADNSPHAPSMSEEEINSLPVFKYKVQAQQRHPPARKSDGPSQLSVSSTGSGNEEKQDGLKADGTSKPSEDELTCSVCLEQVTVGDLLRSLPCLHQFHVNCIDPWLRQQGTCPICKHQVSDGWHATGNGEEDASYMV

SEQ ID NO: 6490 - protein, 99 aa, Zea mays
  UNSURE (1)..(99): unsure at all Xaa locations
  Clone ID: PAT_MRT4577_94320C.1.pep
  unsure (1)..(99): unsure at all Xaa locations
NRHIHQLILCCLYRVXKVSQLELSFKEILNNGKKEAQCRPKVFLNIYIGSTNHNXVLISHHVDIITFYNEVFVPAAKPLLEPLISSDTRPKDKKNASGQ

SEQ ID NO: 6491 - protein, 289 aa, Zea mays
  Clone ID: PAT_MRT4577_94673C.1.pep
MKKCASELELEAFIRESGEDARAAAGGSSPGCGGSSDPGGSGVFSPGFGFADSDLLAPEQDTMDGGSWWYGNVRTPNPVMSQAASISASPGLTTSANHALESESDSDSESLYEVEGVPYERGNRSIETKRIRRMVSNRESARRSRRRKQAQLSDLESQVERLKGENATLFQQLSDANQQFSTAVTDNRILKSDVEALRIKVKMAEDMVARSAVSCGLGDLGLAPYVNSRKMCQALNVLTGLDLLGSDAFRGPTAGTRVQNSPVQSTASLESLDNRKSNEVTSCAADIWP

SEQ ID NO: 6492 - protein, 480 aa, Zea mays
  Clone ID: PAT_MRT4577_94704C.1.pep
MAVSHNVGSKHGVAPLEVSVEAGNGGAAEWLDDDGRPRRTGTFWTASAHIVTAVIGSGVLSLAWAIAQLGWVAGPAAMLLFAFVTYYTATLLAECYRTGDPDTGKRNYTYMDAVRSNLGGAKVAFCGAIQYANLVGVAIGYTIASSISMQAVSRAGCFHKRGHAVPCKSSSNPYMILFGAVQILFSQIPDFDQIWWLSIVAAVMSFTYSAIGLSLGIAQTVANGGFKGSLTGISIGADVTSTQKVWHSLQAFGDIAFAYSFSNILIEIQDTIKAPPPSESKVMQKATRLSVATTTIFYMLCGCMGYAAFGDKAPDNLLTGFGFFEPFWLIDVANVAIVVHLVGAYQVFCQPIFAFVERRAAAAWPDSAFVSRELRVGPLALSVFRLTWRSAFVCVTTVVAMLLPFFGNVVGFLGAVSFWPLTVYFPVEMYIKQRRVPRGSTKWVCLQTLSVACLVVSIAAAAGSIADVIEALKVYHPFSS

SEQ ID NO: 6493 - protein, 482 aa, Zea mays
  Clone ID: PAT_MRT4577_94705C.1.pep
MAPAPHNGVNNNHPVVPMEVSVEAGNAGAAEWLDDDGRPRRSGTFWTASAHIITAVIGSGVLSLAWAIAQLGWVAGPAAMLLFAFVTYYTAALLAECYRTGHPETGKRNYTYMDAVRSNLGGVKVVFCGVIQYANLVGVAIGYTIASSISMQAVSRAGCFHKRGHAVPCKSSSNPYMILFGAVQILFSQIPDFDQIWWLSIVAAVMSFTYSAIGLSLGIAQTVANGGFKGSLTGISIGADVTSTQKVWHSLQAFGDIAFAYSFSNILIEIQDTIKAPPPSESKVMQKATRLSVATTTIFYMLCGCMGYAAFGDKAPDNLLTGFGFFEPFWLIDVANVAIVVHLVGAYQVFCQPIFAFVERRAAAAWPDSAFVARELRVGPLALSVFRLTWRSAFVCATTVVAMLLPFFGNVVGFLGAVSFWPLTVYFPVEMYIKQRRVPRGSTKWVCLQTLSVACLVVSIAAAAGSIADVIEALKVYHPFSS

SEQ ID NO: 6494 - protein, 54 aa, Zea mays
  Clone ID: PAT_MRT4577_94884C.1.pep
AGAQKDLGNQEGQDHEKAAEGVEAEHEQDDVDGVFLADAVMRLSVGHGLGPRVR

SEQ ID NO: 6495 - protein, 53 aa, Zea mays
  Clone ID: PAT_MRT4577_94991C.1.pep
PQAGSNISRKPLGQRGQLIYTSASPQLTAAEHMWHQYLPAPACSAIAAEHLAL

SEQ ID NO: 6496 - protein, 43 aa, Zea mays
  UNSURE (1)..(43): unsure at all Xaa locations
  Clone ID: PAT_MRT4577_95056C.1.pep
  unsure (1)..(43): unsure at all Xaa locations
MSASDVEYRCFVGXLAFSTSNDSLENAFSSYCDILDSNVITYR

SEQ ID NO: 6497 - protein, 117 aa, Zea mays
  UNSURE (1)..(117): unsure at all Xaa locations
  Clone ID: PAT_MRT4577_95065C.1.pep
  unsure (1)..(117): unsure at all Xaa locations
MHIRVPTMAPKIFRFLMLLGLSASXVATVTIFPQCSQAPIAVLITPYLSPTVSSMCENPIVQPYXIQHAIATGILPLXPLFLQQPCALLQXLPLVHLVAIQYIRAQQLQQLVLANIA

SEQ ID NO: 6498 - protein, 80 aa, Zea mays
  Clone ID: PAT_MRT4577_95066C.1.pep
MGGFVGTHKTKAEFKRFQVKFNRRLSVKTDYRASIRLINQDKNKYNTPKYIFVSRFTNKDITSQIIFASIAFDMDLASVY

SEQ ID NO: 6499 - protein, 54 aa, Zea mays
  Clone ID: PAT_MRT4577_95234C.1.pep
LATHKKAERFMTQIGARQDTPRCAEIEHQEHRHNRAPFRQGDGARPYIVSPKSR

SEQ ID NO: 6500 - protein, 399 aa, Zea mays
  Clone ID: PAT_MRT4577_95273C.1.pep
MMNLSAAANGRDEFPPYVVPSNAAAPPPSLLPTMEQQQESSIHREHHQLLGYNLEANSLALLPPSNAAAAHHHTTFAGGHSPHDILHFYTPPPSAASHYLAAAAGNPYSHLVSAPGTTFHQTSSSYYPPAAAAQAAPEYYFPTLVSSAEENMASFAATQLGLNLGYRTYFPPRGGYTYGHHPPRCQAEGCKADLSSAKRYHRRHKVCEHHSKAPVVVTAGGLHQRFCQQCSRFHLLDEFDDAKKSCRKRLADHNRRRRKSKPSDADAGDKTRAHANKAAAAKDKAESSSKNMDIGDGLGAQILGSALLSKEQDQAMDLGEVVKEAVDPKGKASMQQHYGFPFHSSSAGSCFPQTQAVSSDTTSNIGQVQEPSLGFHHQHHQHSNILQLGQAMFDLDFDH

SEQ ID NO: 6501 - protein, 73 aa, Zea mays
  Clone ID: PAT_MRT4577_95443C.1.pep
LPRKHPLYIECFNGRLVHPCMLIVVNACDHLQLAAYRLPQPVATFEHLFVDDILITNTLTWLLTNRQPRYLID

SEQ ID NO: 6502 - protein, 286 aa, Zea mays
  Clone ID: PAT_MRT4577_95672C.1.pep
MGITINSFPKPQPPTNLRLPSPSDPPRPQQSAMSSSPTPAPDAGAAAMAVDDSSETDQLDSMSTEDIVRATRLLDNEVRVLKDELQRNNLELENVKDKIKENQEKIKLNKQLPYLVGNIVEILEMNPEDEAEEDGANIDLDSQRKGKCVVLKTSTRQTIFLPVIGLVDPDNLKPGDLVGVNKDSYLILDTLPSEYDSRVKAMEVDEKPTEDYNDIGGLEKEIQELVEAIVLPMTHKEQFQKLGIRPPKGVLLYGPPGTGKTLMARACAAQTNATFLKLAGPQLVQM

SEQ ID NO: 6503 - protein, 75 aa, Zea mays
  Clone ID: PAT_MRT4577_9575C.1.pep
RPSLAPQAGGSAPGLVCLCVVTLPSHQRGRLVPKLPFPLWSSPANIVIKSVWVMVCYQNIGSCMNGPVHGLGFLA

SEQ ID NO: 6504 - protein, 587 aa, Zea mays
  UNSURE (1)..(587): unsure at all Xaa locations
  Clone ID: PAT_MRT4577_95838C.1.pep
  unsure (1)..(587): unsure at all Xaa locations
MGSYAYKYCMCFTRKFRSPDAQPPPDVRAAHLSFASDAHALRRFVAGVQGESPADVDRILAMLSGGHSHGIARLVTRSPAASTPTLEDFFAFLFSPDLNPPIAHQVHQDMSAPFSHYFVFTGHNSYLTGNQLNSDSSDVPIVKALQRGVRVIELDMWPNPSKDNVDILHGGTLTAPVEMIKCLKSIKEYAFCASNYPLVITLEDHLTSDLQAKVATMLTETFGDLLFVPNPDPMKEFPSPASLMKRIIISTKPPQEYKEFLKAENNRSGSGNIAELPDQGSLRRIDSNADESDGKDELDEQDEEDSDEDDPKFQQDTACEYRKLITIQAGKPKGHLRDALKVDPDKVRRLSLSETQLAKATISHGAEVIRFTQKNILRVYPKGTRVNSSNYDPMNAWTHGAQMVAFNMQGHDKALRLMQGFFRANGGCGYVKKPDFLLRTGPNGEVFDPKASLPVKKPLXKVKVYMGDGWRMDFSKTHFDAFSPPDFYTRVGIAGVKAHSVMKKTRVIEAQWVPMWDEEFTFLLTVPELALLRVEVQEYDMSEKPDFGGQTVLPVWELKQGIRAVPLHDRKGVRYKSVRLLMRFDFV

SEQ ID NO: 6505 - protein, 77 aa, Zea mays
  Clone ID: PAT_MRT4577_95881C.1.pep
EEFHSLAAVDYRLPHRFRGRGTGRALSRESVFIVSAQALLPLVVMKGTNSRHLFRIKRSNSIITDFTHSFDNLNMMY

SEQ ID NO: 6506 - protein, 100 aa, Zea mays
  Clone ID: PAT_MRT4577_96002C.1.pep
MAAEGEKKMITLKSSDGEEFEVEEAVAMDSQTIRHMIEDDCADNGIRLPNGHSNILCKVIECCNKHVHADADAGDASKAGYHNVGDAFDNSNDNSGEDRQ

SEQ ID NO: 6507 - protein, 506 aa, Zea mays
  Clone ID: PAT_MRT4577_96005C.1.pep
MAPPQTIPRRGLFIGGAWREPCLGRRLPVVNPATEATIGDIPAGTAEDVEIAVAAARDAFSRDGGRHWSRAPGAVRANFLRAIAAKIKDRKSELALLETLDSGKPLDEASGDMDDVAACFEYYADLAEALDGKQQSPISLPMENFKSYVLKEPIGVVGLITPWNYPLLMATWKVAPALAAGCTTILKPSELASVSCLELGAICMEIGLPPGVLNIITGLGPEAGAPLSSHSHVDKVAFTGSTETGKRIMISAAQMVKPVSLELGGKSPLIVFDDIGDIDKAVEWTMFGIFANAGQVCSATSRLLLHEKIAKKFLDRLVAWAKNIKVSDPLEEGCRLGSVISEGQYEKIKKFISTARSEGATILYGGGRPQHLRRGFFLEPTIITDVSTSMQIWQEEVFGPVICVKEFRTESEAVELANDTHYGLAGAVISNDQERCERISKALHSGIIWINCSQPCFVQAPWGGNKRSGFGRELGEWGLDNYLTVKQVTKYCSDEPWGWYQPPSKL

SEQ ID NO: 6508 - protein, 289 aa, Zea mays
  Clone ID: PAT_MRT4577_96019C.1.pep
MEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRAIFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 6509 - protein, 585 aa, Zea mays
  Clone ID: PAT_MRT4577_96073C.1.pep
MAEAGDPTLEQGLLANPEESNQLTYSGDGSVDFSGNPVVKEKTGRWKACPFILGNECCERLAYYGISTNLVTYLTKKLHDGNSSAARNVTTWQGTCYLTPLIGAILADAYWGRYWTIATFSTIYFIGMSVLTLSASVPMLMPPSCEGAFCPEASPLQYTVFFLGLYLIALGTGGIKPCVSSFGADQFDDTDPAERIQKGSFFNWFYFSINIGALISSSFLVWVQDNVGWGLGFGIPTVFMGLAIISFFSGTSLYRFQKPGGSPITRVCQVIVASLRKWNVPVPEDSSLLYELPNGVSTIEGSRQIEHTDELRCLDKAATVTEVDVKTADFNNPWRICTVTQVEELKILVRMFPVWATTIVFSAVYAQMSTMFVEQGMVLDPSLGSFKIPPASLSTFDTLSVIICVPMYDYIVVPIARRFTGNERGFTELQRMGIGLVISIIAMSVAAVLEIKRLAVAREAHLVDQNVPVPLSIFWQIPQYFLIGLAEIFTFIGALEFFYDQSPDAMRSLCSALNLLTTAFGNYLSTFILTMVAYFTTRGGNPGWIPDNLNEGHLDYFFLLIAGISFLNLIVYVLCAGKYKSKKAA

SEQ ID NO: 6510 - protein, 89 aa, Zea mays
  UNSURE (1)..(89): unsure at all Xaa locations
  Clone ID: PAT_MRT4577_96215C.1.pep
  unsure (1)..(89): unsure at all Xaa locations
HDPFEVLDQRGVGELVKFATERVRKARSNLKVGICGEHGGEPSSVXFFAKXGLDYVSCSPFRVPIARLAAAQVLVLSCLLIGNRISAAG

SEQ ID NO: 6511 - protein, 96 aa, Zea mays
  UNSURE (1)..(96): unsure at all Xaa locations
  Clone ID: PAT_MRT4577_96289C.1.pep
  unsure (1)..(96): unsure at all Xaa locations
MALSVVKTSYGLEYKVKDLSQADFGRLETELTPVRMPGLIACRTKLSPCKPFIRARISGSMHMTIQTAVLMETITALGSEVRXCCCNIFCTHDHAD

SEQ ID NO: 6512 - protein, 493 aa, Zea mays
  Clone ID: PAT_MRT4577_96538C.1.pep
MAGAAAVETAAAAAAANGKACCHAAKGPGYATPLEAMEKGPREKLVYVTCVYNGTGINKPDYLATVDLDPSSPTYSQVIHRLPVTHIGDELHHSGWNSCSSCHGDPSAKRRFLILPSLLSGRVYVVDTATDPRAPSLHKVVESEDIAENTGLGFPHTSHCLASGDIMISCLGDKEGNAAGNGFLLLDSEFNVKGRWEKPGHSPLFGYDFWYQPRHKTMISSSWGAPAAFRTGFDLQHVQDGLYGRHLHVYDWPGGELKQTLDLGDTGLLPLEVRFLHDPSKDTGYVGCALTSNMVRFFKTADGSWSHEVAISVKPLKVRNWILPEMPGLITDFVISLDDRYLYFVNWLHGDIRQYNIEDPAKPFLAGQVWVGGLLQKGSDVVYVTDDGQEQQYNVPQVKGHRLRGGPQMIQLSLDGKRIYVTNSLFSRWDEQFFGDDLVKKGSHMLQIDVDTEKGGLAVNPNFFVDFGTEPDGPALAHEMRYPGGDCTSDIWI

SEQ ID NO: 6513 - protein, 75 aa, Zea mays
  Clone ID: PAT_MRT4577_96581C.1.pep
MASAKRSREENVYMAKLAQQAERYKEMVEFMDKVAKTVDSDELTVEERSLLSVTYKNVIGARRASWRIISSIEQK

SEQ ID NO: 6514 - protein, 179 aa, Zea mays
  UNSURE (1)..(179): unsure at all Xaa locations
  Clone ID: PAT_MRT4577_96713C.1.pep
  unsure (1)..(179): unsure at all Xaa locations
ALGVVACARVLVHFIGHQNIRXAQQLQXXCAXANLAXXLXQQQQXFFHFNXQLGSXXNSXXSYLQQTTELPFKPXLXXAAYXPAXXLPFSXXXAALNXSCXYLQQQXQLLXHSAXAXGGEGPATXXLTQPXXLLPFXQHVXPNAGTXXLQLQQLLPFNQLALTNPAVFYQQPIIGGALF

SEQ ID NO: 6515 - protein, 72 aa, Zea mays
  UNSURE (1)..(72): unsure at all Xaa locations
  Clone ID: PAT_MRT4577_9673C.1.pep
  unsure (1)..(72): unsure at all Xaa locations
MAVTITLGKARQIFRSRGNPTVQVDVGPKDGSYAKGGVPNGASTGIYEGLELKDXDLDNLAKVVLKPATTVT

SEQ ID NO: 6516 - protein, 580 aa, Zea mays
  Clone ID: PAT_MRT4577_96895C.1.pep
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESGIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGEDDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 6517 - protein, 228 aa, Zea mays
  UNSURE (1)..(228): unsure at all Xaa locations
  Clone ID: PAT_MRT4577_96897C.1.pep
  unsure (1)..(228): unsure at all Xaa locations
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGXWGWGFGIPAVVMAIAV

SEQ ID NO: 6518 - protein, 580 aa, Zea mays
  UNSURE (1)..(580): unsure at all Xaa locations
  Clone ID: PAT_MRT4577_96902C.1.pep
  unsure (1)..(580): unsure at all Xaa locations
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESGIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRXIVPLVPSYTGRPRGFTQLQRMGIGLVVSIFSMVAAGVLDIVRLRAIARHGLYGENDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 6519 - protein, 81 aa, Zea mays
  UNSURE (1)..(81): unsure at all Xaa locations
  Clone ID: PAT_MRT4577_9696C.1.pep
  unsure (1)..(81): unsure at all Xaa locations
MADEAKAXGYAAFSAGRFEEAVXYFTDAIGLVRDNQVVYSNRSVALALLHRYSDALSDAQNXTCDLMPDWAKGYSRLGAAH

SEQ ID NO: 6520 - protein, 422 aa, Zea mays
  Clone ID: PAT_MRT4577_97035C.1.pep
MDALPPLQRATSPPPQPRPQPPVPSRRYGVHFSASSFIQAPLTTLLEYSGILRPDPGGGTQQDGAGAGPGEVSIRIVAPGEAGTSSERPEEVIVEEEEEDGHATRTRPEDPSPAAGGGEGGRESSSSYQRYDIQQVARWVEQILPFSLLLLVVFIRQHLQGFFVTIWIAAVMFKSNDILRKQTALKRERKIPVLVGITILFVVHVSGFYWCYKNGDLIRPLMMLPPKEIPPFWHAIFIILVNDTMVRQTAMVVKCLLLMYYKNSRGRSYRRQGQMLTIVEYFLLLYRALLPTPVWYRFFLNKEYGSLFSSLTTGLYLTFKLTSVVEKVQSFLTALRALSHKDFHCGSYATSEQVAAAGDLCAICQEKMHVPILLRCKHVFCEDCVSEWFERERTCPLCRALVKPADLRSFGDGSTSLFFQLF

SEQ ID NO: 6521 - protein, 256 aa, Zea mays
  Clone ID: PAT_MRT4577_97181C.1.pep
MSREENVYMAKLAEQAERYEEMVEYMEKVAKTVDVEELTVEERNLLSVAYKNVIGARRASWRIVSSIEQKEESRKNEEHVNLIKEYRGKIEAELGNICDGILKLLDSHLVPSSTAAESKVFYLKMKGDYHRYLAEFKTGPERKESAESTMMAYKAAQDIALAELAPTHPIRLGLALNFSVFYYEILNSPDKACNLAKQAFDEAISQLDTLGEESYKDSTLIMQLLRDNLTLWTSDLTEDGADEGKEAPKGEAGDGQ

SEQ ID NO: 6522 - protein, 263 aa, Zea mays
  Clone ID: PAT_MRT4577_97182C.1.pep
MSREENVYMAKLAEQAERYEEMVEYMEKVAKTVDVEELTVEERNLLSVAYKNVIGARRASWRIVSSIEQKEESRKNEEHVNLIKEYRGKIEAELSNSGSRENTICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQ

SEQ ID NO: 6523 - protein, 256 aa, Zea mays
  Clone ID: PAT_MRT4577_97187C.1.pep
MAREENVYMAKLAEQAERYEEMVEYMEKVAKTVDVEELTVEERNLLSVAYKNVIGARRASWRIVSSIEQKEESRKNEEHVNLIKEYRAKIEAELSNICDGILKLLDSHLVPSSTAAESKVFYLKMKGDYHRYLAEFKTGPERKESAESTMMAYKAAQDIALAELAPTHPIRLGLALNFSVFYYEILNSPDKACNLAKQAFDEAISQLDTLGEESYKDSTLIMQLLRDNLTLWTSDLTEDGADEGKEAPKGEAGDGQ

SEQ ID NO: 6524 - protein, 280 aa, Zea mays
  Clone ID: PAT_MRT4577_97190C.1.pep
MAREENVYMAKLAEQAERYEEMVEYMEKVAKTVDVEELTVEERNLLSVAYKNVIGARRASWRIVSSIEQKEESRKNEEHVNLIKEYRAKIEAELSNICDGILKLLDSHLVPSSTAAESKVFYLKMKGDYHRYLAEFKTGPERKESAESTMMAYKAAQDIALAELAPTHPIRLGLALNFSVFYYEILNSPDKACNLAKQAFDEAISQLDTLGEESYKDSTLIMQLLRDNLTLWTSDLTEDGADEGKEAPKGEAGDVQKGTVILGERILFEPIVLDALCCRS

SEQ ID NO: 6525 - protein, 55 aa, Zea mays
  Clone ID: PAT_MRT4577_97200C.1.pep
YRCFIRGLSWATDDHSLHNAFNTYGEVLESNIILDQETHTSLDFSFDTFYTEDSM

SEQ ID NO: 6526 - protein, 83 aa, Zea mays
  Clone ID: PAT_MRT4577_97404C.1.pep
KARLSRGLPRSKVQGPSGALLKKEKDGDVFLWSNTSSLLPFVTMFVRSQKMYGGVCPKPTQVFLWWEPQNQKRTVFFFPPSKF

SEQ ID NO: 6527 - protein, 370 aa, Zea mays
  Clone ID: PAT_MRT4577_97516C.1.pep
MAAGAGGGELEALEGVRSIVLKPSESLDESRFTRIAGADFNDPAVGLEGLLASLASTGFQASNLGDAIDVVNQMLDWRLSHEKPSEDCDEAELDPKYRASVKCKIFLGFTSNLVSSGIRDIIRFLAQHHMVDVIVTSAGGIEEDLIKCLAPTYRGDFSLPGALLRSKGLNRIGNLLVPNDNYCKFENWIMPLFDQMLQEQSTENVWTPSKVIARLGKEINDESSYLYWAYKNNIPVYCPALTDGSLGDMLFCHAVRNPGLIIDIVQDIRLMNGEAIHATPRKTGIIVLGGGLPKHHICNANMFRNGADYAVYINTAQEFDGSDSGAHPDEAVSWGKIKGSAKPVKVHCDASIAFPLLVAATFARKVHNSK

SEQ ID NO: 6528 - protein, 87 aa, Zea mays
  Clone ID: PAT_MRT4577_97632C.1.pep
AGGAGSGAAGDGYGVGGAGYDGGNRAGGYASSCGFCRNWAVGPARPSYPVRGRVVYPSPECFLRSVSCLLLPPCVFALKRRLLCSGC

SEQ ID NO: 6529 - protein, 72 aa, Zea mays
  UNSURE (1)..(72): unsure at all Xaa locations
  Clone ID: PAT_MRT4577_97676C.1.pep
  unsure (1)..(72): unsure at all Xaa locations
YYSRQHILPFSQXVGVSPVAFLTQHSLLPFYLHGGLNVGTFLQLHQLLPFNQLVLTNPAGFYQQPIIGGALF

SEQ ID NO: 6530 - protein, 153 aa, Zea mays
  UNSURE (1)..(153): unsure at all Xaa locations
  Clone ID: PAT_MRT4577_97760C.1.pep
  unsure (1)..(153): unsure at all Xaa locations
QHRKHNTVPTVAAKNFXLLMLLGLSASAATATIFPQCSQAPIASLIPPYLSPTVXSSVCXENPILQPYRIQQAIPAGILPLSPLXSNKSSAXLLQQVPLVPLLAQNINAQQLQQPVLETLVATLXQQEVFSYNQLTGFNSASYLEEQQLPFSQ

SEQ ID NO: 6531 - protein, 272 aa, Zea mays
  Clone ID: PAT_MRT4577_97786C.1.pep
MDPSAVSFDSGGARRGGGAQMLLFGGGGSANSNGFFRGVPMAVLGMDDATRVGKRPFFTTHEELLEEEYYDEQAPEKKRRLTAEQVQLLERSFEEENKLEPERKTELARRLGMAPRQVAVWFQNRRARWKTKQLETDYDRLKAAYDALAADHQGLLADNDNLRAQVISLTEKLQGKETSPSATTAAQEVDQPDEHTAVSGTEELLAQQLKDNLHSSGDCTGHGTLSSEEDDGGVVSDEGCSFALPDAMFAAGFTHHGAEEVQLANWTSMFWN

SEQ ID NO: 6532 - protein, 271 aa, Zea mays
  UNSURE (1)..(271): unsure at all Xaa locations
  Clone ID: PAT_MRT4577_97787C.1.pep
  unsure (1)..(271): unsure at all Xaa locations
MHPSAVSFDSGDGRAAXGGAQMLLFGGGGSANSNGFFRGVPMAVLAMDDATRVGKRPFFTTHDELLEEEYYDEQAPEKKRRLTAEQVQLLERSFEEENKLEPERKTELARRLGMAPRQVAVWFQNRRARWKTKQLETDYDRLKAAYNALAADHQGLLADNDSLRAQVICLTEKLQGKETSLSATIAAQEVDQPNEHTTGTEKLLAQQLKDDLHSSCGCTGHGALSSEEEDGGVVSDEGCNFDLPDAMFAVGVTNHGAEEAQLANWTSWFWN

SEQ ID NO: 6533 - protein, 107 aa, Zea mays
  UNSURE (1)..(107): unsure at all Xaa locations
  Clone ID: PAT_MRT4577_97851C.1.pep
  unsure (1)..(107): unsure at all Xaa locations
GSPAFGFMGEQIEMAASDVEYRCFIRGLSWATDDHSLHNAFSTYGEVLXSKIILDRETQRSRGFSFRTLFTEEAMPNAIEGMNGKELDGRNITCNKAQSRGCRRSCG

SEQ ID NO: 6534 - protein, 87 aa, Zea mays
  UNSURE (1)..(87): unsure at all Xaa locations
  Clone ID: PAT_MRT4577_9787C.1.pep
  unsure (1)..(87): unsure at all Xaa locations
KNCLKEAGIGTMLNELSSPVVFXRPKDXKFFPRWQLAXKGXIAPVVVMPSVNIAKVDYFLNELVXKRAPWFQDGINQPPCISKKVGV

SEQ ID NO: 6535 - protein, 53 aa, Zea mays
  Clone ID: PAT_MRT4577_97913C.1.pep
IVSRIKQSGVGLRRVRREYKAKKMSEEDYVSAIMEAVNRVVKLQQERGIEVLV

SEQ ID NO: 6536 - protein, 243 aa, Zea mays
  UNSURE (1)..(243): unsure at all Xaa locations
  Clone ID: PAT_MRT4577_97919C.1.pep
  unsure (1)..(243): unsure at all Xaa locations
MDSASRVAPPPVSAGVRVRAPLVESVSCYCRLDTGLKTVVDARKLLXGAKMCMQPDVKQTKRKSRGSRKERCRAQAPLLPGLPDDLAIACLIRVPRVEHPNLRTVCKRWNRLLSGNYYYSLRKKLSMAEEWVYVFKRDREGKISWHAFDPLNQLWKSLPPVPPEYSEALGFGCAVLSGCYLYLFGGKDPLRGSMRRVVFYNARTNKWHRAPDMLRKRHFFGSCVIKKWLYVAGGECGSIQRTP

SEQ ID NO: 6537 - protein, 73 aa, Zea mays
  Clone ID: PAT_MRT4577_97947C.1.pep
ALQIGSLMSAPSASSCVEKQLSMSAQKTRYREEVFQHPHPGGFNQAKHSTARLVGLPHAAPGVGRGICRASAR

SEQ ID NO: 6538 - protein, 140 aa, Zea mays
  Clone ID: PAT_MRT4577_97997C.1.pep
VVCPTLYSESYYANAHAWHLVAATITLLLSQLAGRLFAFTLPLPLTANLLHSSHPPLSIHRPTLPTRHGGPRIRQLSTGGGTPYQRSERCPPRSYFRGGLGRPLPGHPPRGGRDLLHYLRAVQGHQAHRGYNGVVGQHLT

SEQ ID NO: 6539 - protein, 90 aa, Zea mays
  Clone ID: PAT_MRT4577_98095C.1.pep
PAPRPPPFIPQSHSPQATAATKVRRGTHYWEPSNYTRMQYRIKQVCGLCAPELALARSRAGRYYGQPKRWWCFFSPLASLAYLGSFFFSG

SEQ ID NO: 6540 - protein, 134 aa, Zea mays
  Clone ID: PAT_MRT4577_98097C.1.pep
MSEEKHHHFFHHHKKDGEEQPTGEYGYSETVAAEVVTTGEDEYEKYKKEEKEHKHKQHLGEAGAIAAGAFALYEKHEAKKDPEHAHRHKITEEVAAAAAVGAGGYAFHEHHEKKKDHKDADEASGEKKHHHLFG

SEQ ID NO: 6541 - protein, 131 aa, Zea mays; identical to SEQ ID NO: 5738
  Clone ID: PAT_MRT4577_98100C.1.pep

SEQ ID NO: 6542 - protein, 101 aa, Zea mays
  Clone ID: PAT_MRT4577_98174C.1.pep
PKDPRVFGDPPGDFVPARFLGEEGSKLLQYVYWSTAPETENPRVANKQCPGKNFLVLVGRVLLVELFLRYDPFPPKVGKELFGPRVFFPGVPKAPSGPGSE

SEQ ID NO: 6543 - protein, 104 aa, Zea mays; identical to SEQ ID NO: 5724
  Clone ID: PAT_MRT4577_98231C.1.pep

SEQ ID NO: 6544 - protein, 80 aa, Zea mays
  UNSURE (1)..(80): unsure at all Xaa locations
  Clone ID: PAT_MRT4577_98283C.1.pep
  unsure (1)..(80): unsure at all Xaa locations
SGFFEVTHDVCHLTCADWLRAPGVQTPVIVRFSTVVHERGSPWTLRDPRGFAVKFYTRVWYFDLRGNNMPXFFITXGIKF

SEQ ID NO: 6545 - protein, 425 aa, Zea mays
  Clone ID: PAT_MRT4577_98362C.1.pep
MEAAGRLLLLIVSSLLLLFSPERPAEAAPPRIQPLATAALSRLYDTSNYGRLQLNNGLALTPQMGWNSWNFFACNINETVIRETADALVSTGLAALGYNFVNIDDCWSYVKRGKQDQLLPDPKTFPSGVKALADYVHGKGLKLGIYSDAGKFTCQVRPGSLGHENDDAAIFASWGIDYLKYDNCYNLGIKPQKRYPPMRDALNSTGRQIFYSLCEWGQYDPALWAGKVGNSWRTTDDITDTWKSMTDIADKNNKWASYAGPGGWNDPDMLEVGNGGMTLAEYRSHFSIWALMKAPLLIGCDVRNMTSETMEILSNKEVIQVNQDPLGVQGRKILGQGKYGCREVWAGPLSGNRLVVALWNRCSDTANVTMKLPAVGLDGYAAYSVRDLWKHETLSENVVGTFGAQVDVHDTKMYIFSPATIVASV

SEQ ID NO: 6546 - protein, 333 aa, Zea mays
  Clone ID: PAT_MRT4577_98428C.1.pep
MATSMGCLVLLCLVSSLLPSAVLGHPWGGLFPQFYDHSCPKAKEIVQSIVAQAVAKETRMAASLVRLHFHDCFVKGCDASVLLDNSSSIVSEKGSNPNRNSLRGFEVIDQIKAALEAACPGTVSCADIVALAARDSTALVGGPYWDVPLGRRDSLGASIQGSNNDIPAPNNTLPTIITKFKRQGLNVVDVVALSGGHTIGMSRCTSFRQRLYNQTGNGMADSTLDVSYAAKLRQGCPRSGGDNNLFPLDFITPAKFDNFYYKNLLAGKGLLSSDEILLTKSAETAALVKAYAADVNLFFQHFAQSMVNMGNISPLTGSQGEIRKNCRRLNNDH

SEQ ID NO: 6547 - protein, 354 aa, Zea mays
  UNSURE (1)..(354): unsure at all Xaa locations
  Clone ID: PAT_MRT4577_98430C.1.pep
  unsure (1)..(354): unsure at all Xaa locations
TLNYSTWLVITNHLQHCYMXGCDASVLLDNSSSIVSEKGSNPNRNSLRGFEVIDQIKAALEAACPGTVSCADIVALAARDSTALVCSTIDNPFQPQGTDMIFVCVCVCIYIYSDSFGKLRYFLSSKXXGGPYWDVPLGRRDSLGASIQGSNNDIPAPNNTLPTIITKFKRQGLNGGDVAALSGXFLVFIRNIWPSLFTNLAHTHITHGYNIMCEYXGHTIGMSRCTSFRQRLYNQTXNGMADSTLDVSYAAKLRQGCPRSGADSTLFPLDVVAPAKFDNFYYKNLLAGRGLLSSDEVLLTKSAQTASLVKAYAADAGLFFRHFAQSMVSMGNISPLTGSQGEIRKNCRRLNSGH

SEQ ID NO: 6548 - protein, 901 aa, Zea mays
  Clone ID: PAT_MRT4577_98473C.1.pep
MDHVPALVLAGCCFLALLPGWACGLGSMSSIAVSYGEDGPVFCGLNSDGSHLVACFGADASVLYGAPPNIPFLGLTAGDGFVCGLLLDTRQPYCWGSNSYVKSGVPQPMVEGARYSELSAGDNHLCALRAAQDGGRGSSAATSLIDCWGYNMTATHAVDEAVSTVSAGSVFNCGLFARNRTVFCWGDETVSGVVGLAPRDLHFQSIGAGGYHVCGVLENAQVFCWGRSLEMQQVVPSSAIGDGDVNIVPMDAMSTVVGGRFHACGIRSLDHQVACWGFTLHNSTSPPKGLKMYALVAGDYFTCGVPAETSLMPRCWGNSGPLALPMAVPPGICVPTACSHGYYEYVNHGEVGSIKVCKPANSRLCLPCSTGCPEGLYESSPCNATADRVCQFDCLKCVTDECLSFCLSQKRTKSRKLMAFQMRIFVAEIVFAVVLVLSVSVTTCLYVRHKLRHCQCSNRELRLAKSTAYSFRKDNMKIQPDMEDLKIRRAQEFSYEELEQATGGFSEDSQVGKGSFSCVFKGILRDGTVVAVKRAIKASDVKKSSKEFHNELDLLSRLNHAHLLNLLGYCEDGSERLLVYEFMAHGSLYQHLHGKDPNLKKRLNWARRVTIAVQAARGIEYLHGYACPPVIHRDIKSSNILIDEDHNARVADFGLSILGPADSGTPLSELPAGTLGYLDPEYYRLHYLTTKSDVYSFGVVLLEILSGRKAIDMQFEEGNIVEWAVPLIKAGDIFAILDPVLSPPSDLEALKKIASVACKCVRMRGKDRPSMDKVTTALEHALALLMGSPCIEQPILPTEVVLGSSRMHKVSQMSSNHSCSENELADGEDQGIGYRAPSWITFPSVTSSQRRKSSASEADIVGRRATDGRNVGSSIGDGLRSLEEEIAPASPQENLYLQHNF

SEQ ID NO: 6549 - protein, 128 aa, Zea mays
  UNSURE (1)..(128): unsure at all Xaa locations
  Clone ID: PAT_MRT4577_98547C.1.pep
  unsure (1)..(128): unsure at all Xaa locations
ARLLIHQPLALSQQLPLLQRVAQNIRAQQLQQLVLTNLAAYSXQHQLVPFNQLAALNSAAYSQHQLPFIQIVDAYHQQFLTFNQLSAFNSAAYLQQQQLLPFSQLANVNPDAFLTQQHLLQFYLHAMP

SEQ ID NO: 6550 - protein, 57 aa, Zea mays
  Clone ID: PAT_MRT4577_98621C.1.pep
GLKKFFPSMGGDKNTNPGHKRYCFNELGIHYIGKYIPKQTLKSFQNQKKGSPFGGPH

SEQ ID NO: 6551 - protein, 48 aa, Zea mays
  Clone ID: PAT_MRT4577_98685C.1.pep
QDNKDVRHVKTYELALKDKDFIEGPWSQNNVDNGAGLSIPVPAPLGGV

SEQ ID NO: 6552 - protein, 69 aa, Zea mays
  UNSURE (1)..(69): unsure at all Xaa locations
  Clone ID: PAT_MRT4577_98731C.1.pep
  unsure (1)..(69): unsure at all Xaa locations
MAAKIFCLLMLLGLSASAATATIFPQCSQASIASLHPAYLSPAACAVCEYSILXPYTIHHALATGIIPL

SEQ ID NO: 6553 - protein, 257 aa, Zea mays
  Clone ID: PAT_MRT4577_98913C.1.pep
MSREDNVYMAKLAEQAERYEEMVEYMEKVAKTVDVEELTVEERNLLSVAYKNVIGARRASWRIISSIEHKEESRKNEEHVIQIKEYRGKIEAELSNICDGILKLIDSHLVPSSTAAESKVFYLKMKGDYHRYLAEFKTGAERKEAAESTMIAYKAAQDIALAELASTHPIRLGLALNFSVFYYEILNSPDKACNLARQAFDEAISQLDTLGEDSYKDSTLIMQLLRDNLTLWTADSTTEDGIEEGNEASKGDAGEGQ

SEQ ID NO: 6554 - protein, 252 aa, Zea mays
  Clone ID: PAT_MRT4577_98915C.1.pep
MSREENVYMAKLAEQAERYEEMVEYMEKVAKTTDVQELTVEERNLLSVAFKNVIAAPRASWRIISSIEQKEESRKNEEHVAQIKEYRGKIEAELSNICDGILKLLDTHLVPSSTATESKVFYLKMKGDYHRYLAEFKTGAERKESAESTMVAYKAAQDIALAELPPIHPIRLGLALNFSVFYYEIQNSPDKACNLAKEAFDEAISQLDMLGEDSYKDSNLIMQLLRDNLTLWTEDGIEEGLESSKGDAGEGQ

SEQ ID NO: 6555 - protein, 105 aa, Zea mays
  Clone ID: PAT_MRT4577_99007C.1.pep
TCFIDYRKDRSFFAPQGLGWLAPADQVVAAAQAASAARSTPYLQETSTGVQATAGLQPAPEKKAAPDLHEDGDESHEDVHRLKPEASTAIATSAIALNIDTRPWI

SEQ ID NO: 6556 - protein, 272 aa, Zea mays
  UNSURE (1)..(272): unsure at all Xaa locations
  Clone ID: PAT_MRT4577_99082C.1.pep
  unsure (1)..(272): unsure at all Xaa locations
MGRGKVQLKRIENKINRQVTFSKRRNGLLKKAHEISVLCDAEVAVIVFSPKGKLYEYATDSRMDKILERYERYSYAEKALISAESESEGNWCHEYRKLKAKIETIQKCHKHLMGEDLESLNPKELQQLEQQLESSLKHIRSRKSHLMAESISELQKKERSLQEENKALQKELAERQKAVASRQQQQQQXQWDQQTHAQAQTSSSSSSFMMRQDQQGLPPPHNICFPPLTMGDRGEELAAAAAAQQQQPLPGQAQPQLRIAGLPPWMLSHLNA

SEQ ID NO: 6557 - protein, 118 aa, Zea mays
  UNSURE (1)..(118): unsure at all Xaa locations
  Clone ID: PAT_MRT4577_99248C.1.pep
  unsure (1)..(118): unsure at all Xaa locations
MLDAAAVLAAALLLLAAGAGTAYAAVSCDQVTSYVAPGLGHAMRSAESPSAVRCSVVRSVNSRASSAADRQATCNCLKSMXTAXPAGVSMDNADNIPGKCGVSVGVPISHTADCTKIN

SEQ ID NO: 6558 - protein, 122 aa, Zea mays
  UNSURE (1)..(122): unsure at all Xaa locations
  Clone ID: PAT_MRT4577_99251C.1.pep
  unsure (1)..(122): unsure at all Xaa locations
MAARSSSQQLAAAAVLAAALLVLAAAAATPPAAASCGEVTTSEAPGLAYAMDSAAPPSAACCSGVRSLNSRASPAADRLVICTCLQSMTGRLGGGVSNDQXGNYPGKCGGPLAATINPNGHC

SEQ ID NO: 6559 - protein, 129 aa, Zea mays
  Clone ID: PAT_MRT4577_99256C.1.pep
MAARSSSQQLVAAAAAAVLAAALLLLAAGAGTASAAVSCGEVTSSVAPCLGYAMGSAASPSAACCSGVRSLNSRASSTADRQATCNCLKSMTGRLGGGVSMANAANIPGKCGVSVGVPISPTVDCTKIN

SEQ ID NO: 6560 - protein, 126 aa, Zea mays
  Clone ID: PAT_MRT4577_99257C.1.pep
MAARSSSQQLVAAAVLAAALLLLAAGAGTASAAVSCGEVTSSVAPCLGYAMGSAASPSAACCSGVRSLNSRASSTADRQATCNCLKSMTGRLGGGVSMANAANIPGKCGVSVGVPISPTVDCTKIN

SEQ ID NO: 6561 - protein, 129 aa, Zea mays
  UNSURE (1)..(129): unsure at all Xaa locations
  Clone ID: PAT_MRT4577_99258C.1.pep
  unsure (1)..(129): unsure at all Xaa locations
MAARSSSQQLVAAAAAAVLAAALLLLAAGAGTASAAVSCGEVTSSVAPCLGYAMGSAASPSAACCSGVRSLNSRASSTADRQATCNCLKSMTGRXGXGVSMANAANIPGKCGVSVGVPIIPTVDCTKIN

SEQ ID NO: 6562 - protein, 126 aa, Zea mays
  Clone ID: PAT_MRT4577_99262C.1.pep
MAARSSSQQLVAAAVLAAALLLLAAGAGTASAAVSCGEVTSSVAPCLGYAMGSAASPSAACCSGVRSLNSRASSAADRQATCNCLKSMTGRLGGGVSMANAANIPGKCGVSVGVPISPTVDCTKID

SEQ ID NO: 6563 - protein, 93 aa, Zea mays
  Clone ID: PAT_MRT4577_99318C.1.pep
PRYGGGGYAGGGGSGGGGGGSGGGGAGYGGGTRGGGFGNSPGNWRNLPVGPPRPSYPFRSRVVSPSPEGLSSFVSCLLFPPCVFDLRSLCARC

SEQ ID NO: 6564 - protein, 109 aa, Zea mays
  UNSURE (1)..(109): unsure at all Xaa locations
  Clone ID: PAT_MRT4577_99484C.1.pep
  unsure (1)..(109): unsure at all Xaa locations
MASMTMALSSTAFAGKAANVPSSSAFGEARATMRKTAAKAKPAAASGSPWYAPHRVLYLGALAGEPPTYLACESXSEYAVITAGVRALLVPEASFFFLGAMPIGCTATV

SEQ ID NO: 6565 - protein, 52 aa, Zea mays
  UNSURE (1)..(52): unsure at all Xaa locations
  Clone ID: PAT_MRT4577_99523C.1.pep
  unsure (1)..(52): unsure at all Xaa locations
MPSLRXVWVQGYKAFQPGQDLMLMASPFWNIKFPPPSSQNVGRLIKNGDPCV

SEQ ID NO: 6566 - protein, 258 aa, Zea mays
  UNSURE (1)..(258): unsure at all Xaa locations
  Clone ID: PAT_MRT4577_9957C.1.pep
  unsure (1)..(258): unsure at all Xaa locations
IGTLEAGRGKYLSPSRQQHQPRLLEFDRHGEPRKGKKDYSTAILERKKSPNRLVVDEATNDDNSVVALHPDTMERLQLFRGDTVLIKGKKRKDTVCIVLADETCEEPKVRMNKIVRKNLRVRLGDVVSVHQCPDVKYGKRVHILPIDDTIEGITGNLFDAFLKPYFLEAYRPLRKGDLFLVRGGMRSVEFKVIETDPAEYCIVAPDTEIFCEGEPIKREDEERLDEVGYDDVGGVRKQMAQIRELVELPLRHPXLFKS

SEQ ID NO: 6567 - protein, 200 aa, Zea mays
  UNSURE (1)..(200): unsure at all Xaa locations
  Clone ID: PAT_MRT4577_99607C.1.pep
  unsure (1)..(200): unsure at all Xaa locations
ESLKRETAPXFLTEHGVRRPSILGVREHIFTGSVSSLAWFMSNQEHSFVTIGQRLLANPLKVRFHYGHPDVFDRLFHLTTGGVSKASKSINLSEDIFAGYNSTLRGGNVTHHEYVQVGKGRDVGLNQISKFEAKIANGNGEQTLSRDIYRLGHRFDFFRMLSCYFTTVGFYFSTLLTVVTVYVFLYGRLYLALSGLEEGL

SEQ ID NO: 6568 - protein, 807 aa, Zea mays
  Clone ID: PAT_MRT4577_9961C.1.pep
MASQGEPSSSDPKGKKDYSTAILERKKSPNRLVVDEATNDDNSVVALHPDTMERLQLFRGDTVLLKGKKRKDTICIVLADETCEEPKVRMNKVVRKNLRVRLSDVVSVHQCPDVKYGKRVHILPIDDTIEGITGNLFDAFLKPYFLEAYRPLRKGDLFLVRGGMRSVEFKVIETDPAEYCIVAPDTEIFCEGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLEIIAKDTHGYVGADLAALCTEAALQCIREKMDIIDLEDETIDAEILNSMAVSNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRRKDNPEAMEEDEVDDIAEIKAAHFEESMKYARRSVSDADIRKYQAFAQTLQQSRGFGSEFRFPDQPTAAAAAADPFASAAAAADDDDLYS

SEQ ID NO: 6569 - protein, 103 aa, Zea mays
  UNSURE (1)..(103): unsure at all Xaa locations
  Clone ID: PAT_MRT4577_99757C.1.pep
  unsure (1)..(103): unsure at all Xaa locations
LMLLVLYASAASSTIISQCSQAPIASLLPPYXLSPTLSSKCENPILXPYRIQQAFAPGILPXSPLFLQQPTALLQHLPLXHLSAQNIQAQQLQQLVLGNLADY

SEQ ID NO: 6570 - protein, 65 aa, Zea mays
  Clone ID: PAT_MRT4577_99767C.1.pep
CIEKQSFEPWSSLEVLPDWGKKGHGIVFFMSAATSNVHIAWVCKNTVEHHIPHQQAFRLPMRRGS

SEQ ID NO: 6571 - protein, 91 aa, Zea mays
  UNSURE (1)..(91): unsure at all Xaa locations
  Clone ID: PAT_MRT4577_99835C.1.pep
  unsure (1)..(91): unsure at all Xaa locations
VSYILNVDCDHYFNSNKAFREAMSLMMDPAIGWKTCHAQLPQRCDGIDLHDRYANRNIIFXYDINCESLYGFQCTDDGGTRCVFNRQALYG

SEQ ID NO: 6572 - protein, 53 aa, Zea mays
  Clone ID: PAT_MRT4577_99841C.1.pep
SYIQMLDRRQPAKVQARLTMIEFYQSIDLPMALFICKPSRIAKTSACPQWATL

SEQ ID NO: 6573 - protein, 92 aa, Zea mays
  UNSURE (1)..(92): unsure at all Xaa locations
  Clone ID: PAT_MRT4577_99927C.1.pep
  unsure (1)..(92): unsure at all Xaa locations
RENMNGKERGGRNITGNQAQSRGGGGGGGRYCXGRGRRSYGGGPHDSSYGAGGGYCGLPAGGGGTYXGGGGYSSRREGGGGGYCGRSGCWRD

SEQ ID NO: 6574 - protein, 136 aa, Zea mays
  Clone ID: PAT_MRT4577_99994C.1.pep
MARTKQTARKSTGGKAPRKQLATKAARKSAPATGGVKKPHRSRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 6575 - protein, 800 aa, Oryza sativa
  Clone ID: PAT_MRT4530_100020C.1.pep
MSFSAISSSSSVSPHLTRRRLSPRVWSARPPFTGGGGGGCPMAAHERRTIDLEEGWAFMQKGITKLKNILEGKPEPQFSSEDYMMLYTTIYNMCTQKPPHDYSQQLYDKYRESFEEYITSMVLPSLREKHDEFMLRELVKRWSNHKVMVRWLSRFFHYLDRYFISRRSLPQLSEVGLSCFRDLVYQEIKGKVKSAVISLTYFLEQIDQEREGEQIDRALLKNVLDIFVEIGLTSMDYYENDFEDFLLKDTADYYSIKAQTWILEDSCPDYMLKAEECLKREKERVAHYLHSSSEQKLLEKVQHELLTQYASQLLEKEHSGCHALLRDDKVDDLSRMYRLFSRITRGLEPVSQIFKQHVTNEGTALVKQAEDAASNKKPEKKEIVGLQEQVFVRKIIELHDKYVAYVTDCFQGHTLFHKALKEAFEVFCNKGVSGSSSAELLATFCDNILKKGGSEKLSDEAIEDTLEKVVRLLAYISDKDLFAEFYRKKLARRLLFDKSANDEHERSILTKLKQQCGGQFTSKMEGMVTDLTVARDHQAKFEEFISTHSELNPGIALAVTVLTTGFWPSYKSFDINLPAEMVKCVEVFKEFYQTRTKHRKLTWIYSLGTCNINAKFEAKTIELIVTTYQAALLLLFNGVDRLSYSEIVTQLNLSDDDVVRLLHSLSCAKYKILSKEPNNRSISPNDVFEFNSKFTDKLRRLKIPLPPVDEKKKVVEDVDKDRRYAIDASIVRIMKSRKVLGHQQLVMDGVEQLGHIFKPDFQGCKEATSRIFSNKRFTWNGIIRHIEKIYRNWSCWVFYW

SEQ ID NO: 6576 - protein, 1581 aa, Oryza sativa
  UNSURE (1)..(1581): unsure at all Xaa locations
  Clone ID: PAT_MRT4530_100065C.1.pep
  unsure (1)..(1581): unsure at all Xaa locations
MPSWTPKRRSKQQQSRILFKPSSSLERPSVSANLVFPQELAMGQEDGDVPQPGVHRPRSRSGSIRRDAVAFEITSPADKRAPHAIHSSKENKGRDGDGSGGGVIGLGGGGGSARRTRLLHGRRTKGRRRREEEAPVGKGRERRWRRVGRRRLGMGGDGVGRRRSGKGKSGAGVGLGGGVGLGGVVGLERRRGAAVRTASSASVAAVVAPEGRCPWSSDAERRRQQEWMKNATEWYGSNFSKLQWHPADMTNSSDSSTTLLALLNRNMLKESLHDTIAGHIERNCKVDIDATLPRKVPAAAAPKRPQHLAASTSASVPGDKEHPQPGGRGVLSWTPGMAAIEQQMRKRALVTSVLSGRREVSPAMVVAALGRRCRVPSEDVRIEVTRPSDFLISFRREEDCASVLGWSGRFSVEGASISFRHWHRSVHARRSKLLFVVKLAVEGLPAHALEFEAIKQFLNKIDCQFIELFLPVDACMTEVLAWSVDPSKIPKEFTLDIPEPMQEWWMPPVMEDPDIHEPLVSQTPPAPPIEKRCLSSCWTAPPMTPTTTIARLCAGAPTAPSSXIDGTGPVVLSPPEPTPVEMEPASALGSPPEHTPEAMASLASLGSPPGTALGGLEVDVISDVVSSPMLAPEGPETVTILGAPVEHASPNEVLISIETVVMGPGSLTRPASAPAKLVVDPHVRESLGVGLARQISFEEPARDLLSSVAFTSSPPLPAVAPLAVVEGANLTFNPPGERESVPLSTGALEMVLGPWPEVHVASPQIVYRKRHLLPTSGRKWPTHRAALGLTQDGSPGAVPSLGDLVAPQPAAIIGTRPQATPARSKRRIEPYSHTPRRSERLAAINGGRHQHSVSKAQRVLMKKLRVVEDESKVEDTDILKYLELFKSPLVPAHVQALAALCNVRLCLHKGVWSLSLCVTNLEGGASWTLTNVYGPQETEQKIQFLEELTWVGQQCVQGAWCIVGDFNLLAAESDKNNGNVNRGLINRFRGLLNTLELRELYLFGRRYTWSSEQERPTITKINKVLMNADWEDFFRDAHLQALSSSASDHCPLLLACEAMVHRSRRFKFEAFWLHLEGFEEVVRSAWDVVPAGSNALSSLHFKLRATAMALKSWGERRISELRLQLAMAHEIILRLDGAMDLRLLSHEERSLRAALKGRCLALAALERIRLRQRARLRYLKHSGTASQFFYLKINARRRKKTIPVLQQGGVWGVTEEDKLAMAHDYFLEIMGSPSPPMVALDLGRLGLPTLDLSELEIEILEDEAKKVMLEMLSDRAPGPDGFGAAFYKRCWEIVKEDVVAALNLVLNANSQHLHLLNTASIILLPKKEDPMQLADYRPISLIHSFIKLFTKGVVQRLHRAKCPAILLKLDIAKAFDTVSWEFLLELLRHLGFGVKWHDCIAVLLVSSSTTVYEGCNWFGLELRESSITPIHCSDEQLAAVTEVLGCPVRLLPIVYLGLPLSVRKLGKADLQPMMDRLAKSLASWKPKLLALDARLAIIKHVLMVLPLYFMSVLELPVWAIKEIEKKCRGFLWKGDENAAGSCSLVAWDKLCLPIENGGLGIKDLRLMGVALRTRWPWLCRV

SEQ ID NO: 6577 - protein, 84 aa, Oryza sativa
  UNSURE (1)..(84): unsure at all Xaa locations
  Clone ID: PAT_MRT4530_100215C.1.pep
  unsure (1)..(84): unsure at all Xaa locations
GLGKGGAKXHRKVLRDXIQGITKPAIRRLARRGGVKRISGLIYEETRGXLKIFLENVIRDVVTYTEHXXRKXVTXXDVVYXLKR

SEQ ID NO: 6578 - protein, 126 aa, Oryza sativa
  UNSURE (1)..(126): unsure at all Xaa locations
  Clone ID: PAT_MRT4530_100251C.1.pep
  unsure (1)..(126): unsure at all Xaa locations
HSSAFECKKLVSATKARLKLDESADXKKRHEELTAKFEGLGKVIKDALADXATKVAVSDPVADSRCWLVTGEYGWTANMERIMKVHALEDSNMXGYISSXKKTIDINLDNAIMDELRKRADADKND

SEQ ID NO: 6579 - protein, 217 aa, Oryza sativa
  UNSURE (1)..(217): unsure at all Xaa locations
  Clone ID: PAT_MRT4530_100287C.1.pep
  unsure (1)..(217): unsure at all Xaa locations
TRPGRARDDRNDYYAIGTYDGETDTWTPDNADIDVGIGLRHDYGKFYASKTFYDPVGRRRVLWGWIGETDSERADILKGWASLQSIPRTVMLDTKTGSNLLQWPVVEVENLRMRGKSFDGLDVSPGSVVPLDVGKATQLDIEAVFEVDTSAADGVVTEAGAAAYSCGTGGGAVGRGLMGPVGLLVLADDQLSERTAGFFYLVKGXDXNLTTFFWEDE

SEQ ID NO: 6580 - protein, 142 aa, Oryza sativa
  Clone ID: PAT_MRT4530_100303C.1.pep
HASAHASAHASAHASGERERERRRERTESLILINSNNEAIILQGTFGPDDNQDDSSNTSSGVSLGDYFLGPGLDILLQHLAESDLNRSGTPPAKKEAVEALPTVNIQEVLGCSVCLEDFEMGTEAKEMPCQHKFHSQCILPW

SEQ ID NO: 6581 - protein, 551 aa, Oryza sativa
  UNSURE (1)..(551): unsure at all Xaa locations
  Clone ID: PAT_MRT4530_100469C.1.pep
  unsure (1)..(551): unsure at all Xaa locations
MGNACGGSLRSKYLSFKQTASQRHDTDDNNNAAAADSPKKPSRPPAAAKTDDHPVSASAPAAAMRRGQAPADLGSVLGHPTPNLRDLYAMGRKLGQGQFGTTYLCTELSTGVDYACKSISKRKLITKEDIEDVRREIQIMHHLSGHKNVVAIKGAYEDQLYVHIVMELCAGGELFDRIIQRGHYSERKAAELTRIIVGVVEACHSLGVMHRDLKPENFLLANKDDDLSLKAIDFGLSVFFKPGQTFTDVVGSPYYVAPEVLLKHYGPEADVWTAGVILYILLSGVPPFWAETQQGIFDAVLKGFIDFDSDPWPVISESAKDLITKMLNPRPKERLTAHEVLCHPWIRDHGVAPDRPLDPAVLSRIKQFSAMNKLKKMALRVIAESLSEEEIAGLKEMFQTMDADNSVAITYDERKEGFRKYGSTLQDTXNRDLMDWANIDNXGTIVYIEIISSILSLNKLEREEHLVAAFSYFDKDGSGYITVDELQQACKEHNMPDAFLDDVINEADQDNDGRIDYGEFVAMMTKGNMGVGRRTMRNSLNISMRDAPGAL

SEQ ID NO: 6582 - protein, 173 aa, Oryza sativa
  Clone ID: PAT_MRT4530_100499C.1.pep
MAAEGEKKMITLKSSDGEEFEVEEAVAMESQTIRHMIEDDCADNGIPLPNVNSKILSKVIEYCNKHVHAAAAAASKAADDAASAAAAVPPPSGEDLKNWDADFVKVDQATLFDLILAANYLNIKGLLDLTCQTVADMIKGKTPEEIRKTFNIKNDFTPEEEEEIRRENQWAFE

SEQ ID NO: 6583 - protein, 1130 aa, Oryza sativa
  UNSURE (1)..(1130): unsure at all Xaa locations
  Clone ID: PAT_MRT4530_101067C.1.pep
  unsure (1)..(1130): unsure at all Xaa locations
MMSSSRPTQCSSSSSRTRQSSRARILAQTTLDAELNAEYEEYGDSFDYSKLVEAQRTTGPEQQARSEKVIAYLHHIQRAKLIQPFGCLLALDEKTFNVIALSENAPEMLTTVSHAVPSVDDPPKLRIGTNVWSLFTDPGATALQKALGFADVSLLNPILVQCKTSGKPFYAIVHRATGCLVVDFEPVKPTEFPATAAGALQSYKLAAKAISKIQSLPGGSMEVLCNTVVKELFDLTGYDRVMAYKFHEDDHGEVFAEITKPGLEPYLGLHYPATDIPQAARFLFMKNKVRMICDCRARSIKIIEDESLHLDISLCGSTLRAPHSCHLQYMENMNSIASLVMAVVVNENEDDDEVGADQPAQQQKRKKLWGLLVCHHESPRYVPFPLRYACEFLAQVFAVHVNKEFELERQVREKSILRMQTMLSDMLLRESSPLSIVSGTPNIMDLVKCDGAALLYGGKVWRLQNAPTESQIRDIAFWLSDVHRDSTGLSTDSLHDAGYPGAAALGDMICGMAVAKINSKDILFWFRSHTAAEIRWGGAKHDPSDKDDSRRMHPRLSFKAFLEVVKMKSLPWNDYEMDAIHSLQLILRGTLNDDIKPTRAASLDNQVGDLKLDGLAELQAVTSEMVRLMETATVPILAVDSNGLVNGWNQKVAELTGLRVDEAIGRHILTVVEESSVPVVQRMLYLALQGKEEKEVKFEVKTHGSKRDDGPVILVVNACASRDLHDHVVGVCFVAQDMTVHKLVMDKFTRVEGDYKAIIHNPSXPLIPPIFGADEFGWCSEWNAAMTKLTGWHRDEVINKMLLGEVFDSTNASCLVKNKDAFVSLCILINSALAGDETEKAPFSFFDRNGKYIECLLSVNRKVNADGVITGVFCFIQVPSHELQHALHVQQASQQNALTKLKAYSYMRHAINNPLSGMLYSRKALKNTGLNEEQMKEVNVADSCHRQLNKILSDLDQDSVMNKSSCLDLEMVEFVLQDVFVAAVSQVLITCQGKGIRVSCNLPERYMKQTVYGDGVRLQQILSDFLFVSVKFSPVGGSVEISCSLTKNSIGENLHLIDLELRIKHQGKGVPADLLSQMYEDDNKEQSDEGMSLAVSRNLLRLMNGDVRHMREAGMSTFILSVELASAPAK

SEQ ID NO: 6584 - protein, 1007 aa, Oryza sativa
  Clone ID: PAT_MRT4530_101087C.1.pep
MQSECGTVKLIWIWWAQLINSVCTLQVNFAYDYRLLPQIFNRAMGPGTAFRKLASKMGGLEEIKNEAVDLENIPIEEVFEQLKCTREGLSSEEGNRRIEMFGPNKLEEKKESKILKFLGFMWNPLSWVMEMAAIMAIALANGGGKPPDWEDFVGIIVLLVINSTISFIEENNAGNAAAALMANLAPKTKVLRDGRWGEQEAAILVPGDIISIKLGDIVPADARLLEGDPLKIDQSALTGESLPVTKNPGDEVFSGSTCKQGEIEAVVIATGVHTFFGKAAHLVDSTNQVGHFQTVLTAIGNFCICSIAVGIVIEIIVMFPIQHRAYRSGIENLLVLLIGGIPIAMPTVLSVTMAIGSHKLSQQGAITKRMTAIEEMAGMDVLCSDKTGTLTLNKLSVDKNLVEVFTKGVDKDHVLLLAARASRTENQDAIDAAMVGMLADPKEARAGIREVHFLAFNPVDKRTALTYIDADGNWHRASKGAPEQILTLCNCREDVKRKVHAVIDKYAERGLRSLAVARQEVPEKSKESAGGPWQFVGLLPLFDPPRHDSAETIRKALHLGVNVKMITGDQLAIGKETGRRLGMGTNMYPSSALLGQNKDASLEALPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFLLIALIWKYDFSPFMVLIIAILNDGTIMTISKDRVKPSPLPDSWKLKEIFATGIVLGSYLALMTVIFFWAMHKTDFFTDKFGVRSIRNSEHEMMSALYLQVSIVSQALIFVTRSRSWSFIERPGLLLVTAFMLAQLVATFLAVYANWGFARIKGIGWGWAGVIWLYSIVFYFPLDIFKFFIRFVLSGRAWDNLLENKIAFTTKKDYGREEREAQWATAQRTLHGLQPPEVASNTLFNDKSSYRELSEIAEQAKRRAEIARLRELNTLKGHVESVVKLKGLDIDTIQQNYTV

SEQ ID NO: 6585 - protein, 462 aa, Oryza sativa
  Clone ID: PAT_MRT4530_101198C.1.pep
MQAHAHTLGLRISPPPPAPPRRRARPRRRAVRVAAAASAPRRETDPRKRVVITGMGLVSVFGNEVDAFYERLLAGESGVGAIDRFDAGGFPTRFAGQIRGFSSEGYIDGKNDRRLDDCLRYCIVSGKKALENAGLGKGSDGHTKLDKVRAGVLVGTGMGGLTVFSDGVQNLIEKGYKKISPFFIPYAITNMYSALLAMDAGFMGPNYSISTACATSNYCFYAAANHIRRGEADVIVAGGTEAAIIPIGLGGFVACRALSQRNDDPETASRPWDKERDGFVMGEGAGVLVMESLEHAMKRDAPIIAEYLGGAVNCDAYHMTDPRSDGLGVSSCINQSLEDAGVAPEEVNYINAHATSTLAGDLAEVRAIKQVFKNPSDIKINSTKSMIGHCLGAAGGLEAIAAVKAITTGWVHPTINQFNPEPEVDFDTVANEKQQHEVNVAISNSFGFGGHNSVVVFAPFKP

SEQ ID NO: 6586 - protein, 1137 aa, Oryza sativa
  Clone ID: PAT_MRT4530_101539C.1.pep
MSSSRSNNRATCSRSSSARSKHSARVVAQTPMDAQLHAEFEGSQRHFDYSSSVGAANRSGATTSNVSAYLQNMQRGRFVQPFGCLLAVHPETFALLAYSENAAEMLDLTPHAVPTIDQREALAVGTDVRTLFRSHSFVALQKAATFGDVNLLNPILVHARTSGKPFYAIMHRIDVGLVIDLEPVNPVDLPVTATGAIKSYKLAARAIARLQSLPSGNLSLLCDVLVREVSELTGYDRVMAYKFHEDEHGEVIAECKRSDLEPYLGLHYPATDIPQASRFLFMKNKVRMICDCSATPVKIIQDDSLTQPISICGSTLRAPHGCHAQYMASMGSVASLVMSVTINEDEDDDGDTGSDQQPKGRKLWGLMVCHHTSPRFVPFPLRYACEFLLQVFGIQINKEVELAAQAKERHILRTQTLLCDMLLRDAPVGIFTQSPNVMDLVKCDGAALYYQNQLWVLGSTPSEAEIKNIVAWLQEYHDGSTGLSTDSLVEAGYPGAAALGDVVCGMAAIKISSKDFIFWFRSHTAKEIKWGGAKHEPIDADDNGRKMHPRSSFKAFLEVVKWRSVPWEDVEMDAIHSLQLILRGSLQDEDANKNNNAKSIVTAPSDDMKKIQGLLELRTVTNEMVRLIETATAPILAVDITGSINGWNNKAAELTGLPVMEAIGKPLVDLVIDDSVEVVKQILNSALQGIEEQNLQIKLKTFNHQENNGPVILMVNACCSRDLSEKVVGVCFVAQDMTGQNIIMDKYTRIQGDYVAIVKNPSELIPPIFMINDLGSCLEWNEAMQKITGIKREDAVDKLLIGEVFTHHEYGCRVKDHGTLTKLSILMNTVISGQDPEKLLFGFFNTDGKYIESLMTATKRTDAEGKITGALCFLHVASPELQHALQVQKMSEQAAMNSFKELTYIRQELRNPLNGMQFTRNLLEPSDLTEEQRKLLASNVLCQEQLKKILHDTDLESIEQCYTEMSTVDFNLEEALNTVLMQAMPQSKEKQISIDRDWPAEVSCMHLCGDNLRLQQVLADFLACMLQFTQPAEGPIVLQVIPRMENIGSGMQIAHLEFRLVHPAPGVPEALIQEMFRHSPGASREGLGLYISQKLVKTMSGTVQYLRESESSSFIVLVEFPVAQLSTKRCKASTSKF

SEQ ID NO: 6587 - protein, 356 aa, Oryza sativa
  Clone ID: PAT_MRT4530_101669C.1.pep
MPRETPPPPPPEGGEVHEVVEGEDGQAEDQEERWARLLPELMSEVVRRVEASGGERWPARKDVVSCACVCRRWRDAAVAVVRPPAESGKITFPSSLKQPGPREFPMQCFIKRNKKNSTFYLYLGLTNATVDKGKFLMAARRFRRGPHTEYIVSLDADDLSQGSNAYMGKLRSDFWGTNFKIYDSKPPYDGAKASSSRSSRRFGSRRISPQVSAGNYEVGQVSYKYNLLKSRGPRRMYCALECPSTQETWENCLKTKFRKPTGNTVLRNKAPRWHEHLQCWCLNFHGRVTVASVKNFQLVAAADPNDPASSKDEETVLLQFGKVDDNIFTMDYRQPLSAFQAFAISLSSFGTKLACE

SEQ ID NO: 6588 - protein, 246 aa, Oryza sativa
  Clone ID: PAT_MRT4530_101732C.1.pep
MGRGKVQLKRIENKINRQVTFSKRRSGLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQVQWDQTQPQTSSSSSSFMMREALPTTNISNYPAAAGERIEDVAAGQPQHVRIGLPPWMLSHING

SEQ ID NO: 6589 - protein, 421 aa, Oryza sativa
  Clone ID: PAT_MRT4530_102034C.1.pep
MQSLLLPTFAAASAAPPRRGRVPPAGRASVSVRASASAAAVAPRRETDPRKRVVITGMGLVSVFGNDVDAYYDRLLAGESGIGPIDRFDASNFPTRFAGQIRGFSSEGYIDGKNDRRLDDCLRYCIVSGKKALESAGLALGSKSMDKIEKTRAGVLVGTGMGGLTVFSDGVQNLIEKGHRKITPFFIPGEADVMIAGGTEAAIIPIGVGGFVACRALSQRNDDPKTASRPWDQDRDGFVMGEGAGVLVMESLEHAMKRDAPIIAEYLGGAVNCDAYHMTDPRSDGLGVSSCIKQSLADAGVAPEEVNYINAHATSTLAGDLAEVNAIRQVFKDPSEIKINATKSMIGHCLGAAGGLEAIATVKAITTGWVHPSINQFNPEPAVEFDTVPNVKKQHEVNVGISNSFGFGGHNSVVVFAPFKP

SEQ ID NO: 6590 - protein, 623 aa, Oryza sativa
  Clone ID: PAT_MRT4530_102156C.1.pep
MLEKKATRSTRVDGVSGEAVIEEFERVTRDAANVQRETLRRILAENGGVEYLRGLGLAGATDPATFRARVPLATHADLEPYIDRIADGDASPVLTAKPATSISLRSVSPPAAACCSLTSIENVADHGGDHLTAGACSSGTTQGKRKYLLFNEELVKSTMQIYRISYAFRNREFPVENGKALQFIYSSRETRTKGGLTATTATTNVYRSEEFKATMRDIQSQCCSPDEVIFGPDFAQSLYCHLLAGLLAAGDVQIVSATFAHSVVLAFQTFERAWEDLCADIRRGEVSPSRVTSPAVRRAMAALLAAPNPGLADEVARKCAALSNWYGVIPALWPNARYVYGIMTGSMEHYVKKLRHYAGGLPLVAAEYGASEGWVGANVEPGTPPERATFTVLPDIAYFEFIPLKPVAGDGGYAEAEPVGLTEVAAGELYEVVMTTFAGLYRYRLGDVVKVAGFYNATPKLKFVCRRNLMLSINIDKNSEQDLQLAVDAAARAVLAGEKLEVVDYTSHADVSSDPGHYVVFLELNAADPAAVDGDVMQACCDELDRAFADAGYVGSRKSGAIAPLELRVLQRGTFQKVLRHYLSLGAPVSQFKSPRCVSRSNSGVLQILAGCTVNVFFSSAYD

SEQ ID NO: 6591 - protein, 467 aa, Oryza sativa
  Clone ID: PAT_MRT4530_102188C.1.pep
MADEKLAKLREAVAGLSQISDNEKSGFISLVARYLSGEEEHVEWAKIHTPTDEVVVPYDTLAAPPEDLEETKKLLNKLAVLKLNGGLGTTMGCTGPKSVIEVRNGFTFLDLIVIQIESLNKKYGSNVPLLLMNSFNTHEDTLKIVEKYTNSNIEVHTFNQSQYPRVVADEFLPWPSKGKTCKDGWYPPGHGDIFPSLMNSGKLDLLLSQGKEYVFIANSDNLGAIVDMKILNHLIHKQNEYCMEVTPKTLADVKGGTLISYEDKVQLLEIAQVPDAHVNEFKSIEKFKIFNTNNLWVNLKAIKRLVEADALKMEIIPNPKEVDGVKVLQLETAAGAAIRFFDHAIGINVPRSRFLPVKATSDLQLVQSDLYTLVDGFVTRNPARTNPSNPSIELGPEFKKVGCFLGRFKSIPSIVELDTLKVSGDVWFGSSITLKGKVTITAQPGVKLEIPDGAVIENKDINGPEDL

SEQ ID NO: 6592 - protein, 494 aa, Oryza sativa
  UNSURE (1)..(494): unsure at all Xaa locations
  Clone ID: PAT_MRT4530_102208C.1.pep
  unsure (1)..(494): unsure at all Xaa locations
KANLLKSKKKKKKKTAKNLRPXXXKKSLSSCQMERAAADRSGAEEGESEWREELRQQQSQVDALRERLVEVKVGMKCSEEDSRKELDHLCRRVKTIATLLAYLKSKARIMAIPHLAHTSCGIRHQDGVGYVDRNGVPLADWSKGGESASCEGLDDETSADSSRVAEHGDANEGDVDVEDILKSIHVVTDVMETLVKRVIVAESEAANEKEKVRMGLEEIRRKTIQVESMSAKVEEMEKFAVGTNGMLNEMRQRVEDMVLETTRQRQRAAENEQELSRVKHDFESLRTYVGTLVNVRETLLSSEKQFETMEKLFDRLVARTNQLESEKAQKEAEVQKVVEENVRLRAMIDKKEAQLQAMSEQCKFMALSQEELQIDVAKQRMVPTAGDLRGHAAQRPTQVVDLVVVKGSRRRLHYYPAGTCTASHTPRPGKTHATPSSSASTRSDLSQSQPWRRLGFGSPPSSSPSSSPPPPSSKLPELSPRKKLLQLKLLMGLI

SEQ ID NO: 6593 - protein, 488 aa, Oryza sativa
  Clone ID: PAT_MRT4530_102369C.1.pep
MGENVVGTYYYPPSAAAMDGVELGHAAAGSKLFDDDGRPRRNGTMWTASAHIITAVIGSGVLSLGWAIAQLGWVAGPAVMVLFSLVTYYTSSLLSDCYRSGDPVTGKRNYTYMDAVNANLSGFKVKICGFLQYANIVGVAIGYTIAASISMLAIGRANCFHRKGHGDPCNVSSVPYMIVFGVAEVFFSQIPDFDQISWLSMLAAVMSFTYSVIGLSLGIVQVVANGGLKGSLTGISIGVVTPMDKVWRSLQAFGDIAFAYSYSLILIEIQDTIRAPPPSESAVMKRATVVSVAVTTVFYMLCGSMGYAAFGDDAPGNLLTGFGFYEPFWLLDIANAAIVVHLVGAYQVFCQPLFAFVEKWAAQRWPESPYITGEVELRLSPSSRRCRVNLFRSTWRTAFVVATTVVSMLLPFFNDVVGFLGALGFWPLTVYFPVEMYVVQKKVPRWSTRWVCLQMLSVGCLVISIAAAAGSIAGVMSDLKVYRPFKGY

SEQ ID NO: 6594 - protein, 109 aa, Oryza sativa
  Clone ID: PAT_MRT4530_102377C.1.pep
MASKLQAFWNHPAGPKTIHFWAPTFKWGISIANVADFAKPPEKISYPQQVAVACTGVIWSRYSMVITPKNWNLFSVNVAMAGTGLYQLSRKIRKDYFSDQKDDVASLEG

SEQ ID NO: 6595 - protein, 109 aa, Oryza sativa; identical to SEQ ID NO: 6594
  Clone ID: PAT_MRT4530_102380C.1.pep

SEQ ID NO: 6596 - protein, 1110 aa, Oryza sativa
  Clone ID: PAT_MRT4530_102471C.1.pep
MDILIPLLLSSIYVSSSAAAAETDAAALLRFKAFVHKDPRGVLSSWVDPGPCRWRGVTCNGDGRVTELDLAAGGLAGRAELAALSGLDTLCRLNLSGNGELHVDAGDLVKLPRALLQLDLSDGGLAGRLPDGFLACYPNLTDVSLARNNLTGELPGMLLASNIRSFDVSGNNMSGDISGVSLPATLAVLDLSGNRFTGAIPPSLSGCAGLTTLNLSYNGLAGAIPEGIGAIAGLEVLDVSWNHLTGAIPPGLGRNACASLRVLRVSSNNISGSIPESLSSCHALRLLDVANNNVSGGIPAAVLGNLTAVESLLLSNNFISGSLPDTIAHCKNLRVADLSSNKISGALPAELCSPGAALEELRLPDNLVAGTIPPGLSNCSRLRVIDFSINYLRGPIPPELGRLRALEKLVMWFNGLDGRIPADLGQCRNLRTLILNNNFIGGDIPVELFNCTGLEWVSLTSNQITGTIRPEFGRLSRLAVLQLANNSLAGEIPRELGNCSSLMWLDLNSNRLTGEIPRRLGRQLGSTPLSGILSGNTLAFVRNVGNSCKGVGGLLEFAGIRPERLLQVPTLKSCDFTRLYSGAAVSGWTRYQTLEYLDLSYNSLDGEIPEELGDMVVLQVLDLARNNLTGEIPASLGRLRNLGVFDVSRNRLQGGIPDSFSNLSFLVQIDISDNNLSGEIPQRGQLSTLPASQYAGNPGLCGMPLEPCGDRLPTATMSGLAAAASTDPPPRRAVATWANGVILAVLVSAGLACAAAIWAVAARARRREVRSAMMLSSLQDGTRTATTWKLGKAEKEALSINVATFQRQLRKLTFTQLIEATNGFSTASLIGSGGFGEVFKATLKDGSCVAIKKLIHLSYQGDREFMAEMETLGKIKHKNLVPLLGYCKIGEERLLVYEFMSHGSLEDTLHGDGGRSASPAMSWEQRKKVARGAARGLCFLHYNCIPHIIHRDMKSSNVLLDGDMEARVADFGMARLISALDTHLSVSTLAGTPGYVPPEYYQSFRCTVKGDVYSFGVVLLELLTGRRPTDKDDFGDTNLVGWVKMKVGDGAGKEVLDPELVVEGADADEMARFMDMALQCVDDFPSKRPNMLQVVAMLRELDAPPPATAI

SEQ ID NO: 6597 - protein, 149 aa, Oryza sativa
  Clone ID: PAT_MRT4530_102501C.1.pep
MLRGFPQARRLLRRMGLEKEDAYFWKQMGKGMLCTYALFGAAWLWNETSPLGWWTLKPRPKEEREMAHLYERRMFPYPGDEEAVEEFIKSGGALGTTIGPKGFADSNMDSDNMQKQLQSKKFDQEAQKLWFRMRNEVVQELQEKGFDVE

SEQ ID NO: 6598 - protein, 137 aa, Oryza sativa
  Clone ID: PAT_MRT4530_102600C.1.pep
MAGKGGKGLLAAKTTAAKSAEKDKGKKAPVSRSSRAGLQFPVGRIHRQLKQRTQANGRVGATAAVYSAAILEYLTAEVLELAGNASKDLKVKRITPRHLQLAIRGDEELDTLIKGTIAGGGVIPHIHKSLINKSSKE

SEQ ID NO: 6599 - protein, 118 aa, Oryza sativa
  Clone ID: PAT_MRT4530_102751C.1.pep
MAGVWVFEDGMVRRADSEAPSRGRGVGGGGGGGKVLVHVPSSEVVTSYEVLERRLRELGWERYLNDPCLLQFHQRSTVHLISVPRDFSRLKLVHMYDVVVKTRNVFEVRDAATTASPP

SEQ ID NO: 6600 - protein, 257 aa, Oryza sativa
  Clone ID: PAT_MRT4530_102917C.1.pep
MAANFWTSSHCKQLLDQEDVDKVPQADSDRGITLEEFRLVKIHMSFHIWRLAQQVKVRQRVIATAVTYFRRVYTRKSMTEYDPRLVAPTCLYLASKVEESTVQARLLVFYIKKMCASDEKYRFEIKDILEMEMKLLEALDYYLVVYHPYRPLLQLLQDAGITDLTQFAWGIVNDTYKMDLILIHPPYMIALACIYIASVLKDKDITLWFEELRVDMNIVKNISMEILDFYDTYKIDPQRGLPEDKIAPVMNKLPSKA

SEQ ID NO: 6601 - protein, 277 aa, Oryza sativa
  Clone ID: PAT_MRT4530_102919C.1.pep
MAANFWTSSHCEGSKQLLDQEDVDKVPQADSDRGITLEEFRLVKIHMSFLLQIKANHLMISDIWRLAQQVKVRQRVIATAVTYFRRVYTRKSMTEYDPRLVAPTCLYLASKVEESTVQARLLVFYIKKMCASDEKYRFEIKDILEMEMKLLEALDYYLVVYHPYRPLLQCFDFRLLQDAGITDLTQFAWGIVNDTYKMDLILIHPPYMIALACIYIASVLKDKDITLWFEELRVDMNIVKNISMEILDFYDTYKIDPQRGLPEDKIAPVMNKLPSKA

SEQ ID NO: 6602 - protein, 66 aa, Oryza sativa
  Clone ID: PAT_MRT4530_102927C.1.pep
IGRYLKKGRYAQRIGTGAPDYLADELEYLAAEVLELAGNAVSDNKKNRIIPRHVLLAIRNDEELCK

SEQ ID NO: 6603 - protein, 795 aa, Oryza sativa
  Clone ID: PAT_MRT4530_102993C.1.pep
MGKFLCPLFISFISVLLCCAASASPWQTTGTGTSLQVDHGETFLVSPDTTFSCGFYPSGDDTNAFYFSIWFTHATDRTVVWTADSGLPVNGHGSKISLSHEGNLAFTDVNGTTVWESKTGWGKHTTVALLNSGNMVMKASDSEDKIVWQSFDWPTDTLLPSQRLTREKRLVSQSGNHFLYFDNDNVLRLQYNGPEITSIYWPSPDYTAVQNGRTRFNSSKIAVLDDEGRFLSSDGFKMVALDSGLGIQRRITIDYDGNLRMYSLNASDGNWTITGEGVLQMCYVHGLCGRNGICEYSPGLRCTCPPGYEMTDPENWSRGCRPTFSVSCGQQREDFTFVKIPHGDYYGFDLTSNKSISLEECMRICMDSCVCLSFTYKGGDGLCYTKGLLYNGQVYPYFPGDNYIKLPKNVASTSLISKHHGLTCKPNASKVMLVSIDAYRKNSDNIMWAYLYVFATIIGAVELVFIMTGWYFLFKMHNIPKSMEKGYKMITSQFRRFTYRELVEATGKFKEELGKGGSGTVYRGILGDKKVVAVKKLTDVRQGEEEFWAEVTLIGRINHINLVRMWGFCSEGRQRLLVYEYVENESLDRYLFDDSGTRNLLSWSQRFKIALGTTRGLAYLHHECLEWVVHCDVKPENILLNRDFEAKIADFGLSKLSKRDSSTFNFTHMRGTMGYMAPEWALNLPINAKVDVYSYGVVLLEIVTGTRVSSGITIEEENIDLMQFVQVVKQMLTSGEVLDTIVDSRLKGHFNCDQAKAMVKAAISCLEERSKRPTMDQIVKDLMVYDDEDYHPAYF

SEQ ID NO: 6604 - protein, 99 aa, Oryza sativa
  UNSURE (1)..(99): unsure at all Xaa locations
  Clone ID: PAT_MRT4530_10588C.1.pep
  unsure (1)..(99): unsure at all Xaa locations
PQQKNQRPAXETXAAASNTRGAATRPPAXSAAKXXXQXNRPKAXRPPSTXNGEXXRXNTARXXPXGRQXKAASRAARSTRXENGDSXEEXQTKATPEKN

SEQ ID NO: 6605 - protein, 162 aa, Oryza sativa
  Clone ID: PAT_MRT4530_1065C.1.pep
MSDSEEHHFESKADAGASKTYPQQAGTIRKNGYIVIKNRPCKVVEVSTSKTGKHGHAKCHFVGIDIFNGKKLEDIVPSSHNCDVPHVDRTDYQLIDISEDGFVSLLTESGNTKDDLRLPTDDTLTNQIKNGFGEEGKDMILTVMSAMGEEQICAVKEIGAKN

SEQ ID NO: 6606 - protein, 467 aa, Oryza sativa
  UNSURE (1)..(467): unsure at all Xaa locations
  Clone ID: PAT_MRT4530_10807C.1.pep
  unsure (1)..(467): unsure at all Xaa locations
MAVHHSLEVAAAGGDGGGGRCYDDDGHPARTGTEWTCXAHVITAVIGSGVLSLAWSVAQLGWLAGPGMMLVFAAVTALQSALFADCYRSPDPEVGPHRNRTYANAVERNLGSSSAWVCLLLQQTALFGYGIAYTITASISCRAILRSNCYHTHGHDAPCKYGGSYYMLMFGAAQLFLSFIPDFHDMAWLSVLAAVMSFSYSFIGLGLGLANTIANGTIKGSITGAPTRTPVQKVWHVSQAIGDIAFAYPYSLILLEIQDTLKAPPAENKTMKKASIISIVVTTFFYLCCGCFGYAAFGSDAPGNLLTGFGFYEPYWLIDFANACIILHLLGGYQVYSQPIYQFADRFFAERYPASRFVNDFHTVKLPLLPPCRVNLLRVCFRTVYVASTTAVALAFPYFNEVLALLGALNFWPLAIYFPVEMYFIQRHVPRWSPRWVVLQSFSVLCLLVSAFALVGSIQGLISQKLG

SEQ ID NO: 6607 - protein, 81 aa, Oryza sativa
  Clone ID: PAT_MRT4530_10972C.1.pep
FEPGELKSWSFYRAGIAEFVATFLFLYITILTVMGVFKFFFKCATVGIQGICWSFGGMIFALVYWTGGIFGGHNNPTVTFG

SEQ ID NO: 6608 - protein, 160 aa, Oryza sativa
  Clone ID: PAT_MRT4530_11027C.1.pep
MSDSEEHHFESKADAGASKTYPQQAGTIRKNGYIVIKNRPCKVVEVSTSKTGKHGHAKCHFVAIDIFTAKKLEDIVPSSHNCDVPHVNRTEYQLIDISEDGFVSLLTENGNTKDDLRLPTDDNLLSQIKDGFGEGKDLVVTVMSAMGEEQICALKDIGPK

SEQ ID NO: 6609 - protein, 294 aa, Oryza sativa
  Clone ID: PAT_MRT4530_11056C.1.pep
MEQYEKEEKIGEGTYGVVYRARDKVTNETIALKKIRLEQEDEGVPSTAIREISLLKEMHHGNIVRLHDVIHSEKRIYLVFEYLDLDLKKFMDSCPEFAKNPTLIKSYLYQILRGVAYCHSHRVLHRDLKPQNLLIDRRTNALKLADFGLARAFGIPVRTFTHEVVTLWYRAPEILLGSRQYSTPVDMWSVGCIFAEMVNQKPLFPGDSEIDELFKIFRVLGTPNEQSWPGVSSLPDYKSAFPKWQAQDLATIVPTLDPAGLDLLSKMLRYEPNKRITARQALEHEYFKDLEMVQ

SEQ ID NO: 6610 - protein, 47 aa, Oryza sativa
  Clone ID: PAT_MRT4530_11109C.1.pep
FSLCWLNFSAALPFVCPNKWCAWLSKCHESMPFYVNFVQVELYLPKF

SEQ ID NO: 6611 - protein, 182 aa, Oryza sativa
  Clone ID: PAT_MRT4530_11190C.1.pep
MELELGLAPPNSGHLVVDELSSSSSSGGGSGSAPVSASSAGKRGFREAFQETLLLFDDGSCCNTSDDDCRRRKKTVVGWPPVSSARRACGGANYVKVKKEGDAIGRKVDLALHSSYDELAATLARMFPTNDHQGEKKMANDDHGDAAGPVVTYEDGDGDWMLVGDVPWDDFARSVKRLKILG

SEQ ID NO: 6612 - protein, 256 aa, Oryza sativa
  Clone ID: PAT_MRT4530_11246C.1.pep
MSREENVYMAKLAEQAERYEEMVEYMEKVAKTVDVEELTVEERNLLSVAYKNVIGARRASWRIVSSIEQKEEGRGNEEHVTLIKEYRGKIEAELSKICDGILKLLDSHLVPSSTAAESKVFYLKMKGDYHRYLAEFKTGAERKEAAESTMVAYKAAQDIALADLAPTHPIRLGLALNFSVFYYEILNSPDKACNLAKQAFDEAISELDTLGEESYKDSTLIMQLLRDNLTLWTSDLTEDGGDEVKEASKGDACEGQ

SEQ ID NO: 6613 - protein, 419 aa, Oryza sativa
  Clone ID: PAT_MRT4530_11349C.1.pep
MENMRSENFNQGVSMEGVKHAPEMANTNRRALRDIKNIIGAPHQHMAVSKRGLLDKPAAKNQSGHRPMTRKFAATLANQPSSAPLAPIGSERQKRTADSAFHGPADMECTKITSDDLPLPMMSEMDEVMGSELKEIEMEDIEEAAPDIDSCDANNSLAVVEYVDEIYSFYRRSEGLSCVSPNYMLSQNDINEKMRGILIDWLIEVHYKLELLDETLFLTVNIIDRFLARENVVRKKLQLVGVTAMLLACKYEEVSVPVVEDLILICDRAYTRTDILEMERMIVNTLQFDMSVPTPYCFMRRFLKAAQSDKKLELMSFFIIELSLVEYEMLKFQPSMLAAAAIYTAQCTINGFKSWNKCCELHTKYSEEQLMECSKMMVELHQKAGHGKLTGVHRKYSTFRYGCPAKSEPAVFLLKSVAL

SEQ ID NO: 6614 - protein, 364 aa, Oryza sativa
  Clone ID: PAT_MRT4530_1149C.1.pep
MGSSCSRSHSLSEAETTKNAKSADIDRRILQETKAEQHIHKLLLLGAGESGKSTIFKQIKLLFQTGFDEAELRSYTSVIHANVYQTIKILYEGAKELSQVESDSSKYVISPDNQEIGEKLSDIDGRLDYPLLNKELVLDVKRLWQDPAIQETYLRGSILQLPDCAQYFMENLDRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 6615 - protein, 270 aa, Oryza sativa
  Clone ID: PAT_MRT4530_11646C.1.pep
MGRPPCCDENGLKKGPWTPEEDEKLMSYIQKHGHASWRVLPELAGLNRCGKSCRLRWTNYLKPDIKRGNFSREEEQTILQLHSILGNKWSAIAKHLPGRTDNEIKNFWNTHLRKKLIKMGIDPMTHCPRTDFFQSLPQLIALANLRQIIERQPWDGHIEGLQTVAVQAAKLEYMQSLLHSAVCHCDQPHHHHHHQQLKHLHHRTGADQPPMPSTGAFFNNIALVSGWITLKLEDGVIPTGNSPVLDHLAGEALEGALGIRDFGSTTASSA

SEQ ID NO: 6616 - protein, 261 aa, Oryza sativa
  Clone ID: PAT_MRT4530_11916C.1.pep
SCVCWNSYIKNYLASTDYDGTVQLWDASSGQGFTQFTEHRKRAWSVSFSEVDPTKLASGSDDCCVKVWSINQKNCTDTIRNVANVCCVQFSPYSSRMLAFGSADYKIYCYDLRNTRIPWCTISGHGKAVSYVRFLDPETLISASTDNTLKIWDLNQTNSSGLSTDACSMTLSGHTNEKNFVGLSVHDGYITCGSENNEVFSYYKTFPMPITSHKFGSIDPITGQETNDDNQQFVSSVCWRGRSNMVVAANSTGSIKVLELV

SEQ ID NO: 6617 - protein, 792 aa, Oryza sativa
  Clone ID: PAT_MRT4530_12732C.1.pep
MVDAMHEYAVGQLKEFEGKKLVSATKEGLKLDESEDEKKRKEELKEKFEGLCKVIKEVLGDKVEKVVVSDRVVDSPCCLVTGEYGWTANMERIMASETETFAFQAEINQLLSLIINTFYSNKEIFLRELISNSSDALDKIRFESLTDKSKLDAQPELFIHIVPDKASNTLSIIDSGIGMTKSDLVNNLGTIARSGTKEFMEALAAGADVSMIGQFGVGFYSAYLVAERVVVTTKHNDDEQYVWESQAGGSFTVTRDTSGEQLGRGTKITLYLKDDQLEYLEERRLKDLIKKHSEFISYPISLWTEKTTEKEISDDEDEEEKKDAEEGKVEDVDEEKEEKEKKKKKIKEVSHEWSLVNKQKPIWMRKPEEITKEEYAAFYKSLTNDWEEHLAVKHFSVEGQLEFKAVLFVPKRAPFDLFDTRKKLNNIKLYVRRVFIMDNCEELIPEWLSFVKGIVDSEDLPLNISREMLQQNKILKVIRKNLVKKCVELFFEIAENKEDYNKFYEAFSKNLKLGIHEDSTNRNKIAELLRYHSTKSGDELTSLKDYVTRMKEGQNDIYYITGESKKAVENSPFLEKLKKKGYEVLYMVDAIDEYAVGQLKEFEGKKLVSATKEGLKLDESEDEKKRKEELKEKFEGLCKVIKEVLGDKVEKVVVSDRVVDSPCCLVTGEYGWTANMERIMKAQALRDSSMAGYMSSKKTMEINPENAIMEELRKRADADKNDKSVKDLVLLLFETALLTSGFSLDDPNTFGSRIHRMLKLGLSIDEDETAEADTDMPPLEDDAGESKMEEVD

SEQ ID NO: 6618 - protein, 488 aa, Oryza sativa
  Clone ID: PAT_MRT4530_12828C.1.pep
MKKLFFFLFLLILAASVVHGEDGAYIGVNIGTAMTSVPAPTQITTLLRSQNIRHVRLYDADPAMLAALANTGIRVIVSVPNEQLLAIGNSNATAANWVARNVAAHYPSVNITAIAVGSEVLSTLPNAAPLLMPAIRYLQNALVAAALDRYIKISTPHSSSIILDSFPPSQAFFNRSLDPVLVPLLKFLQSTGSPLMLNVYPYYDYMRSNGEAVDANTLLHYTNVFDAVVDAAYFAMAYLNVTNVPVMVTETGWPHKGDPSNEPDATSDNADTYNSNLIRHVMNTTGTPKHPGVAVPTYIYELYDEDTRPGSTSEKYWGLFDMNGIPAYTLHLTGSGVLLANDTTNQTYCVAREGADEKMLQAALDWACGPGKVDCSALMQGQPCYDPDNVEAHATYAFNAYYHGMGMGSGTCYFSGVAVITTTDPSHGSCVYAGSGGKNGTSLLNGTSLAPSSNSTAGDSGAHRAIGDVSSFVRAVVAALLLSVVLLL

SEQ ID NO: 6619 - protein, 504 aa, Oryza sativa
  Clone ID: PAT_MRT4530_12829C.1.pep
MKKLFFFLFLLILAASVVHGEDGAYIGVNIGTAMTSVPAPTQITTLLRSQNIRHVRLYDADPAMLAALANTGIRVIVSVPNEQLLAIGNSNATAANWVARNVAAHYPSVNITAIAVGSEVLSTLPNAAPLLMPAIRYLQNALVAAALDRYIKISTPHSSSIILDSFPPSQAFFNRSLDPVLVPLLKFLQSTGSPLMLNVYPYYDYMRSNGVIPLDYALFRPLPPNKEAVDANTLLHYTNVFDAVVDAAYFAMAYLNVTNVPVMVTETGWPHKGDPSNEPDATSDNADTYNSNLIRHVMNTTGTPKHPGVAVPTYIYELYDEDTRPGSTSEKYWGLFDMNGIPAYTLHLTGSGVLLANDTTNQTYCVAREGADEKMLQAALDWACGPGKVDCSALMQGQPCYDPDNVEAHATYAFNAYYHGMGMGSGTCYFSGVAVITTTDPSHGSCVYAGSGGKNGTSLLNGTSLAPSSNSTAGDSGAHRAIGDVSSFVRAVVAALLLSVVLLL

SEQ ID NO: 6620 - protein, 50 aa, Oryza sativa
  Clone ID: PAT_MRT4530_13180C.1.pep
QVPWLVEKSLTKEIKVDGYVPPGMNLTDITKAFDLLHEGACLRCVRATDK

SEQ ID NO: 6621 - protein, 541 aa, Oryza sativa
  Clone ID: PAT_MRT4530_1353C.1.pep
MTLDLSRISGTPWGTSVRLYHLRFRIPRTRSTALPLAPTCPPAASQPHSQSSAASPATAAVRPLRHPEGAEPPRRSAASALFVEHRGIMGWDGDHRPFQAVRHHWFLDASAMAQDLSSSAVWPERNGRIFEHKFKVAEQLVGDIKEILKVKVVDPRYVLINIDGNHFGASLLPSLSLLSSFIEPAIMENTCKRISNTPNSMPVLQGWADLPDDLLQCVLALLSSPSDLAAFIATCPNWHAAFRSAKSTLRTTLFRPLAIRSCASSGDDPVVWELFDPAKPTICIHRVTPPDFLAGMDYECCSYGHAIFSGNAPSLKDTTFAIVDVFTGTSVSPPPCPFFTFVNSCALTAPLDYHNSHFLVEAKHSLFAWRVGSDHWSQCSCPPNSKALEQFVPFKGQLYALEYQQLYTVKLEPQLSLEEVQVVWSVEMSEPDLCEPSLVVCDDMLILLAASIGEAFCLDLSSQPAMWVKMEEEELKEWAFFFDEKREAFRPRPPLSCKNPQRWGGIGYDSYCVSSLAPNQGNRRGLLPNWVKPRMLLSCDH

SEQ ID NO: 6622 - protein, 63 aa, Oryza sativa
  UNSURE (1)..(63): unsure at all Xaa locations
  Clone ID: PAT_MRT4530_13758C.1.pep
  unsure (1)..(63): unsure at all Xaa locations
GFNLPVPKGFASSIYRWGQKNLSLSPDPPVEKKKEVEEPQVXKKESSPLKEEADPSLFYKAHL

SEQ ID NO: 6623 - protein, 353 aa, Oryza sativa
  Clone ID: PAT_MRT4530_13914C.1.pep
MAAAVVANGASGDSSKAAFAEIYSRLKEEMLEDPAFEFTDESLQWIDRMLDYNVLGGKCNRGISVIDSFKMLKGTDVLNKEETFLACTLGWCIEWLQAYFLVLDDIMDNSQTRRGQPCWFRVPQVGLIAVNDGIILRNHISRILQRHFKGKLYYVDLIDLFNEVEFKTASGQLLDLITTHEGEKDLTKYNLTVHRRIVQYKTAYYSFYLPVACALLLSGENLDNFGDVKNILVEMGTYFQVQDDYLDCYGDPEFIGKIGTDIEDYKCSWLVVQALERADENQKHILFENYGKPDPECVAKVKDLYKELNLEAVFHEYERESYNKLIADIEAHPNKAVQNVLKSFLHKIYKRQK

SEQ ID NO: 6624 - protein, 375 aa, Oryza sativa
  Clone ID: PAT_MRT4530_13916C.1.pep
MAAAVVANGASGDSSKAAFAEIYSRLKEEMLEDPAFEFTDESLQWIDRIISLTYECRWIKELRVAQSATKMLDYNVLGGKCNRGISVIDSFKMLKGTDVLNKEETFLACTLGWCIEWLQAYFLVLDDIMDNSQTRRGQPCWFRVPQVGLIAVNDGIILRNHISRILQRHFKGKLYYVDLIDLFNEVEFKTASGQLLDLITTHEGEKDLTKYNLTVHRRIVQYKTAYYSFYLPVACALLLSGENLDNFGDVKNILVEMGTYFQVQDDYLDCYGDPEFIGKIGTDIEDYKCSWLVVQALERADENQKHILFENYGKPDPECVAKVKDLYKELNLEAVFHEYERESYNKLIADIEAHPNKAVQNVLKSFLHKIYKRQK

SEQ ID NO: 6625 - protein, 945 aa, Oryza sativa
  UNSURE (1)..(945): unsure at all Xaa locations
  Clone ID: PAT_MRT4530_1407C.1.pep
  unsure (1)..(945): unsure at all Xaa locations
MRFLLNSRLSSSCLVGWSGTLNSLCSFLLDVRNSLLREPKHGSSVQINYGSGFEEKNKGSEIKKQTGNLDKTVEELSNVYRGAQETNRKLYQELFPIQIMQMCGWLLKVVRWENLNCVHMEAHGNRRSSPTYLVMLWMISVASLLITCRGSIQKQVLFPGFTAAQMDYIDNDGIFLLSNGSVFGFGFVTSNVSDNTFYILAVVHMATTTTVWSANPNSPVTHSDDFFFDKDGNAFLQSGGGSXYGLPISPGXRDCHLYATTGLWQSXVVLGKDASSPLWQSFSHPTDTLLSGQNFIEGMTLMSKSNTVQNMTYTLQIKSGNMMLYAGFETPQPYWSAQQDSRIIVNKNGDSIYPANLSSASWSFYDQSGSLLSQLVIAQENANATLSAVLGSDGLIAFYMLQGGNGKSKFSITVPADSCDMPAYCSPYTICSSGTGCQCPSALGSFANCNPGVTSACKSNEEFPLVQLDSGVGYVGTNFFPPAAKTNLTGCKSACTGNCSCVAVFFDQSSGNCFLFNQIGSLQHKGGNTTRFASFIKVSSRGKGGSDSGSGKHNTIIIVIMLGTLAIIGVLIYIGFWIYKRKRHPPPSQDDAGSSEDDGFLQTISGAPVRFTYRELQDATSNFCNKLGQGGFGSVYLGTLPDGSRIAVKKLEGIGQGKKEFRSEVTIIGSIHHIHLVKLRGFCTEGPHRLLAYEYMANGSLDKWIFHSKEDDHLLDWDTRFNIALGTAKGLAYLHQDCDSKIVHCDIKPENVLLDDNFIAKVSDFGLAKLMTREQSHVFTTLRGTRGYLAPEWLTNYAISEKSDVYSYGMVLLEIIGGRKSYDPSEISEKAHFPSFAFKKLEEGDLQDIFDAKLKYNDKDGRVETAIKVALWCIQDDFYQRPSMSKVVQMLEGVCEVLQPPVSSQIGYRLYANAFKSSSEEGTSSGMSDYNSDALLSAVRLSGPR

SEQ ID NO: 6626 - protein, 495 aa, Oryza sativa
  Clone ID: PAT_MRT4530_14135C.1.pep
MDAVAANGIGEVERKAQRSYWEEHSKDLTVEAMMLDSRAADLDKEERPEVLSVLPSYKGKSVLELGAGIGRFTGELAKEAGHVLALDFIESVIKKNENINGHHKNITFMCADVTSPDLTIEDNSIDLIFSNWLLMYLSDEEVEKLVGRMVKWLKVGGHIFFRESCFHQSGDSKRKVNPTHYREPRFYTKIFKECHSYDKDGGSYELSLETCKCIGAYVKSKKNQNQLCWLWEKVKSTEDRGFQRFLDNVQYKTTGILRYERVFGEGYVSTGGIETTKEFVDKLDLKPGQKVLDVGCGIGGGDFYMAENYDAHVLGIDLSINMVSFAIERAIGRKCSVEFEVADCTTKTYAPNTFDVIYSRDTILHIHDKPALFRSFFKWLKPGGKVLISDYCRNPGKPSEEFAAYIKQRGYDLHDVKTYGKMLEDAGFHHVIAEDRTDQFLRVLQRELAEVEKNKEAFMADFTQEDYDDIVNGWNAKLKRSSAGEQRWGLFIATK

SEQ ID NO: 6627 - protein, 630 aa, Oryza sativa
  Clone ID: PAT_MRT4530_14370C.1.pep
MESGLVASHRLRVPFAAAHHRHHPAAPPHLLRQRRGSVAATPLRLGLHLPTPTPLRLPAALPLRPSLPPLRAAAASAAAPEPVGSASPKFLGVETKTLKKIVPLGLMFFCILFNYTILRDTKDVLVVTAKGSSAEIIPFLKTWVNLPMAIGFMLLYTKLADVLSKEALFYTVIFPFIAFFGAFGYLLYPMRDAIHPTALADRLLAALGPSFLGPVAILRVWSFCLFYVMAELWGSVVISVLFWGFANQITTVEEAKEFYPLFGLGANIALIFSGRTVKYFSNMRQNLGPGVDGWAISLRGMMSIVVLLGLVIAGIYWGVNKFVIDKSAAPVVERKKKDKPKLSMGESLKVLVSSRYVRDLATLVVAYGISINLVEVTWKSKLKAQYPSPNEYSSFMGDFSTATGIATFTMMLLGRVILRKFGWGVAATITPAVLLLTGVGFFSLILFGEPLTPLMATLGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDSQFSPLAKQELEKEKMLKAKTVETTAQVVGSGNGSLQETLASENSANGSAIKVSQEPESTTSEKSGQQSQ

SEQ ID NO: 6628 - protein, 443 aa, Oryza sativa
  Clone ID: PAT_MRT4530_14451C.1.pep
AWSPGWRNAEKMLEEFVSHGLLEYSKHGMKVEGATTSLLSPYLHFGEVSVRKVYQLVRMQQIKWENEGTSEAEESIHFFMRSIGLREYSRYLCFNFPFTHEKSLLGNLKHYPWKVDEERFKSWRQGMTGYPLVDAGMRELWATGWTHNRIRVIISSFAVKFLLIPWTWGMKYFWDVLLDADLESDILGWQYISGSLPDGHELSRLDNPEVQGQKYDPDGVYVRTWIPELARMPTEWIHHPWDAPSCILEVAGVELGFNYPKPIVDLHIARECLDDSISTMWQLDTAEKLAELDGEVVEDNLSNIKTFDIPKVVLRETSPCALPIDQRVPHASSKDHNLKSKVLKASNRSSICVDMIRSSKMEATSSVANSPVSRKRSFCETAFHVPSYSSSAEVHSHIQDHGGSLVGPSRYLLQEAGRNCVDEVEDSSTADSGSSISRQRKAA

SEQ ID NO: 6629 - protein, 178 aa, Oryza sativa
  Clone ID: PAT_MRT4530_14488C.1.pep
IEFDRDDELFATAGVSKRIKVSSFLQSKLSCLSWNKYSKNVIASSDYEGIVTVWDVQTRQSVMEYEEHEKRAWSVDFSRTEPSMLVSGSDDCKVKVWCTKQEASAINIDMKANICSVKYNPGSSHYVAVGSADHHIHYFDLRNPSAPVHVFGGHKKAVSYVKFLSTNELASASTDSTL

SEQ ID NO: 6630 - protein, 685 aa, Oryza sativa
  Clone ID: PAT_MRT4530_14490C.1.pep
MGDSTVAGALVPSVPKQEQAPSGDASTAALAVAGEGEEDAGARASAGGNGEAAADRDLLCPICMAVIKDAFLTACGHSFCYMCIVTHLSHKSDCPCCGNYLTKAQLYPNFLLDKVLKKMSARQIAKTASPIDQFRYALQQGNDMAVKELDSLMTLIAEKKRHMEQQESETNMQILLVFLHCLRKQKLEELNEIQTDLQYIKEDISAVERHRLELYRTKERYSMKLRMLLDEPAASKMWPSPMDKPSGLFPPNSRGPLSTSNPGGLQNKKLDLKGQISHQGFQRRDVLTCSDPPSAPIQSGNVIARKRRVQAQFNELQEYYLQRRRTGAQSRRLEERDIVTINKEGYHAGLEDFQSVLTTFTRYSRLRVIAELRHGDLFHSANIVSSIEFDRDDELFATAGVSKRIKVFEFSTVVNEPSDVHCPVVEMATRSKLSCLSWNKYSKNVIASSDYEGIVTVWDVQTRQSVMEYEEHEKRAWSVDFSRTEPSMLVSGSDDCKVKVWCTKQEASAINIDMKANICSVKYNPGSSHYVAVGSADHHIHYFDLRNPSAPVHVFGGHKKAVSYVKFLSTNELASASTDSTLRLWDVKENCPVRTFRGHKNEKNFVGLSVNNEYIACGSETNEVFVYHKAISKPAANHRFVSSDLDDADDDPGSYFISAVCWKSDSPTMLTANSQGTIKVLVLAP

SEQ ID NO: 6631 - protein, 739 aa, Oryza sativa
  Clone ID: PAT_MRT4530_14565C.1.pep
LLVPLAAIIAIGFSIAQWVGGSKNDGYGDYLIEEEEGLNDHDVVVKCHEIQTAISEGATSFLFTEYQYVGIFMSIFAVVIFLFLGSVEGFSTKSQPCTYSKDKYCKPALFNALFSTASFLLGAITSLVSGYLGMKIATFANARTTLEARKGVGKAFIIAFRSGAVMGFLLASSGLVVLYIAINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSVGIIVCLITTLFATDFFEIKAVKEIEPALKKQLIISTALMTVGIAIISWLALPAKFTIFNFGAQKEVTNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNSIPGLMEGTGKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATHGGLLFKWF

SEQ ID NO: 6632 - protein, 721 aa, Oryza sativa
  UNSURE (1)..(721): unsure at all Xaa locations
  Clone ID: PAT_MRT4530_14624C.1.pep
  unsure (1)..(721): unsure at all Xaa locations
MSASPSSMXSGAGAGEAGVRTVVWFRRDLRVEDNPALAAAARAAGEVXVPVYVWAPEEDGPYYPGRVSRWWLSQSLKHLDASLRRLGASRLVTRRSADAVVALIELVRSIGATHLFFNHLYGSIDPEFQIDPLSLVRDHRVKALLTAEGIAVQSFNADLLYEPWEVVDDDGCPFTMFAPFWDRCLCMPDPAAPLLPPKRIAPGELPARRCPSDELVFEDESERGSNALLARAWSPGWQNADKALAAFLNGPLMDYSVNRKKADSASTSLLSPYLHFGELSVRKVFHQVRMKQLMWSNEGNHAGDESCVLFLRSIGLREYSRYLTFNHPCSLEKPLLAHLRFFPWVVDEVYFKVWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPESVLQAAGIELGSNYPLPIVELDAAKTRLQDALSEMWELEAASRAAMENGMEEGLGDSSDVPPIAFPPELQMEVDRAPAQPTVHGPTTAGRRREDQMVPSMTSSLVRAETELSADFDNSMDSRPEVPSQVLFQPRMEREETVDGGGGGGMVGRSNGGGHQGQHQQQQHNFQTTIHRARGVAPSTSEASSNWTGREGGVVPVWSPPAASGPSDHYAADEADITSRSYLDRHPQSHTLMNWSQLSQSL

SEQ ID NO: 6633 - protein, 200 aa, Oryza sativa
  UNSURE (1)..(200): unsure at all Xaa locations
  Clone ID: PAT_MRT4530_14668C.1.pep
  unsure (1)..(200): unsure at all Xaa locations
MARVYVGNLDPRVTAREIEDEFRVFGVLRSVWVARKPPGFAFIDFDDRRDAEDAIRDLDGKNGWRVELSTKAGSGRGRDRSGGSDMKCYECGEPGHFARECRLRIGSGGLGSGRRRSRSRSRSPRYRGRSRSRSPRYRRSPSYGRRPTGSFSXRRSYSRSPPPARARSYSRSPPPPRERSYSRSPAQPANREESPYANNA

SEQ ID NO: 6634 - protein, 386 aa, Oryza sativa
  Clone ID: PAT_MRT4530_14815C.1.pep
MELDSLREAFDRVIEKRASSSAKAQEVIDQIVSEVEQAITKMQMMNTDSMGTADHSSILAELKAKLNELAPLNQLEGCQKELNVALSKYLKLLEKSFSPDISKAYRNVDFEASTINSIIANHFYRQGLFDLGDSFVRECGESDGAHLKLQFQEMYSILEAMQVRNLQPALSWAAKNHDQLLQNGSMLELKLHQLQFVEILTKGSRDEALKYARTHLVPFASLHKAEIQKLMACLLWADRLDQSPYAEFMSSTHWEKLAEELTHQFCSLLGQSSESPLGVAVSAGFQGLPTLLKLTTVMAAKKQEWQAMKQLPVPIDIGPEFQYHSVFVCPVLREQSSDENPPMLMPCGHVVSKQSIMKLSKSSSRPFKCPYCPSEAVASQCKQLHF

SEQ ID NO: 6635 - protein, 159 aa, Oryza sativa
  Clone ID: PAT_MRT4530_14868C.1.pep
MDAAGAGAGGKLKKGAAGRKAGGPRKKAVSRSVKAGLQFPVGRIGRYLKKGRYAQRIGTGAPVYLAAVLEYLAAEVLELAGNAARDNKKNRIIPRHVLLAIRNDEELGKLLAGVTIAHGGVLPNINPVLLPKKTAEKAAAAGKEAKSPKKAAGKSPKKA

SEQ ID NO: 6636 - protein, 163 aa, Oryza sativa
  Clone ID: PAT_MRT4530_14871C.1.pep
MEVGAKVPKKAGAGGRRGGGGPKKKPVSRSVKAGLQFPVGRIGRYLKQGRYSQRIGTGAPVYLAAVLEYLAAEVLELAGNAARDNKKNRIIPRHVLLAIRNDEELGKLLAGVTIAHGGVLPNINPVLLPKKTGSAAAKEAKEGKTPKSPKKATTKSPKKAAAA

SEQ ID NO: 6637 - protein, 451 aa, Oryza sativa
  Clone ID: PAT_MRT4530_14919C.1.pep
MEFVANGKVILFLLFVSTSVLIVSPASPPRFHYINPHNFTTPASSSSSASASAVHRSRNNNNPSLSLVHRDAISGATYPSRRHQVVGLVARDNARVEHLEKRLVASTSPYLPEDLVSEVVPGVDDGSGEYFVRVGVGSPPTDQYLVVDSGSDVIWVQCRPCEQCYAQTDPLFDPAASSSFSGVSCGSAICRTLSGTGCGGGGDAGKCDYSVTYGDGSYTKGELALETLTLGGTAVQGVAIGCGHRNSGLFVGAAGLLGLGWGAMSLVGQLGGAAGGVFSYCLASRGAGGAGSLASSFYYVGLTGIGVGGERLPLQDSLFQLTEDGAGGVVMDTGTAVTRLPREAYAALRGAFDGAMGALPRSPAVSLLDTCYDLSGYASVRVPTVSFYFDQGAVLTLPARNLLVEVGGAVFCLAFAPSSSGISILGNIQQEGIQITVDSANGYVGFGPNTC

SEQ ID NO: 6638 - protein, 473 aa, Oryza sativa
  Clone ID: PAT_MRT4530_14922C.1.pep
MEFVANGKVILFLLFVSTSVLIVSPASPPRFHYINPHNFTTPASSSSSASASAVHRSRNNNNPSLSLVHRDAISGATYPSRRHQVVGLVARDNARVEHLEKRLVASTSPYLPEDLVSEVVPGVDDGSGEYFVRVGVGSPPTDQYLVVDSGSDVIWVQCRPCEQCYAQTDPLFDPAASSSFSGVSCGSAICRTLSGTGCGGGGDAGKCDYSVTYGDGSYTKGELALETLTLGGTAVQGVAIGCGHRNSGLFVGAAGLLGLGWGAMSLVGQLGGAAGGVFSYCLASRGAGGAGSLVLGRTEAVPVGAVWVPLVRNNQASSFYYVGLTGIGVGGERLPLQDGLFQLTEDGAGGVVMDTGTAVTRLPREAYAALRGAFDGAMGALPRSPAVSLLDTCYDLSGYASVRVPTVSFYFDQGAVLTLPARNLLVEVGGAVFCLAFAPSSSGISILGNIQQEGIQITVDSANGYVGFGPNTC

SEQ ID NO: 6639 - protein, 868 aa, Oryza sativa
  UNSURE (1)..(868): unsure at all Xaa locations
  Clone ID: PAT_MRT4530_15007C.1.pep
  unsure (1)..(868): unsure at all Xaa locations
MAGAGAVGGSNWEEMVRRMLPPGTTIPEAPANLDYSIALEYDGPPVSYELPRIDPVDLPAIPTAQPVSGPLVPGRSNGVVAPVVRPVFMPPVHRKQDAHRAEPPPVAAQGRRRRSSESVDSAPQNEGFSDDDDSCSVSQESAHNFHGQRGGRTAAQEGRRAQVVTFGVTEDSRYESKEFDDVSEQYVAVTKKEKRGRTCSRCGKRKWESKESCIVCDARFCSYCVLRAMGSMPEGRKCITCIGQPIDESKRSKLGKGSRILSRLLSPLEVRQILKAEKECQANQLRPEQLIINGFPLNPDEMASLLSCQRPPQKLKPGRYWYDKESGLWGKEGEKPDRVVSTNLTFNGKLQPNASNGNTQVYMNGREITKIELRVLKIAQVQCPRDTHFWVYHDGGYEEEGQNNIKGKIWESPVTRFACALFSLPVPPANSDEPKDEAPYSARTVPDYLDQKRIQKLLILGSPGAGTSTIFKQAKLLYDTRFTQEELDSIKLMIQSNMFKYLGILLEGRERFEEEALAGSNNPSSEDENTQHDGNKSNGSDSCIYSINAKLKKFSDWLLDIIAMGDLDAFFPAATREYAPIVEEMWKDPAIQATYKRKDELHFLPDVAEYFLSRAIEVSSNEYEPSEKDIIYAEGVTQGNGLAFIEFTLDDRSPMSEMYTDNHEPHSQTLNKYQLIRVSAKGMNEGCKWVEMFEDVSMVIFSVALSDYDQLGAPSSGGNSPLVNKMIQSRDLFEATIRQPCFRDMPFVLVLNKFDLFEEKIGRVPLSTCEWFSDFCPLRTHHNNQSLAXQAFYYVAMKXFKALYAACTDRNLFVCQARARDRLTVDEAFKFIREVLKWEDEKDGGGYYPDESFYSTTELSSSRLIRQE

SEQ ID NO: 6640 - protein, 751 aa, Oryza sativa
  Clone ID: PAT_MRT4530_15014C.1.pep
MGGERPPPISGGGAFAFISKGWREVRDSASADLRQMRARADRELEHLLASASALAGPPLPPVAAGAPIAEVEFVRKRIQPKIMELRRQYSSTVRDAGWAPKAAGASLRVDLSGITAIRNAIVAEGGGGGGGGGRWGLVRWKGHADDEGRKEWEVVRMIRSGLKEFERRSLSSEVFGGFRGRGEFVEKFKLSLKSLNKESQESKEVLPLDLTEILAYLVRQSGPFLDQLGIRRDLCDKIVETLYSKHNGRLIYHSLSADRSLIGNENMTDELDLRIARVLESTGHHTEESFWKDHAKYKLSDNRRHVAIVTTASLPWMTGTAINPLFRAAYLARSTKQKFTRRTENYIRNWLQERLGFEANFKISFYPGKFSKERRSIIPAGDTSQFISSSEADIAILEEPEHLNWYHHGKRWTDKFKHVIGVVHTNYLEYIKREKNGALQAFLVKHINNWVTRAYCHKVLRLSAATQDLPRSVVCNVHGVNPKFLKVGEKIAADKEHGQQSFTKGAYFLGKMVWAKGYRELIDLLSKHKSDLEGFNVDVYGNGEDSQAVQMAARKLNLSLNFFKGRDHADSSLHGYKVFINPSVSDVLCTATAEALAMGKFVICADHPSNEFFKSFPNCLTYKTSEEFVARVKEAMASEPSPLTPEQRYSLSWEAATERFMEYSELDKVLNNKIGYSGQDGKRSKVRKIPLLPRLSEVVDGGLAFAHHCLTGNEILRLATGAIPGTRDYDKQQCMDLNLLPPQVQHPVYGW

SEQ ID NO: 6641 - protein, 775 aa, Oryza sativa
  Clone ID: PAT_MRT4530_15016C.1.pep
MGGERPPPISGGGAFAFISKGWREVRDSASADLRQMRARADRELEHLLASASALAGPPLPPVAAGAPIAEVEFVRKRIQPKIMELRRQYSSTVRDAGWAPKAAGASLRVDLSGITAIRNAIVAEGGGGGGGGGRWGLVRWKGHADDEGRKEWEVVRMIRSGLKEFERRSLSSEVFGGFRGRGEFVEKFKLSLKSLNKESQESKEVLPLDLTEILAYLVRQSGPFLDQLGIRRDLCDKIVETLYSKHNGRLIYHSLSADRSLIGNENMTDELDLRIARVLESTGHHTEESFWKDHAKYKLSDNRRHVAIVTTASLPWMTGTAINPLFRAAYLARSTKQKVTLVVPWLCKSDQELVYPNNITFSSPEEQENYIRNWLQERLGFEANFKISFYPGKFSKERRSIIPAGDTSQFISSSEADIAILEEPEHLNWYHHGKRWTDKFKHVIGVVHTNYLEYIKREKNGALQAFLVKHINNWVTRAYCHKVLRLSAATQDLPRSVVCNVHGVNPKFLKVGEKIAADKEHGQQSFTKGAYFLGKMVWAKGYRELIDLLSKHKSDLEGFNVDVYGNGEDSQAVQMAARKLNLSLNFFKGRDHADSSLHGYKVFINPSVSDVLCTATAEALAMGKFVICADHPSNEFFKSFPNCLTYKTSEEFVARVKEAMASEPSPLTPEQRYSLSWEAATERFMEYSELDKVLNNKIGYSGQDGKRSKVRKIPLLPRLSEVVDGGLAFAHHCLTGNEILRLATGAIPGTRDYDKQQCMDLNLLPPQVQHPVYGW

SEQ ID NO: 6642 - protein, 753 aa, Oryza sativa
  Clone ID: PAT_MRT4530_15145C.1.pep
MATTSTLHQAVAYLLAVMLVCLAPVTPASAQPWPGCPDKCGNISISYPFGIGAGCARDKDFQLECDGNTPHFNYLDDREKKLVSLSIADGEVRVFVDAGSNCHDDRFKAISGHYRTPDYGRSIAYRFSTARNRLVVLGCPVLGYLVDADDNYTYVTGCTSTCRRSQSQGDLPGQCTGESGCCQNTMPRALNVYKPYILTLNKTEEPTRNVPDQQELPPTEPVFRHLDSTKCQYVFVAEDKWINTTYSYRAFINRTSDFTVPVVLDWAIRNAGNCDIAVRNRTDYACRSAHSECFNASDGQGYRCRCSKGYEGNPYLDGGCKDIDECQRTKEYPCFGKCTNTIGSYTCECRPGTSGNATQENGCLPTDKFTLALKVVTGVSVRKLIRTKQRFFEQNGGVLLQQQMSSYGGTSGGAGGFKIFSKEELEKATNSFAADRVLGRGGYGIVYKGVLEDNMVVAIKKSKMIEEAQTKEFAKEMCILSQINHKNVVKLLGCCLEVEVPMLVYEFVSNGTLDHYIHGSTLNTVISLDSRLRIAAESAEALSYMHSSASPPILHGDVKTANILLDDKLTAKVSDFGTSKLVPNDEFEIATLVQGTCGYLDPEYLMTCQLTNKSDVYSFGVVLLELLTRKKALYFGGSEEDRSLVSCFMTAVRDGRHEELIDSQVRNEMTEEVLQEITHLVMRCVSMSGEERPMMKEVAEKLEMLRRYQLHPWDKGDANPEEKQSLLDMEQRNVDQKFRHHHDYDPENPACRS

SEQ ID NO: 6643 - protein, 482 aa, Oryza sativa
  Clone ID: PAT_MRT4530_1519C.1.pep
MAAAANGAACCGGATGPGYATPLEAMEKGPREKLLYVTCVYNGTGINKPDYLGTVDVDPNSPTYSQVIHRLPVTHVGDELHHSGWNACSSCHGDPSASRRFLILPSLLSGRVYVVDTLKDPRAPALHKVVEAEDIAEKTGLGFPHTSHCLASGEIMISCLGDKEGNAAGNGFLLLDSEFNVKGRWEKPGHSPLFGYDYWYQPRHKTMISSSWGAPAAFRTGFDLQHVQDGLYGRHLHVYDWPGGELKQTLDLGSTGLLPLEVRFLHDPSKDTGYVGCALTSNMVRFFKTADGSWSHEVAISIKPLKVRNWILPEMPGLITDFVISLDDRYLYLVNWLHGDIRQYNIEDPAKPVLAGQVWAGGLLQKGSEVVYVTEDDKEEQYSVPQVKGHRLRGGPQMIQLSLDGKRIYVTNSLFSRWDEQFYGQDLVKKGSHMLQIDVDTEKGGLSINPNFFVDFGAEPEGPSLAHEMRYPGGDCTSDIWI

SEQ ID NO: 6644 - protein, 640 aa, Oryza sativa
  UNSURE (1)..(640): unsure at all Xaa locations
  Clone ID: PAT_MRT4530_15363C.1.pep
  unsure (1)..(640): unsure at all Xaa locations
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENFKCYLRKEPIGVVGLITPWYFTFFSHPALIFIYDPSMALMNYPLLMATWKVAPALAAGCTAVLKPSELASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCRLGPVVSEGQYEKIKQFVSTAKSQGATILTGGVRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSVPEINXRRSIPAIIWVNCCATLLLPSSMGAGTSDSGFGRELEEGAIDNYLSVKQVTEYASDEPWGWYKSPNYSQSLGELKILRSSWLVASFSESGKAGFSSFWLLVHFLDFTTTASQNLDQKLDCLGELLIMGEAAAARSSPNRPFVSLYQQPW

SEQ ID NO: 6645 - protein, 380 aa, Oryza sativa
  Clone ID: PAT_MRT4530_15416C.1.pep
MASVAELKEKHAAATASVNSLRERLRQRRQMLLDTDVERYSRTQGRTPVSFNPTDLVCCRTLQGHSGKVYSLDWTPEKNWIVSASQDGRLIVWNALTSQKTHAIKLHCPWVMTCAFAPNGQSVACGGLDSACSIFNLNSQADRDGNIPVSRILTGHKGYVSSCQYVPDQETRLITSSGDQTCVLWDVTTGQRISIFGGEFPSGHTADVLSLSINSSNSNMFVSGSCDATVRLWDIRIASRAVRTYHGHEGDINSVKFFPDGQRFGTGSDDGTCRLFDVRTGHQLQVYSREPDRNDNELPTVTSIAFSISGRLLFAGYSNGDCYVWDTLLAEVVLNLGNLQNSHEGRISCLGLSSDGSALCTGSWDKNLKIWAFSGHRKIV

SEQ ID NO: 6646 - protein, 851 aa, Oryza sativa
  Clone ID: PAT_MRT4530_15551C.1.pep
MASRRQWGAGAGAVDVPAQERKGEAAKIARRPKTTTVVAQQPPRIRRALADVSNLVNGRAALPVVNRQKAAAAAADKCRKPIKQRNENNKAAKPEVIVISSDSEKHKKNPAQRAASRRAPIQTLTSILTKCSRASDGVISPKKELIYDIDASDSHNELAVVDYVEDIYRFYRNTENTYRPLCTYMVSQTEINERMRAILTDWLIEVHYRLMLMPETLYLTVYIIDQYLSLENVPRKELQLVGVSAMLIACKYEETWAPLLALASCLTVELPFLQVKDFLVISDNSFSRQQVLSTEKSILNKLQWNLTVPTMYMFILRYLKAALGDEELEHMTFFYAELALVQYSMLFFAPSVIAAAAVYAARCTLGLSPLWSDLLEYHTGLAEPQLLECARRLVSLHAAAPESRQKVVYKKFVFFSSWFVVVVMGIYKRPFFLVSACRFVFFSSWFVVVMACTMSSMACHSLPESGSNLSAADELFQNQRSEQGIYWTLWDSRLSDDLNTTTVYSDNHGSNGGGTQSFDTSEHCSTVPSDSDEQPGYPSQFEPLHMEQTNDMFLSQFSDEEVRRMDAPFQALDMFPDSMHRLMSYEHILNGALVSDSKNQEVNMDQDDMDTCGFPLYFSHGLQDDGGLPSFAKGMVAADTSSMDKTNRYIWVFANAGASATERGDPGSSPPGFEEAVLEELEEVMVQMARTTRICLRDAFYRLAEGSRSPRSAAAAADGATVAEATRYHAQAAVDLSRSLLEILQLVILMLSVSSSPLAAANPLQCVDDAAAPSPRRDRQDGGEPHLQAAAVLAGSRGGDDAAHACLRRPSSPSPDHRRTGGDSLGFSFQCDLARRIASSLACLTKDTLCM

SEQ ID NO: 6647 - protein, 297 aa, Oryza sativa
  Clone ID: PAT_MRT4530_1576C.1.pep
GRVGGRVGGRVGGRVGARAAAVADLALAAGHRAAARRRRRTPYWGGEGFGEMPPKRQRSAAGPSGEAPVNSLDDGCLMHIFSFLSPIPDRYNTALVCHRWRFLACHPRLWLRVERPIRNTIEPGVYPNLESAVSAARPGDTILIAAGGTHVARNIQIKKPLCIIGGGELPDDTVLTCSRGSDNALEFHSTCKIANLTIRTELGCCLLHRSGRLTIEECLLQCEQNPLDYLSFPIISTAIEYDSFSSLKEQGHGVTVVRTRIEGGAKAVRTNGTLALQHVRAIYSRSSVFFWFEVGER

SEQ ID NO: 6648 - protein, 538 aa, Oryza sativa
  Clone ID: PAT_MRT4530_15828C.1.pep
MARGSGAGGGGGGGGGGLELSVGVGGGGGARGGGGGEAAAAVETAAPISLGRLILSGMVAGGVQYGWALQLSLLTPYVQTLGLSHALTSFMWLCGPIAGMVVQPCVGLYSDRCTSKWGRRRPYILTGCVLICLAVVVIGFSADIGYAMGDTKEDCSVYHGSRWHAAIVYVLGFWLLDFSNNTVQGPARALMADLSGRHGPGTANSIFCSWMAMGNILGYSSGSTNNWHKWFPFLKTRACCEACANLKGAFLVAVIFLSLCLVITLIFAKEVPFKGNAALPTKSNEPAEPEGTGPLAVLKGFRNLPTGMPSVLIVTGLTWLSWFPFILYDTDWMGREIYHGDPKGTDPQIEAFNQGVRAGAFGLLLNSIVLGFSSFLIEPMCRKVGPRVVWVTSNFLVCIAMAATALISFWSLKDFHGTVQKAITADKSIKAVCLVLFAFLGVPLAVLYSVPFAVTAQLAATRGGGQGLCTGVLNISIVIPQVVIALGAGPWDELFGKGNIPAFGLASGFALIGGVAGIFLLPKISKRQFRSVSMGGGH

SEQ ID NO: 6649 - protein, 335 aa, Oryza sativa
  Clone ID: PAT_MRT4530_15830C.1.pep
MGCLLMLCLVSPLLLATSVHGNPWYGYGYGLFPQFYDHSCPKAKEIVQSIVAQAVARETRMAASLVRLHFHDCFVKGCDASVLLDNSTTIISEKGSNPNMNSLRGFEVVDEIKAALEAACPGTVSCADILALAARDSTVLVGGPYWDVPLGRRDSLGASIQGSNNDIPAPNNTLPTIITKFKRQGLNIVDVVALSGGHTIGMSRCTSFRQRLYNQSGNGMADYTLDVSYAAQLRQGCPRSGGDNNLFPLDFVSPAKFDNFYFKNILSGKGLLSSDQVLLTKSAETAALVKAYADDVNLFFKHFAQSMVNMGNISPLTGSQGEIRKNCRRLNNYYH

SEQ ID NO: 6650 - protein, 642 aa, Oryza sativa
  Clone ID: PAT_MRT4530_16044C.1.pep
MESLALLHAKPGGLPPRAGLRLPLPRARSARVSLPSSPAAPVSLQSPLLLASRSGPTSRDAVVGLGLGCGLLRRRSGASGGGGGGVSCGAQPAAAAAAGAVPAAQPEGKKFLGVEVKTLKKIVPLGLMFFCILFNYTILRDTKDVLVVTAKGSSAEIIPFLKTWVNLPMAIGFMLLYTKLSNVLSREALFYTVIFPFIAFFGAFAFVLYPLRNVIHPTALADKLLAALGPSFLGPVAILRIWSFCLFYVMAELWGSVVISVLFWGFANQITTVEEAKEFYPLFGLGANIALIFSGRTVKYFSNLRKTLGPGIDGWEVSLKGMMSLVVLLGLVITSIYWGVNKFVLNDPSLPKSDRKKKKDKPKLGMKESLKVLLSSRYVRDLATLVVAYGISINLVEVTWKSKLKAQFPSPNEYSSFMGDFSTATGIATFTMMLLGRIILRKFGWGVAAMITPTVLLLTGVGFFSLILFGQPLTPMLATMGMTPLLAAVYVGALQNIFSKSAKYSLFDPCKEMAYIPLDEDMKVKGKAAIDVVCNPLGKSGGALIQQFMILTFGSLANSTPYLGGILLVIVLAWLGAASSLDKQFSSLAKEDLKRDMSAKEKVDPSLLKAPEADVLVEHTNGTIESEATATESSPSNSSPSN

SEQ ID NO: 6651 - protein, 52 aa, Oryza sativa
  UNSURE (1)..(52): unsure at all Xaa locations
  Clone ID: PAT_MRT4530_16153C.1.pep
  unsure (1)..(52): unsure at all Xaa locations
SSIYRSVQKSLDMSPYTPVEEEQEVQQSEVQEXALSNIKNKSELSSYDKSKL

SEQ ID NO: 6652 - protein, 199 aa, Oryza sativa
  Clone ID: PAT_MRT4530_16438C.1.pep
MGDSTPRRRPGLRLASTPLLSASSSSPPLLLFFFFFLVDRFVRSDRFFGEMEQSFIMIKPDGVQRGLIGDIISRFEKKGFYLRGMKFMNVERSFAQQHYADLSDKPFFPGLVEYIISGPVVAMVWEGKDVVATGRRIIGATRPWEAAPGTIRADYAVEVGRNVIHGSDSVDNGKKEIALWFPEGLAEWRSNLHPWIYES

SEQ ID NO: 6653 - protein, 265 aa, Oryza sativa
  UNSURE (1)..(265): unsure at all Xaa locations
  Clone ID: PAT_MRT4530_16528C.1.pep
  unsure (1)..(265): unsure at all Xaa locations
MAPSDDLVYMAKLAEQAERYDEMVEAMNSVAKLDEGLTKEERNLLSVGYKNLIGAKRAAMRIIGSIELKEETKGKESHVRQTAEYRRKVEAEMDKICCDVINIIDKYLIPHSSGAESSVFYYKMKGDYYRYLAEFKTGTEKIEVSELSLNAYETASKTAQTDLTPTDPIRLGLALNISVFYCEIMNSPDKACQLAKNAFDEAVAELPSLSEENYKDSTLIMQLLRDNLALWNSDMADDADDIRERTDTTGAKGDPAAXDGGANSW

SEQ ID NO: 6654 - protein, 110 aa, Oryza sativa
  Clone ID: PAT_MRT4530_17049C.1.pep
HGEGPAHHFFGPTEGKGAEKIKPPRVNSRPHLSAFHWAGPETFGKNRNPPHAEEDKFFPTQIDHPGAGDVRGGRRRRRGPWDEGPQPKRGGFFSPGGSSALLGPFFFSGG

SEQ ID NO: 6655 - protein, 1039 aa, Oryza sativa
  Clone ID: PAT_MRT4530_17346C.1.pep
MDVDSRMTTESDSDSDAAATAAASASVAAQGGLASETSSSSSASAPSTPGTPTVAPAPAAAGATGPRPAPGYTAVSAVIEKKEDGPGCRCGHTLTAVPAVGEEGTPGYIGPRLILFGGATALEGNSATPPSSAGSAGIRLAGATADVHCYDVLSNKWSRLTPQGEPPSPRAAHVATAVGTMVVIQGGIGPAGLSAEDLHVLDLTQQRPRWHRVVVQGPGPGPRYGHVMALVGQRFLLTIGGNDGKRPLADVWALDTAAKPYEWRKLEPEGEGPPPCMYATASARSDGLLLLCGGRDANSVPLASAYGLAKHRDGRWEWAIAPGVSPSPRYQHAAVFVNARLHVSGGALGGGRMVEDSSSVAVLDTAAGVWCDTKSVVTTPRIGRYSADAAGGDAAVELTRRCRHAAAAVGDQIFIYGGLRGGVLLDDLLVAEDLAAAETTTAANHAAASAAATNVQSGRTPGRYAYNDERARQTAPESAQDGSVVLGTPVAPPVNGDMYTDISPENAVLQGQRRLSKGVDYLVEASAAEAEAISATLAAVKARQVNGEMEQLPDKEQSPDSASTSKHSSLIKPDSILSNNMTPPPGVRLHHRAVVVAAETGGALGGMVRQLSIDQFENEGRRVSYGTPENATAARKLLDRQMSINSVPKKVIASLLKPRGWKPPVRRQFFLDCNEIADLCDSAERIFSSEPSVLQLKAPVKIFGDLHGQFGDLMRLFDEYGAPSTAGDIAYIDYLFLGDYVDRGQHSLETMTLLLALKVEYPQNVHLIRGNHEAADINALFGFRIECIERMGERDGIWTWHRMNRLFNWLPLAALIEKKIICMHGGIGRSINHVEQIENLQRPITMEAGSVVLMDLLWSDPTENDSVEGLRPNARGPGLVTFGPDRVMEFCNNNDLQLIVRAHECVMDGFERFAQGHLITLFSATNYCGTANNAGAILVLGRDLVVVPKLIHPLPPAITSPETSPEHHIEDTWMQSKVICVCETVAHSHAKSVQANDIGLDIVEATLLILMGYLTRFIEGVHMIAPFLCEKAHDLKQLL

SEQ ID NO: 6656 - protein, 389 aa, Oryza sativa
  Clone ID: PAT_MRT4530_17523C.1.pep
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVQRAPISNLTGVQGAVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 6657 - protein, 126 aa, Oryza sativa
  Clone ID: PAT_MRT4530_17623C.1.pep
MSAMETDINAPPPPAPAPAGAGEGSSSAAGPSSRKPNKRFEIKKWNAVALWAWDIVVDNCAICRNHIMDLCIECQANQASATSEECTVAWGVCNHAFHFHCISRWLKTRQVCPLDNSEVGFQVYGH

SEQ ID NO: 6658 - protein, 492 aa, Oryza sativa
  Clone ID: PAT_MRT4530_18010C.1.pep
MVLSHGVSGSDESVHSTFASRYVRTSLPRFRMPEQSIPKEAAYQIINDELMLDGNPRLNLASFVTTWMEPECDKLIQASVNKNYVDMDEYPVTTELQNRCVNMIAHLFNAPLGDSETAVGVGTVGSSEAIMLAGLAFKRRWQNKMKAAGKPCDKPNIVTGANVQVCWEKFARYFEVELKEVKLSDGYYVMDPAKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRSKEDLPEELIFHINYLGADQPTFTLNFSKGSSQVIAQYYQLIRLGFEGYKNIMENCQENAMVLKQGLEKTGRFNIVSKDNGVPLVAFSLKDSARHNEFEISDFLRRFGWIVPAYTMPPDAQHVTVLRVVIREDFSRTLAERLVLDVEKVLHELDALPARVVANGGDAAAASASEREMEKQREVISLWKRAVLAKKKTNGVC

SEQ ID NO: 6659 - protein, 161 aa, Oryza sativa
  Clone ID: PAT_MRT4530_18379C.1.pep
MTSSSSPSRKVLSKIACNRLQKELAEWQVNPPSGFKHKVTDNLQRWVIEVAGAAGTLYAGETYQLQVDFPEHYPMEAPQVIFLHPAPMHPHIYSNGHICLDILYDSWSPAMTVSSVCISILSMLSSSPAKQRPADNDRYVRNCRNGRSPKETRWWFHDDKV

SEQ ID NO: 6660 - protein, 823 aa, Oryza sativa
  Clone ID: PAT_MRT4530_18548C.1.pep
MADNPPLIMLLAFLFSALLLLSPAHGGSRLQRGESLSVERASDILVSSNGVFAFGFYNLSSTVFTVSIWFAASAGRTVAWTANRDRPVHGAGSKLTLRRDGRLVLADYDGTPVWQTNSSSGAAAAAELTDSGNLVVTSHGGDVLWQSFDYPTDTLLPGQPVTATARLSTTDVLHPTSHYALRFDDRYLLSLAYDGPDISNIYWPDPDASSWANGRISYNASRRGVLDDAGRFLASDNTTFVASDTGAAAGGVTWRRLTLDHDGNLRLYSLRDADGGWSVSWMAFSQPCGIHGLCGWNGLCVYTPRPACSCPPGYVPADAGDRGKGCRPTFNLTCGGGGGRPEMGFARLPQTDFWGSDLNLFSSISVDGCKAACLELCNCVAFEYKDDVSDCYLKSALFNGKTYPGYPGTVYLKLPANLVAESDTYTAAPAAAAAVNLACDAARTEEVLLSFSAASPDTSSWRYYYGFLSAFFAVELCFIAFGWWFTARSRPATSEQWAAEEGYRVVTDHFRRFTYGELRKATKNFKDVIGHGRYGSVYRGVLAGAGDDRAVAVKKLKAATPQRGDDEFETEVSVIGRINHMNLVRIRGVCSERHRRRRLLVYEYVDNGSLATWLFGAKETLNWNQRYNIAVGVAKGLAYLHHECLDWIIHCDVKPENILLDEDFEPKISDFGLAKMQQRRDLDDPASFSIRGTRGYMAPEWVSSLPITEKVDVYSYGVVLLELVRGARMADLATDSVGDAEIAMRQLVWKIREGLKIGDRTWVISLVDRRLNGSFVYSQVALMLEVATSCLEKERNQRPSMNDVVKKFYTSDKKVEFIGEMSS

SEQ ID NO: 6661 - protein, 611 aa, Oryza sativa
  Clone ID: PAT_MRT4530_18601C.1.pep
ISGETAAGSSRSGPDPMGGEVPEPRRLNRALSFDDWVPDEALHLVMGHVEDPRDREAASRVCRRWHRIDALTRKHVTVAFCYAARPARLRERFPRLESLSLKGKPRAAMYGLIPDDWGAYAAPWIDELAAPLECLKALHLRRMTVTDADIAALVRARGHMLQELKLDKCIGFSTDALRLVARSCRSLRTLFLEECHITDKGGEWLHELAVNNSVLVTLNFYMTELKVAPADLELLAKNCKSLISLKMSECDLSDLISFFQTANALQDFAGGAFYEVGELTKYEKVKFPPRLCFLGLTYMGTNEMPVIFPFSMKLKKLDLQYTFLTTEDHCQIIAKCPNLLILEVRNVIGDRGLEVVGDTCKKLRRLRIERGDDDPGLQEEQGGVSQLGLTAVAVGCRELEYIAAYVSDITNGALESIGTFCKNLYDFRLVLLDRERQVTDLPLDNGVCALLRNCTKLRRFALYLRPGGLSDDGLSYIGQYSGNIQYMLLGNVGESDHGLIRFAVGCTNLQKLELRSCCFSERALSLAVLQMPSLRYIWVQGYRASQTGLDLLLMARPFWNIEFTPPSPESFNHMTEDGEPCVDSHAQVLAYYSLAGRRSDCPQWVIPLHPA

SEQ ID NO: 6662 - protein, 1130 aa, Oryza sativa
  Clone ID: PAT_MRT4530_18725C.1.pep
MAQAASSSIPSELPSRTNHDVEFSVVDYHQCTLESLEKDLAARVKWGSSQHVVISGYDMSTGEETLFKDNMDVAHALFVRKSDRKLILFVNVEDKISEKIKCDFITNNLAESWNKWVKDMKDRPIADLAEGIRAKTMDLFARRRKIGEKLDGVMLPIVVRQLNAMTRDLGHLKVVQGNRDQAEMAEITPEHDISRHAVNLTEHTCTCREWQVSGKSCPHALALIISARNPRMADYLDPCYSVEKYKLAYAGVIHPLPDKSQWPKVNIGFKLLPPLTMRDVGRQRKNRIVGCLEKGSKPRTKGRWQIQCKRCLNMGHRQTSSKCPLNGTKKKRKNRAKQGRPLGSTSDAAGSSTPKRQKVAINDSSNMSPGLVTRSISNPTMDCYYKLPVEKLAMRLLLFIGLVISLQFMADGASLPDDRCLKKCGDVDILYPFGIGEGCAIEGFVLSCSKTEDGRGDVALYGTTPVLNISLRYGQVRMKSTYISSMCYNLSTKNMDYKNWLLNLTTSPFTISQKENIFIVIGANTAANMFGYSRYSTMLNMIGCLSQCSPYNSFTAQDGSCVGIGCCQAVLSNNISYHEVQFNPLYNTTTSYNNRSITDRASYCGYAVVMEAAAFRFRTAYLNSTAFWDEHNGSVPVVLNWVVGNETCQVAKQMGDRYACRSKNSMCIDSSSGPTGYLCNCTEGYRGNPYLPDGCQDINECDVNNPPPCPGRCKNIPGSFTCSSPSQSRTVILAVSLSVGIVAMAMIVTCSYLVRERKKLANIKKKYFQQHGGMLLLQEIGLKQGQSTAFTIFTEAELIEATNKFEDKNVLGRGGHGTVYRGMLKDSRLIAIKRCMSMIDDRQKKEFGKEMLILSQINHKNIVKLLGCCLEVEVPMLVYEFIPNGTLFHFIHGGNDCRNIPFSTRVRIAHESAQALDYLHSSASPPIIHGDVKTSNILLDENYTAKISDFGASILVPTDEAQFVTLVQGTCGYLDPEYMQTCQLTDKSDVYSFGVVLLELLTGKMAFNLEGPENEKSLSLSFLCAMKEGRLMDIIDHHIQTDENAGVLEEVADLASQCLEMIGDNRPSMRDVADKLGRLRKVMQHPWAQHDPEEMESLLGESSVAGLEMVSTGNFSMEGGAVQGILESGR

SEQ ID NO: 6663 - protein, 274 aa, Oryza sativa
  Clone ID: PAT_MRT4530_18794C.1.pep
MAGGGGEYLRQFVEETAWYNEIFLSHVVPGDWWRALPHPLQSWLRNGLGGYLIYFACGFLWCFVIYYWKRHAYIPKDSIPTIEAMKKQIIVASKAMPLYCALPTLSEYMVENGWTQCYVNISEVGWPMYLVYLALYLIFVEFGIYWMHRELHDIKPLYKYLHTYHHIYNKENTLSPFAGLAFHPLDGILQAIPHVFALYLIPTHFRTHIALLFIEAVWTTNIHDCIHGKVWPVMGAGYHTIHHTTYRHNYGHYTVWMDWMFGTLREPEDILKKD

SEQ ID NO: 6664 - protein, 475 aa, Oryza sativa
  Clone ID: PAT_MRT4530_18872C.1.pep
MASGQKVVKPMEVSVEAGNAGEAAWLDDDGRARRTGTFWTASAHIITAVIGSGVLSLAWAIAQLGWVAGPAVMLLFAFVIYYTSTLLAECYRTGDPATGKRNYTYMDAVRANLGGAKVTFCGVIQYANLVGVAIGYTIASSISMRAIRRAGCFHHNGHGDPCRSSSNPYMILFGAVQIVFSQIPDFDQIWWLSIVAAVMSFTYSGIGLSLGIVQTISNGGIQGSLTGISIGVGVSSTQKVWRSLQAFGDIAFAYSFSNILIEIQDTIKAPPPSEAKVMKSATRLSVATTTVFYMLCGCMGYAAFGDAAPDNLLTGFGFYEPFWLLDVANVAIVVHLVGAYQVFVQPIFAFVERWASRRWPDSAFIAKELRVGPFALSLFRLTWRSAFVCLTTVVAMLLPFFGNVVGLLGAVSFWPLTVYFPVEMYIAQRGVPRGSARWVSLKTLSACCLVVSIAAAAGSIADVIDALKVYRPFSG

SEQ ID NO: 6665 - protein, 342 aa, Oryza sativa
  Clone ID: PAT_MRT4530_19048C.1.pep
MAFFSHHHLQQPHPQAPPPPPPQQQQQPVPPSFRNALPVPVDGQIPAPLPFFNPPPAFQDQPAQPPLVDAMGLTAAAGLGWRQPREQELLGENSQMSSIDFLQTGSAVSTGLALSLEDRRHGGGSGAGAGNSSGDSPLLLLPMLDDDISREVQRLDADMDRFIKAQSERLRQSILEKVQAKQFEALASVEDKILRKIRDKEAEVENINKRNSELEDQIKQLAVEVGAWQQRAKYNESMINALKYNLEQVCAHQSKDFKEGCGDSEVDDTASCCNGGAANLQLMPKENRHSKDLTACRVCKSSEACMLLLPCRHLCLCKECESKLSFCPLCQSSKILGMEIYM

SEQ ID NO: 6666 - protein, 142 aa, Oryza sativa
  Clone ID: PAT_MRT4530_19282C.1.pep
MAGNDNWINSYLDAILDAGKAAIGGDRPSLLLRERGHFSPARYFVEEVITGYDETDLYKTWLRANAMRSPQERNTRLENMTWRIWNLARKKKEFEKEEACRLLKRQPEAEKLRTDTNADMSEDLFEGEKGEDAGDPSVAYGD

SEQ ID NO: 6667 - protein, 103 aa, Oryza sativa
  UNSURE (1)..(103): unsure at all Xaa locations
  Clone ID: PAT_MRT4530_19435C.1.pep
  unsure (1)..(103): unsure at all Xaa locations
MSGRGKGGKGLGKGGAKRHRKVLRDNIQGITKPAIRRLARRGGVKRISGLIYEETRGVLKDFLENVIRDAVTYTEHAKRTTETAMDRLLRAKTXGRTLYGFGG

SEQ ID NO: 6668 - protein, 1887 aa, Oryza sativa
  UNSURE (1)..(1887): unsure at all Xaa locations
  Clone ID: PAT_MRT4530_19802C.1.pep
  unsure (1)..(1887): unsure at all Xaa locations
MGFLVGLVLGIAAGVALIVGFARAENSRAARRRQLAATIASFSKMTIEDSRKLLPADLYPSWVVFSTQQKLKWLNQELIKIWPFVNAAASELIKTSVEPVLEQYRPIILASLKFSKLTLGTVAPQFTGVSIIENDESGIVMELEMNWDANPRVFRLIFKPLVDQLPCFGAVCFSLRKKKKLDFRLKVIGGEISAIPGISDALEDTIKNAIEDSITWPVRKVIPIIPGDYSCLCASNLQNNDLNPIWNEHFEFIVEDADTQTVTVKIYDDDGIQESELIGCAQVTLKDLQPGKVKDVWLKLVKDLEIQRDRKDRGQVHLELLYCPFDMKEETPNPFRQQFSMTSLERTMTSMENGSGSNGFNRLSSRKKKEIIMRGVLSVTVISGEDLPAMDMNGKSDPYVVLSLKKSKTKYKTRVVSESLNPVWNQTFDFVVEDVHDKHSPVDAPRGAQRHAATNQSPAAPAAPTPLAEARGAPPIPEPRRPRRVDAPRGAQLRAASPGVVEVALSPWEVDRGHLGLGIFGDLGVKISRSGHEPHEHPGVSYLGQIRFRFGRYQQSIIVCFIQRPIKPSSEPHGPRFQSIQENERPGSHENPWVSDERPRTPHILYPLPLLPNPNLALHFPTSEAVVEASVSSSSFSYCCCCCLNPSGLRADAPFVAVGFGASGAMAPKGAGRGKGRGGGGGGKGDKRKKEEKVVPSAIDVTVVTPYESQVTLKGISTDRVLDVRKLLGSNVETCHLTNYSLSHVTRGQRLEDGVEIVSLKPCSLTIVEEEYATEAAAAAQVRRLLDIVACTTAFVNKPRDGAKHKSSKHARPATPPSPPALAASPDAHGAGAAQAPPISEAHDMAAIRPPPRLGEFYDFLSFAHLTPPVHFIRRKESNGASQEGDYFEIEVKVCNGKLLHIVASVKGFYSAGKPHTVSHSLVDLLQQLSSAFANAYDALMKAFLDHNKKKDSPASEDKKNAGHVEKETTIKGLGKHFEQLKKIKKKECHVEGAMSEKEDSDSNCSVINGMEESENTKETDISKLMSEDDFCRLKDLGAGLHQKSLEELTMMAHKFYDDTALPKLVGLELVARDYDMNSPNPFDKSDIVNIIPVCKHVVYSSIDGRNLLESSKMALDKGKLDDAVNFGTKALSKIVAVCGPYHRLTANAYSLLAVVLYHTGDFNQATIYQQKALDINERELGLDHPETMKSYGDLSVFYYRLQHIEMALKYLHASPASATQSLFRQLITFQTAASYHAIAIALSMMDAYSLSVQHEQTTLQILQEKLGQDDLRTQDAAAWLEYFESKALEQQEAARRGIPKPDSSIASKGHLSDLLDYISPDQERKERDTQRKGRRAKNNIRAHQGELVEEKESFEHDIGSPHEANKEEFQQVKLKAHPPAISEENYAIHDELKQVDPLSPEEYSDEGWQAANLRGRSANVRKKSSRRRPALTKLMVDRLEDGRTGSAYRAGVQQHMKGDKEDVINSSSQLSFGSFLKTDIMELEMNWDANPSIILDVKTLPIQVKDIGIAGELGXSTGDAVTRRGAVEQPALEQKEAKEKDNAQNTDLIVSSEEEDKKLTDEDEEKEKPSHDSSKEVLSSEPEEIGNDEKAPDSNSDESPTESKKKGGSKLSASAPPFNPGSLLSMSHPYSTVAIYDASVVLQPIPSQPMEILPHAIDTRVPRGPRSTLYYRTGHTFQRKQGYAHSQSTILRGSNSPPTMNPHAAEFVPGKTSQQPDVANREPSADVSVTDSADQLLAPQTSDEVKAGMPAAEQAIQGESTSPCKGKENRAKDALRNSCKTELARQILFSFIVKSVHDSLGSTGAESDRKPSGPDESGNAQSSNNINKSPSGRKELDKQQKATVVPKSEKDTEGFTVVSKRRRSKQHFVHPIHGLYSQQSICTSVS

SEQ ID NO: 6669 - protein, 1413 aa, Oryza sativa
  UNSURE (1)..(1413): unsure at all Xaa locations
  Clone ID: PAT_MRT4530_19805C.1.pep
  unsure (1)..(1413): unsure at all Xaa locations
MAPKGAGRGKGRGGGGGGKGDKRKKEEKVVPSAIDVTVVTPYESQVTLKGISTDRVLDVRKLLGSNVETCHLTNYSLSHTRGQRLEDGVEIVSLKPCSLTIYKEYATEAAAAAQVRRLLDIVACTTAFVNKPRDGAKHKSSKHARPATPPXDMAAIRPPPRLGEFYDFLSFAHLTPPVHFIRRKESNGASQEGDYFEIEVKVCNGKLLHIVASVKGFYSAGKPHTVSHSLVDLLQQLSSAFANAYDALMKAFLDHNKFGNLPYGFRANTWLIPPIYLDSATKCPALPVEDENWGGNGGGNGRDGKYDRRRWAKEFSTLARMPCKTEEGRVIRDRKAFLLHNLFVDTAIFRAASTIQRLIDLSGNSTSQQAGPDGSLAIEERVGDLLITVKRDQADASLKLEDKVDGVALYQTGSMDISQRNLLKGLTSDESVVVKDTSTLGVVIVKHCGYTATVKVSGRTKDGNGGKQTSDICDHLDGISNVDVDDLPDGGSNALNINSLRISLPKIVNSDIASTQCPTPQSHVDNHARKLVRKILEDSLMKLENMPANNPKTIRWELGSSWLQNLQKKDSPASEDKKNAGHVEKETTIKGLGKHFEQLKKIKKKECHVEGAMSEKEDSDSNCSVINGMEESENTKETDISKLMSEDDFCRLKDLGAGLHQKSLEELTMMAHKFYDDTALPKLVADFASLELSPVDGRTMTDFMHTRGLNMCSLGRVVELAEKLPHIQSICIHEMVIRSFKHIVRAVIAAVDDMQNMSAAIAETLNILLGCPRLESDTETDAHSEHNLRFRWVERFLSKRYNWKLKDEFAHLRKFIILRGLCSKVGLELVARDYDMNSPNPFDKSDIVNIIPVCKHVVYSSIDGRNLLESSKMALDKGKLDDAVNFGTKALSKIVAVCGPYHRLTANAYSLLAVVLYHTGDFNQATIYQQKALDINERELGLDHPETMKSYGDLSVFYYRLQHIEMALKYVNRALYLLQFSCGLSHPNSAATYINVAMMEEGMGNVHVALRYLHEALKCNKRLLGADHIQTAASYHAIAIALSMMDAYSLSVQHEQTTLQILQEKLGQDDLRTQDAAAWLEYFESKALEQQEAARRGIPKPDSSIASKGHLSVSDLLDYISPDQERKERDTQRKGRRAKNNIRAHQGELVEEKESFEHDIGSPHEANKEEFQQVKLKAHPPAISEENYAIHDELKQVDPLSPEEYSDEGWQAANLRGRSANVRKKSSRRRPALTKLMVDRLEDGRTGSAYRAGVQQHMKGDKEDVINSSSQLSFGSFLKTDKVNGNSSNIENKVFNAISKPERGIKLSGINRPATIASKLVSYKDVAVSPPGTVLKPILEQKEAKEKDNAQNTDLIVSSEEEDKKLTDEDEEKEKPSHDSSKEVLSSEPEEIGNDEKAPDSNSDESPTESKKK

SEQ ID NO: 6670 - protein, 487 aa, Oryza sativa
  Clone ID: PAT_MRT4530_2005C.1.pep
MAKDVEMAVRNGDGGGGGGYYATHPHGGAGGEDVDDDGKQRRTGNVWTASAHIITAVIGSGVLSLAWATAQLGWVVGPVTLMLFALITYYTSGLLADCYRTGDPVSGKRNYTYMDAVAAYLGGWQVWSCGVFQYVNLVGTAIGYTITASISAAAVHKANCYHKNGHDADCGVYDTTYMIVFGVVQIFFSMLPNFSDLSWLSILAAVMSFSYSTIAVGLSLARTISGATGKTTLTGVEVGVDVTSAQKIWLAFQALGDIAFAYSYSMILIEIQDTVKSPPAENKTMKKATLLGVSTTTAFYMLCGCLGYAAFGNAAPGNMLTGFGFYEPYWLIDFANVCIVVHLVGAYQVFCQPIFAAVETFAARRWPGSEFITRERPVVAGRSFSVNMFRLTWRTAFVVVSTVLAIVMPFFNDILGFLGAVGFWPLTVYYPVEMYIRQRRIQRYTSRWVALQTLSLLCFLVSLASAVASIEGVSESLKHYVPFKTKS

SEQ ID NO: 6671 - protein, 770 aa, Oryza sativa
  Clone ID: PAT_MRT4530_2013C.1.pep
MALIGTVAAEVLIPLAAVIGILFAVLQWYMVSRVAVPPHDGVGGAGKVERESDGGDGDGDGVDDEEDGVDYRGVEARCAEIQHAISVGATSFLMTEYKYLGAFMAAFAAVIFVSLGSVGRFSTSTEPCPYDAARRCRPALANAAFTAAAFLLGATTSVVSGYLGMRVATFANARTALEARRGIGRAFAVAFRSGAAMGFLLASSALLVLFAAVNAFGLYYGDDWGGLYEAITGYGLGGSSMALFGRVGGGIYTKAADVGADLVGKVERNIPEDDPRNPAVIADNVGDNVGDIAGMGSDLFGSYAESSCAALFVASISSFGADHDFAAMMYPLLVSAAGIVACAATTLVATDAGELGAADEVAPALKRQILISTVLMTAAVAAVTFLSLPRSFTLFDFGERKLVKNWHLFICVSAGLWAGLVIGYVTEYFTSNAYGPVQTVAQSCRTGAATNVIFGLAVGYKSVIVPIFAIAGAIYASFRLAAMYGIALAALGMLSTIATGLTIDAYGPISDNAGGIAEMAGMPRRVRERTDALDAAGNTTAAIGKGFAIGSAALVSLALFGAYVSRAGIRTVNVVSPRVFVGLLAGAMLPYWFSAMTMRSVGSAALRMVEEVRRQFDEIPGLAEGLAAPDYATCVRISTDASLREMVAPGALVMASPLVAGTLFGVEALAGLLAGALVSGVQVAISASNSGGAWDNAKKYIEAGATEEARSLGPKGSEAHKAAVIGDTIGDPLKDTSGPSLNILVKLMAVEALVFAPFFAAHGGIVFNHL

SEQ ID NO: 6672 - protein, 287 aa, Oryza sativa
  Clone ID: PAT_MRT4530_20264C.1.pep
MGKEVDVSTLEAGGARDYIDPPPAPLVDVDELGKWSLYRALIAEFVATLLFLYVTVATVIGYKHQTDAAVNGADAACGGVGVLGIAWAFGGMIFILVYCTAGVSGGHINPAVTFGLFLARKVSLVRAVLYIVAQSLGAICGVGLVKGFQSAFYVRYGGGANELSDGYSKGTGLAAEIIGTFVLVYTVFSATDPKRNARDSHVPVLAPLPIGFAVFMVHLATIPITGTGINPARSLGAAVIYNQHKAWHDHWIFWVGPLIGAAIAAAYHQYVLRASAAKLGSSSSFRG

SEQ ID NO: 6673 - protein, 55 aa, Oryza sativa
  Clone ID: PAT_MRT4530_20333C.1.pep
GCQQWFYSLPFKLLVTKQVGVCETRPGWGWGNLLKCLGALPVFLLALLLGFIVMG

SEQ ID NO: 6674 - protein, 497 aa, Oryza sativa
  Clone ID: PAT_MRT4530_2073C.1.pep
MAAELASLPRGLHFFRLSGCVVSHATFPGSKAMGRWIGPQREADGDRGPRTKEEAAPKRFVHTPIPPSILSDPTLAAAATGLLPAAYNFELPKTAHRIRSSGARRTALQLPEGLLLFSLPLSHLLAPFLEPDPSNDVLILADPTYGACCLADRPAKALAADVLVHYGHSCLVPVTSSLLPVLYVFVEIRVDAQRLADAVRAAFPDPADAPRLAIAGTVQFISAVHAAREILSHDGYQGIVVPQAKPLSAGEVLGCTAPALKRSEGVGAVVFVADGRFHLEAFMIANPGVKAYRFDPFLGVLVLEEYDHVGMKQARKEAVLAARKAKSWGVILGTLGRQGSVKVLDRVVEHLEEKGLEHTVVLMSELSPARMELFGDSVDAWVQIACPRLSIDWGEGFKKPMLTTFEFDVALGYVPGWWEKGSRECGSGDATGCCSGSGTSTDCGCSNGGCADKDFGGEYPMDYYSQDGGDWNSCYMKKKPSTGERKLRVRIGNYSNS

SEQ ID NO: 6675 - protein, 492 aa, Oryza sativa
  Clone ID: PAT_MRT4530_20929C.1.pep
MDPCKFRPSSSFDTKTTTTNAGAPVWNDNEALTVGPRGPILLEDYHLIEKVAHFARERIPERVVHARGASAKGFFECTHDVTDITCADFLRSPGAQTPVIVRFSTVIHERGSPETIRDPRGFAVKFYTREGNWDLLGNNFPVFFIRDGIKFPDVIHAFKPNPRSHVQEYWRVFDFLSHHPESLHTFFFLFDDVGIPTDYRHMDGFGVNTYTFVTRDAKARYVKFHWKPTCGVSCLMDDEATLVGGKNHSHATQDLYDSIAAGNFPEWKLFVQVIDPEEEERFDFDPLDDTKTWPEDEVPLRPVGRLVLNRNVDNFFNENEQLAFGPGLVVPGIYYSDDKMLQCRVFAYADTQRYRLGPNYLMLPVNAPKCAHHNNHYDGAMNFMHRDEEVDYYPSRHAPLRHAPPTPITPRPVVGRRQKATIHKQNDFKQPGERYRSWAPDRQERFIRRFAGELAHPKVSPELRAIWVNYLSQCDESLGVKIANRLNVKPSM

SEQ ID NO: 6676 - protein, 544 aa, Oryza sativa
  Clone ID: PAT_MRT4530_20985C.1.pep
MALTLRSSTSFLSPLDPSSKREDAPPCCVVPMPAPGSGGRLRLARAAPVEHATMEEMASPEAATLLHHGGGGGQGQRRGKGTAVYVMLPLETVGAGGKVARARALAASLAALRSGGVEGVMVDVWWGVVEREGPRRYDWEGYGELVRMVERAGLRLQMVMSFHQCGGNVGDSCNIPLPGWVLEEMKSNPDIVYTDRSGRRNPEYISLGCDTLPVLKGRTPIQVYSDYMRSFRDTFCGYLGNTIVEIQVGLGPCGELRYPSYPEANGTWRFPGIGEFQCYDKYMRASLQQAAAAAGHEEWGRGGPHDAGEYKQFPEETGFFRRDGTWCTEYGDFFLGWYSGMLLEHGDRVLAAAEAVFRGTGAALSAKVAGIHWHYRTRSHAAELTAGYYNTRRRDGYAPVAAMLARRGAVLNFTCMEMRDEQQPEHAGCSPEQLVRQVRSAARAARVGLAGENALERYDEAAFAQVVATAASAGLGAFTYLRMNKKLFDGDNWRQFVSFVRAMADGGERAALPSCDTEQSDLYVGFLEKRAAPEAEAAAAAAVV

SEQ ID NO: 6677 - protein, 89 aa, Oryza sativa
  UNSURE (1)..(89): unsure at all Xaa locations
  Clone ID: PAT_MRT4530_21046C.1.pep
  unsure (1)..(89): unsure at all Xaa locations
APPLLLLLPPPAETSSSYPSRIXRSTPPPATETRPLVDRSAARAGAGRQAARGVGGNFGVKINKTTGAAYTIASRGEKRGREGKGPEXW

SEQ ID NO: 6678 - protein, 1155 aa, Oryza sativa
  Clone ID: PAT_MRT4530_21231C.1.pep
MFTPQGKGWTGWSTPAPANQRSGGGAPAASAPLGKGKGTTLRVAELEQELHEYQYNMGLLLIEKKEWTAKLDEINQALTQKEEILKREQAAHLNAISEYERREESMRKALGVEKQCVTDLEKALREIRGEIAEVKFMSEKKITDAQSLEASLEEKRLEIEGKLHAADAKLAEANGTPTQADRDLEEVEARQRRLEKEKLYFENERKAGEDRIKRQEDSLRDWDKKLKESQNRILDLQRSLNDREERANENDKLFKIKQEELEEAKKALEHTKATLKIKEDDINKRLAELHLQEKEAESKNRKLEEREKKIAEREEKVSAREKVGLQKLLEDHNVKLESKRRDFDLQLENEKKSFDAMLVQKEADLVQREKDVRSSEEKLSKKEQVLNESKKKLEEWQNDLDTKSNALKKWEESLQNDEKQLSEQKLQIENERKQAEMYKLELESLKATVVAEKEKILQEQNNLKLTEEERQEHIMLTAQLKKEIDEYRMRSNSLSEETEDLRKQRQKFEEEWEQLDEKRTHLEEEAKKLNNEKKNLERWHDNEEKRLKDREDELDIKYKEQGENLALKEKSLIDNIDHQRLENEELLKRERADLQRNLQLHRHELEMEMEKKQASKERELEEKENELNRKMDFVENELKRAAELNESKIQKILLEKKQLQKEKEVLVEDRQKLETDKADIRRDIDSLNTLSKSLKERREAYNRDRNNLIDIFEKYKVCKNCGVIIFEGLDALALKDSTDIEYPSLAVEADDRSPNPDTLAQETGALVNSGGRLSLLQKCSRIFKFSPRKKAEQSSEQQAVKNTDFGARLEEASQSDDDYEPTPVYQVAYNSFDAEDLPSESGAFENEESERQDIADDVQMESSLGVADNCVDIHGTQSFDGNTDMVVDTTIVDVDQNGKDSAVLPVVDLEPETSKQGRRQQNRKGRAKGGVKRTRSVLAVVEDAKEILGENLEVKKDDGQGDSVTVGGTRKRRFAGATISEQDEDSEAHSESVSLGGQRRKRRQTAAAVTQAPGEKRYNLRRTTVANAATAAQTNKKKAAKKGSKQTVEATADDTEGTSKAEEPATGSKGASQSADDASQLPEYSQAEAGDTHGPVEVTSAEGVDIVDGIDAAPDAMPMTPSGSELGAEQDDEEDDDSERRNQSIGKKLWSFFTT

SEQ ID NO: 6679 - protein, 370 aa, Oryza sativa
  Clone ID: PAT_MRT4530_21267C.1.pep
MAIMVDPPNGMGNQGKYYYSMWQTLFEIDTKYVPIKPIGRGAYGIVCSSINRETNEKVAIKKIHNVFDNRVDALRTLRELKLLRHLRHENVIALKDIMMPVHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMSESDLEFIDNPKARRYIKSLPYTPGVPLASMYPHAHPLAIDLLQKMLIFDPTKRISVTEALEHPYMSPLYDPSANPPAQVPIDLDIDENISADMIREMMWHEMLHYHPEVVAAMSAR

SEQ ID NO: 6680 - protein, 138 aa, Oryza sativa
  UNSURE (1)..(138): unsure at all Xaa locations
  Clone ID: PAT_MRT4530_21361C.1.pep
  unsure (1)..(138): unsure at all Xaa locations
MQMLMSVFVIIIGCYTAIDWITDIVIFIIGVSTMHLKRCQTVKLYIAASLTXFYIVKALFGFIKQLIGYNIVAFCHPSTVFIFGKSTRETMAKMIEALGFGVIWFERRLSFRLLRCICAVFHTAYGALSVQSALMPHS

SEQ ID NO: 6681 - protein, 782 aa, Oryza sativa
  Clone ID: PAT_MRT4530_21504C.1.pep
MAPTLAFLLVLLLLLAGGGGGGAFLAAAASTDTVVPGKGMAGNQTLVSKNGRFELGFFTPGSGIHYFLGVRLRNMAEYSPTFWIGDRVGVIDLPGVSLEVFGDKLYIKEDGVSLWWSSVAGNGSSSSSDGGAVAVLLDTGDLVVRDQGNPSGVLWRSFDYPGDSLLPGGRLGLDAATGTNVSLTFKGFSHNGSLQVDASRRNGFVLTTDGIDSRGAFPDWMVTSQDNGSSLVLNHPDAPNSTEFLQFNLGLISLMRWSDSTAGWVARWTFPSDCKSGAFFCGDFGACTAGGGGGCECVDGFTPSYPDEWRLGYFVTGCSRSLPLSCEANGQTEHDDSFAILDNLRGLPYNAQDEPVTTDEDCRAACLNKCYCVAYSNESGCKLWYHNLYNLSSADKPPYSKIYVRLGSKLKSNRGLATRWIVLLVVGSLAVTSVMLGLVLLCRYRRDLFASSKFEVEGSLIVYTYAQIRKATGNFSDKLGEGGFGSVFRGTLPGSTTVVAVKNLKGVGQAEKQFRTEVQTVGMIRHTNLVRLLGFCVNGNRRLLVYEYMSNGSLDAHIFSEKSSLLSWHVRYQIALGIARGLAYLHEECEDCIIHCDIKPENILLDYEFCPKICDFGMAKLLGREFNSALTTVRGTMGYLAPEWIYGQPITKKADVYSFGIVLFEIISGRRSTETVKFGSHRYFPTYAAVQMNEGDVLCLLDSRLEGNANVKELDITCRVACWCIQDEENDRPSMGQVVRMLEGVVDMEMPPIPASFQNLMESEDSGIYSEESWNFRTRDQF

SEQ ID NO: 6682 - protein, 280 aa, Oryza sativa
  Clone ID: PAT_MRT4530_21919C.1.pep
MSGAYRDRGFGGAAAEMDRKRIKDVLEKHLDRSSPSTSRGAAVAKERDRLAAAGGKLPAPLGKAGKVSDGAEEFETDSEDSDVSGSEGEDTSWISWFCSLRGNEFFCEIDDDYIQDDFNLCGLSNQVPYYDYALDLILDIESSNGDVFTEEQNELIESSAEMLYGLIHARYILTSKGLAAMLEKFKNYDFGRCPRVYCCGQPCLPAGQSDIPRSSTVKIYCPKCEDLHYPRSKYQGNIDGAYFGTTFPHLFLMTYPHLKPQKPSQQYVPKVFGFKLHKQS

SEQ ID NO: 6683 - protein, 625 aa, Oryza sativa
  Clone ID: PAT_MRT4530_21965C.1.pep
MKREYQEAGGSSGGGSSADMGSCKDKVMAGAAGEEEDVDELLAALGYKVRSSDMADVAQKLEQLEMAMGMGGVSAPGAADDGFVSHLATDTVHYNPSDLSSWVESMLSELNAPLPPIPPAPPAARHASTSSTVTGGGGSGFFELPAAADSSSSTYALRPISLPVVATADPSAADSARDTKRMRTGGGSTSSSSSSSSSLGGGASRGSVVEAAPPATQGAAAANAPAVPVVVVDTQEAGIRLVHALLACAEAVQQENFAAAEALVKQIPTLAASQGGAMRKVAAYFGEALARRVYRFRPADSTLLDAAFADLLHAHFYESCPYLKFAHFTANQAILEAFAGCHRVHVVDFGIKQGMQWPALLQALALRPGGPPSFRLTGVGPPQPDETDALQQVGWKLAQFAHTIRVDFQYRGLVAATLADLEPFMLQPEGEADANEEPEVIAVNSVFELHRLLAQPGALEKVLGTVHAVRPRIVTVVEQEANHNSGSFLDRFTESLHYYSTMFDSLEGGSSGQAELSPPAAGGGGGTDQVMSEVYLGRQICNVVACEGAERTERHETLGQWRNRLGRAGFEPVHLGSNAYKQASTLLALFAGGDGYRVEEKEGCLTLGWHTRPLIATSAWRVAAA

SEQ ID NO: 6684 - protein, 346 aa, Oryza sativa
  Clone ID: PAT_MRT4530_22107C.1.pep
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEGWGVAVLVGVPTKDDVFKTHPMNFLNEKTLKGTFFGNYKPRTDLPNVVELYMKKELELEKFITHSVPFSEINTAFDLMLKGESLRCVMRMD

SEQ ID NO: 6685 - protein, 629 aa, Oryza sativa
  Clone ID: PAT_MRT4530_2230C.1.pep
MAFGDRITTFEDSEKESEYGYVRKVSGPVVVADGMGGAAMYELVRVGHDNLIGEIIRLEGDSATIQVYEETAGLMVNDPVLRTRKVMPAQPLSVELGPGILGNIFDGIQRPLKTIAIKSGDVYIPRGVSVPALDKDALWHFKPEKLGVGDIITGGDLYAIVNENTLMQHKVALPPGAMGKISYIAPAGQYSLQDTVLELEFQGIKKEFTMLQTWPVRSPRPVMEKLAADTPLLTGQRVLDALFPSVLGGTCAIPGAFGCGKTVISQALSKYSNSQAVVYVGCGERGNEMAEVLMDFPQLTMTTEDGREESVMKRTTLVANTSNMPVAAREASIYTGITIAEYYRDMGYNVSMMADSTSRWAEALREISGRLAEMPADSGYPAYLAARLASFYERAGKVRCLGSPKRDGSVTIVGAVSPPGGDFSDPVTSATLSIVQVFWGLDKKLAQRKHFPSVNWLISYSKYSKIPTALEPHYEREDPDFIDIRTKAREVLQREDDLNEIVQLVGKDALAESDKITLETAKLLREDYLAQNAFTPYDKYCPFYKSVWMMRNIIHFNTLATQAVERAAGADGQKITYSVIKHRMGDLFYRLVSQKFEDPAEGKEVLIAKFQKLYDDLTAGFRNLEDEAR

SEQ ID NO: 6686 - protein, 338 aa, Oryza sativa
  Clone ID: PAT_MRT4530_22368C.1.pep
MSFLFKSSNGATTEKNLTLEEQQEKINDLRKELGEHSSEEIQDFLSDASCLRFLRARNWNVQKASKMMKSAVKWRVSYMPQKINWDDVAHEAETGKIYRADYKDKHGRTVLVLRPGLENTTSGKGQIKYLVYCLEKAIMSLTEDQEKMVWLTDFQSWTLGSTPLKVTRETVNVLQDCYPERLGLAILYNPPRIFESFWKDFYRSTTLASVLFWYLPNVEIVKPFLDHETYKKVKFVYSSDKESQKIMADVFDLDKLDSAFGGRNPATFEYNSYAERMRADDIKMGSSFKSNGITLPQDHSHVSADKEANGGGSDASSEASFYSGTDSPNHEEGGSILA

SEQ ID NO: 6687 - protein, 469 aa, Oryza sativa
  Clone ID: PAT_MRT4530_22543C.1.pep
MAPQLPLEVASAPKLDDDGHPQRTGNLWTCVAHIITAVIGCGVLALSWSVAQLGWVAGPIAMVCFAFVTYISAFLLSHCYRSPGSEKMQRNYSYMDAVRVHLGRKHTWLCGLLQYLNLYGIGIAYTITTATCMRAIKRANCYHSEGRDAPCDSNGEHFYMLLFGAAQLLLSFIPNFHKMAWLSVVAAIMSFAYSTIGLGLGLAKTIGDGTVKGNIAGVAMATPMQKVWRVAQAIGDIAFAYPYTIVLLEIQDTLRSPPPESETMQKGNVIAVLATTFFYLCVGCFGYSAFGNAAPGNLLTGFGFYEPYWLIDFANACIVLHLLGGYQMFSQQIFTFADRCFAASFPNSAFVNRSYSVKILPWRRGGGGGGAGRYEVNLQRVCFRTVYVASTTGLALVFPYFNEVLGVLGALVFWPLAIYLPVEMYCVQRRISPWTPRWAALQAFSVVCFVVGTFAFVGSVEGVIRKRLG

SEQ ID NO: 6688 - protein, 545 aa, Oryza sativa
  Clone ID: PAT_MRT4530_22702C.1.pep
MGSSVKDAGGGKEEQQQQLESPLLEAAVSSGGGDGGGGHGVSGELESILGDETVPWARRMWAATGVEMRLMLRLAAPAVLVYMINYLMSMSTQIFSGHLGTLELAAASLGNTGIQVFAYGLMVFSWLLAWHAMHGLLANGSYVVQMQLGMGSAVETLCGQAYGAHKYDMLGVYLQRSTVLLMATGVPLAVIYAFSRPILVLLGESPEIASAAAVFVYGLVPQIFAYAANFPIQKFMQAQSIMAPSAYISAATLAFHLVLSYLVVYQFGLGLLGASLMLSISWWVIVVAQFIYIVTSRRCRLTWTGFSMLAFSGLPDFFKLSLASAVMLCLETWYFQILVLIAGLLKDPEMALASLSVCMTISGWVFMISVGFNAAASVRVSNELGAGNPKSAAFSVVVVTVLSFFLSVVISLVILLCRDYISYIFTDGEDVATAVSKLTPLLALTLILNGIQPVLSGVAVGCGWQAFVAYVNVGCYYIVGIPLGCLLGFYFDLGAAGIWSGMIGGTLMQTLILMWVTFRTNWNREVEEAMKRLNKWEDKTPLLSE

SEQ ID NO: 6689 - protein, 1121 aa, Oryza sativa
  Clone ID: PAT_MRT4530_23251C.1.pep
MDSLWAAIAALFVAAAVVVRGAAAADDAQLLEEFRQAVPNQAALKGWSGGDGACRFPGAGCRNGRLTSLSLAGVPLNAEFRAVAATLLQLGSVEVLSLRGANVSGALSAAGGARCGSKLQALDLSGNAALRGSVADVAALASACGGLKTLNLSGDAVGAAKVGGGGGPGFAGLDSLDLSNNKITDDSDLRWMVDAGVGAVRWLDLALNRISGVPEFTNCSGLQYLDLSGNLIVGEVPGGALSDCRGLKVLNLSFNHLAGVFPPDIAGLTSLNALNLSNNNFSGELPGEAFAKLQQLTALSLSFNHFNGSIPDTVASLPELQQLDLSSNTFSGTIPSSLCQDPNSKLHLLYLQNNYLTGGIPDAVSNCTSLVSLDLSLNYINGSIPASLGDLGNLQDLILWQNELEGEIPASLSRIQGLEHLILDYNGLTGSIPPELAKCTKLNWISLASNRLSGPIPSWLGKLSYLAILKLSNNSFSGPIPPELGDCQSLVWLDLNSNQLNGSIPKELAKQSGKMNVGLIVGRPYVYLRNDELSSECRGKGSLLEFTSIRPDDLSRMPSKKLCNFTRMYVGSTEYTFNKNGSMIFLDLSYNQLDSAIPGELGDMFYLMIMNLGHNLLSGTIPSRLAEAKKLAVLDLSYNQLEGPIPNSFSALSLSEINLSNNQLNGTIPELGSLATFPKSQYENNTGLCGFPLPPCDHSSPRSSNDHQSHRRQASMASSIAMGLLFSLFCIIVIIIAIGSKRRRLKNEEASTSRDIYIDSRSHSATMNSDWRQNLSGTNLLSINLAAFEKPLQNLTLADLVEATNGFHIACQIGSGGFGDVYKAQLKDGKVVAIKKLIHVSGQGDREFTAEMETIGKIKHRNLVPLLGYCKAGEERLLVYDYMKFGSLEDVLHDRKKIGKKLNWEARRKIAVGAARGLAFLHHNCIPHIIHRDMKSSNVLIDEQLEARVSDFGMARLMSVVDTHLSVSTLAGTPGYVPPEYYQSFRCTTKGDVYSYGVVLLELLTGKPPTDSADFGEDNNLVGWVKQHTKLKITDVFDPELLKEDPSVELELLEHLKIACACLDDRPSRRPTMLKVMAMFKEIQAGSTVDSKTSSAAAGSIDEGGYGVLDMPLREAKEEKD

SEQ ID NO: 6690 - protein, 215 aa, Oryza sativa
  UNSURE (1)..(215): unsure at all Xaa locations
  Clone ID: PAT_MRT4530_23285C.1.pep
  unsure (1)..(215): unsure at all Xaa locations
MATEEDASTMAAAEADPKPAATPSYPEMILAAIEALDDRNGSNKTAISQHIEGKYEGLLPPAHPSLLTAHLARMKQTGELAFSKNNYFRGDDPSLPPKRGRGXRPPKPKDAAAAAAXAPAPAPAAPAASSPRPRGRPPKPKDPLAEAVAKATSGMPRARGRPPKKAKVEQEDPIGAPAAASAPAAAAEAAPPVKRGRGRPPKVRPAAPVGEPAAA

SEQ ID NO: 6691 - protein, 329 aa, Oryza sativa
  Clone ID: PAT_MRT4530_23712C.1.pep
MDPGAGGPLTESEKADLDAIAAIKESAAAEYKEKGNRLVKMGRSHYADAVDCYTKAIAQMEPLPPPPVPSPDASVLFANRAHVNLLLGNHRRALDDAARAVQLSPSNVKAYYRAAKAAIALGLLPEAAAFCRRGIEQDPANEELKKLLAQVDAQQSEQDRHRAKVAQAVSAAKDIVAAIEKRGLKLGKAAYQELTGVKKPKLDEQGVLHWPVLLLYPEAGVGTVLSKSEILKILLEGTMDSKSLPESLLDEEDGENDDGKSSTITSSDKGSVKWINVKEGKTLQEVLQHKDFIIPAIPGLHYLLLGYSYKHASCMQIGVPRTQTCATVI

SEQ ID NO: 6692 - protein, 485 aa, Oryza sativa
  Clone ID: PAT_MRT4530_23714C.1.pep
MALSVEKTSSGREYKVKDLSQADFGRLEIELAEVEMPGLMACRAEFGPSQPFKGARISGSLHMTIQTAVLIETLTALGAEVRWCSCNIFSTQDHAAAAIGRDSAAVFAWKGETFEEYWWCTERCLDWGVGGGPDLIVDDGGDATLLIHEGVKAEEEFEKSGKVPDPESTDNAEFKIVLTIIRDGLKSDPSKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSTGKYEKKVYVLPKHLDEKVAALHLGKLGARLTKLSKSQADYISVPVEGPYKPAHYRY

SEQ ID NO: 6693 - protein, 831 aa, Oryza sativa
  Clone ID: PAT_MRT4530_23715C.1.pep
MPPLLYNLFVLIVVFLGGGAPACSAATDTVKPGHVVGGKDKVVSNNGKFALGFFKAPAPNQEKWFLGIWFNTVPNRTTVWVANGGEPIMDAADAGSPELTISGDDGDLVALHPTTKSIAWSTNVSAKNSTSNSNNTAAVLLNSGNLVLQDTSNMSQPRTLWQSVDHPTDTLLPGAKLGRDKLTGLNRRLVSKKSMAGPSPGAYCFEVDEDTPQLVLKLCNSSVTYWSSGPWNGQYFTGIPELIGNSPGFHLGFFDNSREEYLQFNVSNEAVVTRNFIDVDGRNKQQVWLDSSQSWLTLYSNPKVQCDVYGVCGAFSVCSFSLLPLCSCMKGFTVGSVKDWEQGDQTGGCVRKNQLDCVGSNTSSSDSTDKFYSMSDIILPDKAESMQDVDSSDECMKVCLNNCSCTAYSYGSKGCLVWHTELLNAKLQQQNSNGEIMYLRLSARDMQRSKKRRVIIGVVVGACAAGLAVLMFILMFIIRRNKDKNRSENYGSLVAFRYKDLRSATKNFSEKIGEGGFGSVFRGQLRDSTGIAVKRLDGRSQGDKQFRAEVRSIGTIQHINLVNLIGFCSDGDSRFLVYEHMPNRSLDTHLFQSNGKFLDWNTRYQIALGVARGLCYLHESCHDRIIHCDIKPQNILLDASFLPKVADFGMAKFVGRDFSRALTTMRGTIGYLAPEWISGTAITPKVDVYSYGMVLLELVSGRRNSARSEEECTTTTTTSTSTDTDGNYSVYFPVQASRKLLDGDVMSLLDQKLCGEADLKEVERVCKIGCWCIQEDEVDRPTMGQVVQILEGVLDCDMPPLPRLLQRIFERPSSVSTSTPVFLFVGSPERQ

SEQ ID NO: 6694 - protein, 348 aa, Oryza sativa
  Clone ID: PAT_MRT4530_23844C.1.pep
MAMASSAYAPAGGVGTHSAPGRIRPPRGLGFSTTTTKSRPLVLTRRGGGGGNISVARLRCAASSSSAAARPMSQPRFIQHKKEAFWFYRFLSIVYDHVINPGHWTEDMRDDALEPADLYSRKLRVVDVGGGTGFTTLGIVKRVDPENVTLLDQSPHQLEKAREKEALKGVTIMEGDAEDLPFPTDTFDRYVSAGSIEYWPDPQRGIKEAYRVLRLGGVACMIGPVHPTFWLSRFFADMWMLFPKEEEYIEWFKKAGFKDVKLKRIGPKWYRGVRRHGLIMGCSVTGVKREHGDSPLQLGPKVEDVSKPVNPITFLFRFLMGTICAAYYVLVPIYMWIKDQIVPKGMPI

SEQ ID NO: 6695 - protein, 580 aa, Oryza sativa
  Clone ID: PAT_MRT4530_24032C.1.pep
MGEVAEDIYTQDGTVDVKGNPATKKNTGNWRACPYILANECCERLAYYGMSTNLVNYMKTRLGQESAIAANNVTNWSGTCYITPLLGAFLADAYMGRFWTIASFMIIYILGLALLTMASSVKGLVPACDGGACHPTEAQTGVVFLALYLIALGTGGIKPCVSSFGADQFDENDEGEKRSKSSFFNWFYFSINIGALVASSVLVYVQTHVGWGWGFGIPAVVMAVAVASFFVGTPLYRHQRPGGSPLTRIAQVLVASARKWGVEVPADGSRLHETLDRESGIEGSRKLEHTGQFACLDRAAVETPEDRSAANASAWRLCTVTQVEELKSVVRLLPIWASGIVFATVYGQMSTMFVLQGNTLDASMGPHFSIPAASLSIFDTLSVIVWVPVYDRLIVPAVRAVTGRPRGFTQLQRMGIGLVISVFSMLAAGVLDVVRLRAIARHGLYGDKDVVPISIFWQVPQYFIIGAAEVFTFVGQLEFFYDQAPDAMRSMCSALSLTTVALGNYLSTLLVTIVTHVTTRNGAVGWIPDNLNRGHLDYFFWLLAVLSLINFGVYLVIASWYTYKKTADSPDDKAEHAGAN

SEQ ID NO: 6696 - protein, 1799 aa, Oryza sativa
  Clone ID: PAT_MRT4530_24184C.1.pep
MGTGSRAVVGAAAGLGSAVLGPPSSLPPRRRAPVFRRSCRTGASTACRRRTRLRPAVSRASPIRSEDESLCVVERSPQLIEEEGRLRRALFARVSGLDMALSAGDAAAALSAALHLPAGRFSVHCAQPDHFLIVFANSGDMDLALSRSPIPAPPYQLILRPWTRLVMATSFSMPFRVSLDLEGVPAHAWNASTAAALVAPGRLISVDTPARPDEYRFLRVTISSHNPAAIPKARLLLIPEPTLGSQCLLRYRVLLHVLSVVCLSAPSASGDVDPAGGGGASGEGGGAANDGGGAANDGGGDLGARSSRAHAATSFSPLADDGRGLLLALPDATNSPAAADAITASPVDVVPPVDAGSPAADVATTCSPVAAGMPAAAVAAAGSTAPAVVAPDSPVAAVAVFSSPTVVAASSSPAASPVDIVAASSSPAAAVAAFGSPTVVVASNSLVAGSLAAVVSPVCATSPVAACHPPTASSLLSGPSGGGPAFPASPLCSRRSPLLADGIAASYAEPTGLFFDELDALAAEFGPAVPLPPRVSPVPPSASGAGTSLPRTACTPPTGGEWLRPESPLSQQAPTLVVDVPDGVLYDVPMVVLDLDGRPLAHSLPSSVADNAALHAFLTSCSRPLPPALLPPPLPLPPLAAKAVEVVPKRSECIAAKMALEALEGPIHAVSRAQRNLMRKLGLVPERGPVTAEAVAAYNALFSKPLSQEHIIALSSLFSSSLPPAKAAEELVETIMDVIPSRTILEMLGLDFDYSFLPAVGRSGGVLLASRTTVWSVSDVHLADFSLASLVRHSSDVAPWWLSVVYGPQEEPDKLRFLDELRSLRSSRTGPWAIVGDFNLILEDQDKNNLNLNRRMMGRFRRLVDELELRELPLHGRRFTWSNERESPTLVKLDRVLFSADWEELFPSCLLQAASSIASDHCALLLHTCVTSPKAHRFRFEAFWPKFDGFLQVVQDAWHPPANLPPLAALAWCFSTTAKRLQSWSDRHIGSVRLQLQMAKELVFRLDVAQESRSLSPLETWLRRDLKLKCIGLASLERTIARQRSRLVWLKEGDTNTKFFHLHARARRRKNFITCLCDGDQLAVSHDALQELASSHFCAILGTSVERELALDLHSLGLRPAQLEGLDCLFTEDEVWAVIKSLPSDKAPGPDGFTGRFYKSCWPVIKVEILAALNSLFLTNGQGFASLNDALISLLPKKDEAVDVKDFRPISLIHSFGKLFSKILASRLSPRLDELVAPNQSAFIKGRSLHDNFRYVQLAARALHAKRIPRLLLKVDIAKAFDTRGLRQGDPLSPMLFILVMDVLNAMLRKASDLGDFLPLNDRAIRHRASLYADDLVLFLSPVRQDLEFIQGILSVFGAASGLRTNFTKCSITPIRCSVLDLELVQSSFPCSISEFPCTYLGIPLSVRKLPKAALQPLVDKVSHRLPPWKGRLTTLAGRSVLVQSVLSSIPVHVSIAIGLPSWVIKAIDKKRRAFLWTGTDSANGGQCRVSWMRVCRPRDLGGLGIPDLRVAGFALRVRWLWLQRSGHPYWSDLKAPVERSVSDMFAASTFSILGDGQSTLFWTDRWIDGRSIASIAPDLLHVVPPRFRGSRTVAAGLANNSWVGDIRGALTVPVISQFLLVWDAVVPTQLSPGIEDHLVWRWTGDQCYSARSEYQAFFLGQHSFAYADLLWHAKGPAKCKFFLWFAFQQRCWTADLLQKRGIDSHSACPFCAQELETANHILIDCVFARQVWLRVLSPPRWAALSPPRGSWLQDWWSSSRVCLPEHLRSGFDSLVLLVSWQLWKERNSRVFTLRSLRS

SEQ ID NO: 6697 - protein, 98 aa, Oryza sativa
  UNSURE (1)..(98): unsure at all Xaa locations
  Clone ID: PAT_MRT4530_24833C.1.pep
  unsure (1)..(98): unsure at all Xaa locations
MLLDLHLVPSSTAAESTVSYLKMKGDYHRYLVVFKTGAVRKVAAVSTLVVYMAAQDFGLACLATTHPIRIGLSLNYSGFYYXIINSSDKACYLAMQAF

SEQ ID NO: 6698 - protein, 1294 aa, Oryza sativa
  Clone ID: PAT_MRT4530_25119C.1.pep
MVSNSFWLFILLVSFIPISAWAESRDISTLFTLRDSITEGKGFLRNWFDSETPPCSWSGITCIGHNVVAIDLSSVPLYAPFPLCIGAFQSLVRLNFSGCGFSGELPEALGNLQNLQYLDLSNNELTGPIPISLYNLKMLKEMVLDYNSLSGQLSPAIAQLQHLTKLSISMNSISGSLPPDLGSLKNLELLDIKMNTFNGSIPATFGNLSCLLHFDASQNNLTGSIFPGITSLTNLLTLDLSSNSFEGTIPREIGQLENLELLILGKNDLTGRIPQEIGSLKQLKLLHLEECQFTGKIPWSISGLSSLTELDISDNNFDAELPSSMGELGNLTQLIAKNAGLSGNMPKELGNCKKLTVINLSFNALIGPIPEEFADLEAIVSFFVEGNKLSGRVPDWIQKWKNARSIRLGQNKFSGPLPVLPLQHLLSFAAESNLLSGSIPSHICQANSLHSLLLHHNNLTGTIDEAFKGCTNLTELNLLDNHIHGEVPGYLAELPLVTLELSQNKFAGMLPAELWESKTLLEISLSNNEITGPIPESIGKLSVLQRLHIDNNLLEGPIPQSVGDLRNLTNLSLRGNRLSGIIPLALFNCRKLATLDLSYNNLTGNIPSAISHLTLLDSLILSSNQLSGSIPAEICVGFENEAHPDSEFLQHHGLLDLSYNQLTGQIPTSIKNCAMVMVLNLQGNLLNGTIPVELGELTNLTSINLSFNEFVGPMLPWSGPLVQLQGLILSNNHLDGSIPAKIGQILPKIAVLDLSSNALTGTLPQSLLCNNYLNHLDVSNNHLSGHIQFSCPDGKEYSSTLLFFNSSSNHFSGSLDESISNFTQLSTLDIHNNSLTGRLPSALSDLSSLNYLDLSSNNLYGAIPCGICNIFGLSFANFSGNYIDMYSLADCAAGGICSTNGTDHKALHPYHRVRRAITICAFTFVIIIVLVLLAVYLRRKLVRSRPLAFESASKAKATVEPTSTDELLGKKSREPLSINLATFEHALLRVTADDILKATENFSKVHIIGDGGFGTVYKAALPEGRRVAIKRLHGGHQFQGDREFLAEMETIGKVKHPNLVPLLGYCVCGDERFLIYEYMENGSLEMWLRNRADALEALGWPDRLKICLGSARGLAFLHHGFVPHIIHRDMKSSNILLDENFEPRVSDFGLARIISACETHVSTDIAGTFGYIPPEYGLTMKSTTKGDVYSFGVVMLELLTGRPPTGQEEVQGGGNLVGWVRWMIARGKQNELFDPCLPVSSVWREQMARVLAIARDCTADEPFKRPTMLEVVKGLKMTHGMECGPLVVTVSRDM

SEQ ID NO: 6699 - protein, 579 aa, Oryza sativa
  Clone ID: PAT_MRT4530_25375C.1.pep
MGSCNENILVWNVRGLDFDYSFLPAVGRSGGVLLAWRTTVWSVSDVHLAEFSLTALVRHSSDVAPWWLSVVYGPQEEPDKLRFLDELRSLRSSRTGPWAVVGDFNLILEAQDKNNLNLNRRMMGRFRRLVDELELRELPLHGRRFTWSNERESPTLVKLDRVLFSADWEELFPSCLLQAASSIASDHCALLLHTCVTSPKALRFRFEAFWPKFDGFLQVVQDAWHPPANLPPLAALAWCFSTTAKRLQSWSDRHIGSVRLQLQMAKELVFRLDVAQESRSLSSLETWLRRDLKLKCLGLASLERTIARQRSRLVWLKEGDANTKFFHLHARARRRKNFITRLCDGDQLAVSHDALQELASSHFCAILGTSVERELALDLHSLGLRPAQLEGLDCPFTEDEVWAVIKSLPSDKAPGPDDFTGRFYKSCWPVIKVEILAALNSLFLTNGQGFASLNDALISLLPKKDEAVDVKDFRPISLIHSFGKLFSKILASRLSPRLDELVAPNQSAFIKGRSLHDNFRYVQLAARALHAKRVPRLLLKVDIAKAFDTVSWPFLLEVHGSPIGEVFAKEILFPPCFSF

SEQ ID NO: 6700 - protein, 135 aa, Oryza sativa
  Clone ID: PAT_MRT4530_25382C.1.pep
HASAHASGGGVGGGSGSSGGYGYGAGYRSAGGGYYDSTAYGYGRGGYGYGGNAGFGSGYGGGYGGSLYGGAYGAYGAYGGGAYGGGAYGGGAYGGGAYGGAPGAYGGAGGYGSYGGAGAAGAGGRGSSRYHPYGK

SEQ ID NO: 6701 - protein, 382 aa, Oryza sativa
  Clone ID: PAT_MRT4530_25494C.1.pep
MVVPSATTPARQETVVAAAPPAAAASGVVGGGGGVTIATVDMSAERGAVARQVATACAAHGFFRCVGHGVPAAAPVAARLDAATAAFFAMAPAEKQRAGPASPLGYGCRSIGFNGDVGELEYLLLHANPAAVAHRARTIDAMDPSRFSAIVNEYIEAMKKLACEILDLLGEGLGLKDPRYFSKLTTNADSDCLLRINHYPPSCNIHKLDHDDQCNIKSLVSTKASNGGNLMAGGRIGFGEHSDPQILSLLRANDVEGLQVFVPDHEGKEMWVQVPSDPSAIFVNVGDVLQALTNGRLISIRHRVIATACRPRLSTIYFASPPLHARISALPETITASSPRRYRSFTWAEYKTTMYSLRLSHSRLELFKIDDDDSDNASEGKA

SEQ ID NO: 6702 - protein, 403 aa, Oryza sativa
  Clone ID: PAT_MRT4530_25496C.1.pep
MVVPSATTPARQETVVAAAPPAAAASGVVGGGGGVTSSTGDMSAERGAVARHFFTACAAHGFFRCVGHGVPAAAPVAARLDAATAAFFAMAPAEKQRAGPASPLGYGCRSIGFNGDVGELEYLLLHANPAAVAHRARTIDAMDPSRFSEICLHISASEYCSGVMQRSISAIVNEYIEAMKKLACEILDLLGEGLGLKDPRYFSKLTTNADSDCLLRINHYPPSCNIHKLDHDDQCNIKSLVSTKASNGGNLMAGGRIGFGEHSDPQILSLLRANDVEGLQVFVPDHEGKEMWVQVPSDPSAIFVNVGDVLQALTNGRLISIRHRVIATACRPRLSTIYFASPPLHARISALPETITASSPRRYRSFTWAEYKTTMYSLRLSHSRLELFKIDDDDSDNASEGKA

SEQ ID NO: 6703 - protein, 911 aa, Oryza sativa
  Clone ID: PAT_MRT4530_25684C.1.pep
MGQPVTQQNFKMGQPVTQQNFLKKCWPWESNPQPSVSRAMLHIILYIMFISSKETNLTGRQPSYLSPYRSPLLATPISASTAAVRLLRHRREHHRSAVVLLLVERSFEGSAGVLTGAWGSGLAGAGSGGSSGTLEKRGERCAGQAKRRSQRRTGRAERRVKWPTMDRSWINSKRFSNEYMDGVNEFMTFLSERFGDDEEMLCPCRRCLNRVPQFKGRVHDHLHIHGMATTYTRWIHHGEPLKVVPHEIDDHVDEDTSLNEDFDMNVDEEDDPDDGIHGMVEELYTAEEEGQGKKSMFAILLEEMKQELYPGGPCTRWKDNGGRKKIPEKVLRHFPLIPRLKRIFSSKRTAEEVQWHKLKRKPVENELSHPADGESWKDFDRKYGWFAEDARNIRLGLATDGFNPFGKMSFSYSMWPVFLIPYNFPPWECVEQSNFIMGLLIPGRECPGKDIDVFLEPLIEELLELWKGVPTVDVLTKKKFDLHAAVIWCIHDYPGLSTLSGRVTRGYYACVHCDKNACSKRIRNKICYIGHRRFLARDHPWRRSKVFDGNVENCEKPEKFTTDELMEQLERVKDVRPGKHPESKKRKRDEEGQCWKRRSCLWDLPYWSSLKLRHNLDVMHIEKNICEYILGTFLGIAGKSKDSTNSRLDLEDMGIRKHLHLIRDGDSYSAPHAPYTMTKTQKADFCDFLKSVKFPNGYASNLATCVTADGCNLQGLKTHDCHILLQRIIPAAVRGIMPKDINEALAELGNFFQQLCAKTLNLDVLERLKANVPIILCKLEKIFPPSFFDVMLHLAVHLPEEAILRGPVQYGWMYPIERRLLTLKRFVRNMARLEGSIAEAYVAAECLTICSKYFGDDVDMYHHQITNLLTFNKYHTDGSIAVIQSTYHIHPTDFNAPKPYNPECREEAQVA

SEQ ID NO: 6704 - protein, 183 aa, Oryza sativa
  Clone ID: PAT_MRT4530_25685C.1.pep
MLNLIKIKDKKKEQAASAAGKAPVKKQSAGELRLHKDISELNLPKSTSISFPNGKDDLMNFEIIVRPDEGYYLGGTFVFTFQVSPSYPHEPPKVKCKTKVYHPNIDLEGNVCLNILREDWKPVLNINTVIYGLNLLFTQPNDEDPLNHEAAAVLRDNPKLFEANVKRAMAGGYVGQHYFPRCA

SEQ ID NO: 6705 - protein, 173 aa, Oryza sativa
  Clone ID: PAT_MRT4530_26068C.1.pep
MSRHPSTKWAQRSDKVFLTIELPDARDVKLNLKPEGQFIFSAKGPADDTPYELDLELFDAVNVEESKAAVAARSICYLIKKAESKWWPRLLKKEGKPPVFLKVDWDKWQDEDDEDIGLGDFGDMDFSKLGMGGPDDDLEDDDEDDTADSANKDDEDIKAEGSGEQEAAGEAKP

SEQ ID NO: 6706 - protein, 186 aa, Oryza sativa
  Clone ID: PAT_MRT4530_26070C.1.pep
MSRHPSTKWAQRSDKVFLTIELPDARDVKLNLKPEGQFIFSAKGPADDTPYELDLELFDAVNVEESKAAVAARSICYLIKKAESKWWPRLLKKEGKPPVFLKVDWDKWQDEDDEDIGLWRELTVHFLLVAVGDFGDMDFSKLGMGGPDDDLEDDDEDDTADSANKDDEDIKAEGSGEQEAAGEAKP

SEQ ID NO: 6707 - protein, 173 aa, Oryza sativa
  Clone ID: PAT_MRT4530_26127C.1.pep
MANDSLTRSHIVGDVLDQFSNSVPLTVMYDGRPVFNGKEFRSSAVSMKPRVEIGGDDFRFAYTLVMVDPDAPNPSNPTLREYLHWMVTDIPSSTDDSFGREIVTYESPSPTMGIHRIVMVLYQQLGRGTVFAPQVRQNFNLRSFARRFNLGKPVAAMYFNCQRPTGTGGRRPT

SEQ ID NO: 6708 - protein, 449 aa, Oryza sativa
  Clone ID: PAT_MRT4530_26698C.1.pep
MWRGGATAASAARALRSRLIPDTSHHPATALAPIASPRSSSSSSSSSAPTIAAAVPAVAEATAAAAAVSRQAGSVSDALRHYGRCYFELSKARLSFQGCISNNSVNCRRALVVATSGAGYVLGSGNMVDIAGLCCTCAGTMMVAASANTLNQVFEIKNDAKMKRTMRRPLPSGRISPAHAAMWATSVGVAGTALLAWKANGLAAGLAASNLILYAFVYTPLKQIHPVNTWVGAVVGAIPPLLGWAAASSELSLNAMILPAALYYWQIPHFMALAYLCRNDYLAGGYRMFSFADPTGKRTAWVSLRNCLYMLPLGFFAYNWGLTSEWFSLEASLLTLGLTIGALSFVLEPTPKTARRMFYGSLLYLPAFMAGLLLHRLPNEQKEHNVTQTSEITGILYGAEQQDEERARQKREDRKPSRIHSRPPVAYASVAPFPFLPVPIYVSTQGHEL

SEQ ID NO: 6709 - protein, 375 aa, Oryza sativa
  Clone ID: PAT_MRT4530_2675C.1.pep
MAAAEARAAWQRAANRCIVQEDRKRAPKLACCPPSSEQQHVKSNGNCRNSEDRPVPNFMPLSWNPMNSSLPPDIRWWLQLQPNLGGQKNLAGLQDLKNIGGYSQVPSKCKENASDCLFNDKEFLDFKNFNPPPSKNPQKDDFDMNAPWKGGERSQPWWQITDENELALLVAERAMQHIENCDLPRPTQIVRVQGTESRSHENMGRYRGNVARSDAQDFSRGINTEPRGKRTYQNPAEQAQLLEALCHSQTRAREAEMAGKKAQSEKDDVIKLFFRQASHLFACKQWLKMLQLENICLQLKHREHQIATMIPDIPWITLKKRTTPDHEKEDWTRKKGRRHKNAGSFCDALLFAVGLGLAGAGLLLGWTFGWLLAKF

SEQ ID NO: 6710 - protein, 824 aa, Oryza sativa
  Clone ID: PAT_MRT4530_26806C.1.pep
MAPPCSSALVLPCLLVIAMAALQSAVVFADTVTAKRPLSGSQSALVSKRRKFALGFFQPENSQHWYLGIWYNQISKHTPVWVANRGTPISNPDTSQLTIATDGNMVLLDNSTTAIWSTNISKIASNSTVGVILDTGNLVLADESNTSIIHWQSFDHFGNTWLPGGKLGRNNKLAGVSTRLVAWKARNDPSPGVFSLELDPNGTSQYLLEWSITQQYWTSGNWTGRIFADVPEMTGCYPSSTYTFDYVNGENESESYFVYDLKDESVLTRFFLSEMGQIQFLTWIYAAKDWMPFWSQPKVKCDVYSLCGPFSVCTENALTSCSCLRGFSEQNVGEWLQGDHTSGCRRNVELQCSSNASVMGRTDGFYTMANVRLPSNAESVVVIGNDQCEQACLRSCSCTAYSYNGSCSLWHGDLINLQDVSAISSQGSSTVLIRLAASELSGQKQKNTKNLITIAIVATSVLVLMIAALFFIFRRRMVKETTRVEGSLIAFTYRDLKSVTKNFSEKLGGGAFGLVFKGSLPDATVVAVKKLEGFRQGEKQFRAEVSTIGNIQHVNLIRLLGFCSEKSRRLLVYEYMPNGSLDKQLFDNKKHVLSWNTRYQIALGIARGLDYLHEKCRDCIIHCDIKPENILLDGSFAPKVADFGLAKLMGRDISRVLTTARGTVGYIAPEWIAGTAVTAKADVFSYGMTLLEIVSGRRNVQGRRRRQEQQDDGGAAADRPFPLVAAGRLVGGGGGRREELVSAVVDGRLGGDADMGEAERACRVAFWCIQDDENARPAMATVVQVLEGLVEIGVPPIPRSLQFLAELADQSNYLQFFSDLLPSN

SEQ ID NO: 6711 - protein, 523 aa, Oryza sativa
  Clone ID: PAT_MRT4530_26969C.1.pep
MAGAEAANGRNKYAVLDPSDEPEGRRRPSAWERRSKERFVLACAIFASLNAILLGYDVGVMSGAIIYIQKDLHITEFQEEILVGCLSVVSLLGSLSGGRTSDAIGRKWTMALGAIVFQAGAAIMTFAPSFTVLMIGRLLAGVGIGFGAMVSAVYIAEISPAAARGTLTSLPEICINLGILLGYVSNYAFSGLSEHINWRIMLGVGILPSVFIGFALFVIPESPRWLMMEKRVPEARAVLLQISESEAEVEERIAEIEEAANLLKSTKSEDKAVWMELLNPSPAVRRMLYAGCGIQMFQQITGIDATVYYSPTIFRDAGIKSDQELLAATVAVGFTKTVFILVAIFLIDKVGRKPLLYVSTIGMTMCLFVLGIALTLQKHAMGLISPRIGIDLAVFAVCGNVAFFSIGMGPICWVLSSEIFPLRLRAQASALGQVGGRVSSGLVSMSFLSMARIISVAGMFFVFAVISTVSVAFVYFCVPETKGKTLEQIEMMFEGGKEWRGSEIELEDTQHLIQSSKKSVSLG

SEQ ID NO: 6712 - protein, 34 aa, Oryza sativa
  Clone ID: PAT_MRT4530_27304C.1.pep
LIPRRAHKHTPAFLYATAGVRKLPSADSEWLLDK

SEQ ID NO: 6713 - protein, 397 aa, Oryza sativa
  UNSURE (1)..(397): unsure at all Xaa locations
  Clone ID: PAT_MRT4530_27531C.1.pep
  unsure (1)..(397): unsure at all Xaa locations
WPPPTSSPPPPPPPPPPRLFPLPPPSPAPPPHLLAASSSTAASSATPRPPRLSLRSPPPSSLRPSQRPHFPVVSAAGTAKKTTTNGTEKATSGGYXLSQRLGIKCSEEEIDMXMTRVQFTKPVKLLPLVXCVLYGVADSGNYQWTVEXGARSVVCMLLSCSCLPGITQRDIDWRYFKRDIDALNEPYLPIXVLALIWALLLAGLGLGALLDVWAGHDFPIIFYLAVGGSLLSYIYSAPPLKLKQNGWIGNFALGASYIGLPWWAGQALFGTLTPDIVVLTSLYSIAGLGIAIVNDFKSVEGDRALGLQSLPVAFGMETAKWICVGAIDITQLSVAGYLFSSGKPYYALALLGLTIPQVVFQFQYFLKDPVKYDVKYQASAQPFFVLGLLVTALATSH

SEQ ID NO: 6714 - protein, 662 aa, Oryza sativa
  Clone ID: PAT_MRT4530_27544C.1.pep
METRDDVADASALPYSYSPLPAGDAASADLAAARRSRRRPLCVALFLASAAVILAVAVLSGVRLAGRPATTTMVVPGVVEMEMASRGPESGVSEKTSGAEEMVRLMGGAAGGEAFPWSNAMLQWQRTGFHFQPERNWMNDPNGPVYYKGWYHLFYQYNPDGAVWGNKIAWGHAVSRDLVHWRHLPLAMVPDQWYDVNGVWTGSATTLPDGRLAMLYTGSTNASVQVQCLAVPSDPDDPLLTNWTKYHANPVLYPPRTIGDRDFRDPTTAWRDPSDGDWRIVIGSKDEHHAGIAVVYRTADFVTYDLLPGLLHRVEATGMWECIDFYPVAGGEGVDMTEAMYARNKGVVHVMKASMDDDRHDYYALGRYDPARNAWTPLDAAADVGIGLRYDWGKFYASKTFYDPAKRRRVLWGWVGETDSERADVAKGWASLQSIPRTVELDTKTGSNLLQWPVEEVETLRTNSTDFGGITVDYASVFPLNLHRATQLDILAEFQLDPLAVDAVLEADVGYNCSTSGGAAGRGALGPFGLLVLADKRHRGDGEQTAVYFYVAKGSDGGVTTHFCQDESRSSHADDIVKRVVGNVVPVLDGETFSLRVLVDHSIVESFAQGGRSTATSRVYPTEAIYANAGVFLFNNATSARVTAKKLVVHEMDSSYNQAYMA

SEQ ID NO: 6715 - protein, 557 aa, Oryza sativa
  Clone ID: PAT_MRT4530_27686C.1.pep
MEAKPVAMEVEGVEAAGGKPRFRMPVDSDLKATEFWLFSFARPHMASFHMAWFSFFCCFVSTFAAPPLLPLIRDTLGLTATDIGNAGIASVSGAVFARLAMGTACDLVGPRLASASLILLTTPAVYCSSIIQSPSGYLLVRFFTGISLASFVSAQFWMSSMFSAPKVGLANGVAGGWGNLGGGAVQLLMPLVYEAIHKIGSTPFTAWRIAFFIPGLMQTFSAIAVLAFGQDMPGGNYGKLHKTGDMHKDSFGNVLRHALTNYRGWILALTYGYSFGVELTIDNVVHQYFYDRFDVNLQTAGLIAASFGMANIISRPGGGLLSDWLSSRYGMRGRLWGLWTVQTIGGVLCVVLGIVDFSFAASVAVMVLFSFFVQAACGLTFGIVPFVSRRSLGLISGMTGGGGNVGAVLTQYIFFHGTKYKTETGIKYMGLMIIACTLPVMLIYFPQWGGMLVGPRKGATAEEYYSREWSDHEREKGFNAASVRFAENSVREGGSVSIAKVVDSLGTVARNVKVLRLYELQILSKSEEQCQASAFVRSKCRARAQCGSWPRGLSGVQ

SEQ ID NO: 6716 - protein, 513 aa, Oryza sativa
  Clone ID: PAT_MRT4530_27817C.1.pep
RIRGVSVLYKSVQFFPCNSDVGCDPSKVGTDNGAQPCQYQVVVSEYSAKGSSANISEVTSADPSEVTRIFTMGLPYTSQHGGQILFGPTDGYLYLMMGDGGGKGDPFNFSQNKKSLLGKIMRLDVDNPPSKSSSTGQSEIANQSLWGNYSIPKDNPYTDDSDLEPEVWALGLRNPWRCSFDSARPSYFYCADVGQDQYEEVDLISKGGNYGWRAYEGPLVFNPPSAPGGNTSLNSINAIPPIMGYSHSDVNKKIGSASIIGGNVYRGSTDPCLVGRYLYADLYASAMWTGTEAPESSGNYSSSLISFSCSKSSPIACDTAAGSPLPSLGYIYSFGEDNNKDTYVLSSKGVYRVVRPSLCGYTCPTEKPATNTGTTTPSSAASSSILSDVEINGFYLELKVLQVSLPDSSMFVPEILKFVMDALLDCPDRLLDCYPNVSVAYRILLTVPMTVASAERSLSKLRLLKNYLRSTMSQERLNGLVMCSIENDILDTIDLNTVLDDFASRNIQRSIFS

SEQ ID NO: 6717 - protein, 274 aa, Oryza sativa
  UNSURE (1)..(274): unsure at all Xaa locations
  Clone ID: PAT_MRT4530_28152C.1.pep
  unsure (1)..(274): unsure at all Xaa locations
GCRNRHEGDTSSQFASRTHSPFASRRGGRAFSAARXMAGAAAAVEDAGMDEVQKRLMFDDECILVDEQDNVVGHESKYNCHLMEKIESENLLHRAFSVFLFNSKYELLLQQRSATKVTFPLVWTNTCCSHPLYRESELIQENYLGVRNAAQRKLLDELGIPAEDVPVDQFTPLGRMLYKAPSDGKWGEHELDYLLFIVRDVKVVPNPDEVADVKYVSREQLKELIRKADAGEEGLKLSPWFRLVVDNFLMGWWDHVEKGTLNEAVDMETIHKLK

SEQ ID NO: 6718 - protein, 168 aa, Oryza sativa
  UNSURE (1)..(168): unsure at all Xaa locations
  Clone ID: PAT_MRT4530_28392C.1.pep
  unsure (1)..(168): unsure at all Xaa locations
ADEWQKFYRGWMKLNVDGXFDATSGTGGLGAVLRNSLGSVILSFFSACGSMERCSSPLEAELLACKEGINLALQWALLPLIMESDCLVAINMIQSPGREMSQLAYLVRDIEELLAGDRVVSIQKVQRCQNNISHFLANRGRTNFLSEFWPDGSCNLISQFVNEEALNE

SEQ ID NO: 6719 - protein, 119 aa, Oryza sativa
  UNSURE (1)..(119): unsure at all Xaa locations
  Clone ID: PAT_MRT4530_28680C.1.pep
  unsure (1)..(119): unsure at all Xaa locations
LIFQDKNKYNTRGXLFVVRCTIKDITGQIISASIAGDMDLASAYSHELPRYGLEAGLTNYAAAYCTGLLLARRVLKIRGSDQEYKGNVEATGEDFFVEPAYERRPFRALLDVGLIRTTT

SEQ ID NO: 6720 - protein, 760 aa, Oryza sativa
  UNSURE (1)..(760): unsure at all Xaa locations
  Clone ID: PAT_MRT4530_29154C.1.pep
  unsure (1)..(760): unsure at all Xaa locations
MQQHQGGGSQYGAVPPDMGPFSPTHHASAPAPLPLSSRPPPAALSQPPPPQQQQQQPRTSYDELAAATSAGAGGFPDDDMLGDAGGSGGGGGSGAAGNRWPREETLALIRIRSEMDATFRDATLKGPLWEEVSRKLAELGYKRSAKKCKEKFENVHKYYKRTKEGRAGRQDGKSYRFFTELEALHAAAPQTPQPQQQQQQQLPPVTSSAPAMHAFAPPVPAPPPMSAMPPPPGPIQPAPISSAAPAVPLELPPQPPINLQGLSFSSMSGSESDDESEDDEMTAETGGSQDRLGKRKXAPAAKGWRLSSRGSSSKSSTGRRRCSGGFWRLWRSERRSARXREEAWRRQEVARLNREQEQLAQERAAAASRDAAIISFLQRIGGQSVQVPPAATVIQMPTPVQLQTPPPVKQPARQHQPQPTPPPPQAAPIPAAPLQQQPPQPQHKETIPPEAVTPRRAPPTSGSSLELVPAAEQHVESGLGGGEGGSASSSRWPKTEVQALIQLRMELDMRYQETGPKGPLWEEISSGMRRLGYNRSSKRCKEKWENINKYFKKVKESNKKRPEDSKTCPYFHQLDVIYRRKHLTGGGGGGASAANVAATAIEHQNPNRHEIEGKNINDNDKRKNGGGGGAQVPTSNGDTAPTTATFDVDSGMKKRFKLNMRMFVRKLTGNPLAVKPEDIVRELSEQPPREFTTDETDSDDMGDDYTDDGEEGEDDGKMQYRIQFQRPNPGGANTAPPPATTPASAVPTSTPTSTFLAMVQ

SEQ ID NO: 6721 - protein, 332 aa, Oryza sativa
  Clone ID: PAT_MRT4530_29234C.1.pep
MSSRMAGSAILRHVGGVRLFTASATSPAAAAAAAARPFLAGGEAVPGVWGLRLMSTSSVASTEAAAKAEAKKADAEKEVVVNSYWGIEQSKKLVREDGTEWKWSCFRPWETYTADTSIDLTKHHVPKTLLDKIAYWTVKSLRFPTDIFFQRRYGCRAMMLETVAAVPGMVGGMLLHLRSLRRFEQSGGWIRTLLEEAENERMHLMTFMEVANPKWYERALVITVQGVFFNAYFLGYLLSPKFAHRVVGYLEEEAIHSYTEFLKDLEAGKIDNVPAPAIAIDYWRLPANATLKDVVTVVRADEAHHRDVNHFASDIHYQGMELKQTPAPIGYH

SEQ ID NO: 6722 - protein, 519 aa, Oryza sativa
  Clone ID: PAT_MRT4530_29468C.1.pep
MAGGAMVQTVGGKTYPGKMTAFVFFTCLVASSGGLIFGYDIGISGGVTSMDSFLSEFFPSVYAQAKASKDTNQYCKFDSQLLTLFTSSLYLAALATSFVAAWVTRVFGRKWSMFCGGVTFLAGSALNGAATDVMMLILGRILLGIGVGFANQSVPLYLSEMAPANLRGMLNIGFQLMTTIGILSANLINYATSSIEGGWGWRIGLGLAGVPALIITLGALVLPDTPNSLIARGYAGDAKRVLVKIRGTDDVHDEYDDMVAASEEAASIEHPWRNILHRKYRPQLTIAILIPCFQQLTGINVIMFYAPVLFLTIGFAGDASLMSAVITGLVNMFATVVSIISVDRLGRRVLFLQGGTQMFISQVVVGTLIALQFGVAGVGEMSRSYAILLVLFICMYVAGFAWSWGPLGWLVPSEVFALEIRSAGQSIAVCVNMMLTFVIGQAFLTMLCHLKFGLFYFFAGWMLVMTTFVALFLPETKGVPIEEMNHVWSRHWFWGSYVTAHDVAGAGAGGGGNRRSHNV

SEQ ID NO: 6723 - protein, 473 aa, Oryza sativa
  Clone ID: PAT_MRT4530_29514C.1.pep
MDQHQLDEENQRAALFHSSAPSSSLGADGEEERETVPLLSCKMADDKSDTVQVSEDTAHQISIDPWYQVGFILTTGVNSAYVLGYSASIMVPLGWIGGTCGLILAAAISMYANALLAHLHEVGGKRHIRYRDLAGHIYGRKMYSLTWALQYVNLFMINTGLIILAGQALKAIYVLFRDDGVLKLPYCIALSGFVCALFAFGIPYLSALRIWLGLSTVFSLIYIMIAFVMSLRDGITTPAKDYTIPGSHSDRIFTTIGAVANLVFAYNTGMLPEIQATIRPPVVKNMEKALWFQFTVGSLPLYAVTFMGYWAYGSSTSSYLLNSVKGPIWIKTVANLSAFLQTVIALHIFASPMYEFLDTRFGSGHGGPFAIHNIMFRVGVRGGYLTVNTLVAAMLPFLGDFMSLTGALSTFPLTFVLANHMYLTVKQNKMSIFRKCWHWLNVVGFSCLSVAAAVAAVRLITVDYSTYHLFADM

SEQ ID NO: 6724 - protein, 447 aa, Oryza sativa
  Clone ID: PAT_MRT4530_29596C.1.pep
MGAKDSKPSYSYSSSYDHGNSSSGYNSRYPAYPANASSSQNTRYAPSMENYVQPETHARLQRKYSRIGDDYRSLNQVTEALAQAGLESSNLIVGIDFTKSNEWTGKLSFNRRCLHDIGNTPNPYEQAISIIGRTLSAFDEDNLIPCFGFGDASTHDQEVFSFYPENRPCNGFEEALERYREIVPTLRLAGPTSFAPMIETAIGIVDSTGGQYHVLLIIADGQVTRSVDTQSGQLSPQERDTIDAIVKASQFPLSIVLVGVGDGPWDMMHQFDDNIPARSFDNFQFVNFTDIMSKSIAADRKEAEFALSALMEIPTQYKATLDLQLLGRRQRIQPRIPLPPPMRNAYSRSTSFDQHSGVYSRSSSFGPQTSGFQQSESFKQRQPVATTAPDTYTSESSLEGRLLCAICMDKSKDLAFGCGHQTCYECGKNLVRCPMCQQHITTRIRLY

SEQ ID NO: 6725 - protein, 505 aa, Oryza sativa
  Clone ID: PAT_MRT4530_29796C.1.pep
MAAPSAIPRRGLFIGGGWREPSLGRRLPVVNPATEATIGDIPAATAEDVELAVSAARDAFGRDGGRHWSRAPGAVRAKYLKAIAAKIKDKKSYLALLETLDSGKPLDEAAGDMEDVAACFEYYADLAEALDGKQRAPISLPMENFESYVLKEPIGVVGLITPWNYPLLMATWKVAPALAAGCTAVLKPSELASLTCLELGGICAEIGLPPGVLNIITGLGTEAGAPLASHPHVDKIAFTGSTETGKRIMITASQMVKPVSLELGGKSPLIVFDDVDIDKAVEWAMFGCFANAGQVCSATSRLLLHEKIAKRFLDRLVAWAKSIKISDPLEEGCRLGSVVSEGQYQKIMKFISTARCEGATILYGGARPQHLKRGFFIEPTIITNVSTSMQIWREEVFGPVICVKEFRTEREAVELANDTHYGLAGAVISNDLERCERISKAIQSGIVWINCSQPCFVQAPWGGNKRSGFGRELGQWGLDNYLSVKQVTKYCSDEPYGWYRPPSKL

SEQ ID NO: 6726 - protein, 96 aa, Oryza sativa
  UNSURE (1)..(96): unsure at all Xaa locations
  Clone ID: PAT_MRT4530_30009C.1.pep
  unsure (1)..(96): unsure at all Xaa locations
KTHAYFKRLHSKFKRXRRQGTTDYRAXRIRLSNQDKNKANTPAYRFVARCTHKDLTFEIVYATIEDDIVMAAAYCHEQPRYGLEVGLTNYARAYCT

SEQ ID NO: 6727 - protein, 60 aa, Oryza sativa
  UNSURE (1)..(60): unsure at all Xaa locations
  Clone ID: PAT_MRT4530_30384C.1.pep
  unsure (1)..(60): unsure at all Xaa locations
CPCPPPPPPPPPPPPCGPSEMSPPPNXAPPPPPPLAAASSTTTTAPXPPPPPPPTGRNLL

SEQ ID NO: 6728 - protein, 801 aa, Oryza sativa
  Clone ID: PAT_MRT4530_3082C.1.pep
MCSRDETVLGSFRSRTSRTRISLTVAIGSSNDGLDKSIKPFHFYLVLAVAIFKAFCALREHFLPAEQVILGASQKDTMLAVSQMDSQDQTVKSNAGSASPNQLTDVNDHSNVSRQYDTSPSSHQECWRSEDLNRYACSDDSKESGHLKKSLSLGNMLHKDHDHHFSEGAECDIIDCDHKGHCSSLKSNSAVGDSAKLNTKGNENAFDALSDLVSPSGDHVVDSDSHYLCYDQTKFPRSQSAIFQNNSNCGTEGSADSEILGPRCRSYEDLCSAVSEKVDYLNSDLCSAVSEKVDYLNSVEPHHSKSNLDVHCAGPSSPDVYERMNFEDNGSIGCSDAADGGQRSTASAEESFVRDGMLSHEYWDNKYVSGHQSVDPVAPYYSGTGDGSHHSNNDGGINEALDQERKDNLWNRDSTPYHKSLVIDASDLKLCDSKDISEELKHNRTGINDNQYFDVDPDELSPRTFSIKRIEDWINQIDIDDGTLVEEQGESSNSVLTKYNEPVAGVPAVRPDAKSPLGMEIAYTYISKLTPTSSSAQLGNLGLVAIPRLSAFLGLRLLNLSGNSIVRITAGALPRGLHMLSLSKNNISTIEGLRELTRLRLLDISYNRISRIGHGLASCSSLKELYLGGNKISEVDGLHRLLKLKVLDLRHNKISTSKGLGQLAANYSSLEAVNLDGNPAQKNVGDEHLKKYLVGLLPNLGFYNKHPIRASGSKEVSDRHTRKISSSHRSDRSGRSDRKSSRLVASTSSYKAQSSRHARSGHASSSFLKNPRGRSMAVAASGPRLMEYGGAGDVQIERKAQ

SEQ ID NO: 6729 - protein, 319 aa, Oryza sativa
  Clone ID: PAT_MRT4530_3088C.1.pep
MAIKRTKAEKKVAYDKKLCQLLDEYTKVLIAVADNVGSNQLQEIRKGLRGDSIVLMGKNTLIRRCIKVHADNTGNKEFLELMPLLVGNVGLIFTKGDLKEVREEVAKYKVGAPARVGLVAPVDVVVPPGNTGLDPSQTSFFQVLNIPTKINKGTVEIITPVELIKKGDKVGSSESALLAKLGIRPFSYGLVITNVYDSGSVFSPEVLDLTEDDLMEKFASGVSMVASVSLAISYPTIAAAPHMFLNGYKNVLAVAVETEYSYPHADKIKEYLKDPSKFAVAAPVAADSGAAAPSAAKEEEKKEEPEEESDGDLGMSLFD

SEQ ID NO: 6730 - protein, 470 aa, Oryza sativa
  Clone ID: PAT_MRT4530_3089C.1.pep
MAIKRTKAEKKVAYDKKLCQLLDEYTKVLIAVADNVGSNQLQEIRKGLRGDSIVLMGKNTLIRRCIKVHADNTGNKDFLELMPLLVGNVGLIFTKGDLKEVREEVAKYKVGAPARVGLVAPVDVVVPPGNTGLDPSQTSFFQVLNIPTKINKGTVEIITPVELIKKGDKVGSSESALLAKLGIRPFSYGLVITNVYDSGSVFSPEVLDLTEEDLMEKFASGVSMVASVSLAISYPTIAAAPHMFLNGYKNVLAVAVETEYSYPHADKIKEYLKDPSKFAVAAAVAAADSGAAAPAASKEEEKKEEPEEESDVRCRYVHQARLPILTVDFRLDGSGEEEAAAPLLLLPAAAAAAEERCPGCVQEQRKARRGGRIPYTELFFVAVTTLASFIAGEMDEMKGIDHEHALPITCLFPFLYFMVRDLQVAQTEEDIGNYAGFLGALNGLLAPIKVNTAWGLGLVVGPALGGYLAQ

SEQ ID NO: 6731 - protein, 138 aa, Oryza sativa
  Clone ID: PAT_MRT4530_31692C.1.pep
MAGKGGKGLLAAKTTAAKSADKDKDKKKAPVSRSSRAGLQFPVGRIHRQLKSRASAHGRVGATAAVYSAAILEYLTAEVLELAGNASKDLKVKRITPRHLQLAIRGDEELDTLIKGTIAGGGVIPHIHKSLINKTSKE

SEQ ID NO: 6732 - protein, 339 aa, Oryza sativa
  Clone ID: PAT_MRT4530_31733C.1.pep
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAK

SEQ ID NO: 6733 - protein, 359 aa, Oryza sativa
  Clone ID: PAT_MRT4530_31736C.1.pep
MDHEADAYRTDLMTITRYVLNEQSRNPEARGDLTILLSHIVLGCKFVASAVNKAGLAKLIGLAGETNVQASVPGNNCHLSQFLVSEIEIGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAK

SEQ ID NO: 6734 - protein, 355 aa, Oryza sativa
  Clone ID: PAT_MRT4530_32113C.1.pep
MENGGGGGGDGGKSDVPADANEHCPGTQSEEAGKADACAGCPNQQICATAPKGPDPDLVGIVERMATVKHKILVLSGKGGVGKSTFSAQLSFALAEMDCQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEINFCKKVGVPILGVVENMSGLRQVLSDFRFVKQGEGGEMDATEWALNYIKEKAPELLTMVACSEVFDSSKGGAEKMCNEMGVPFLGKVPMDPQLCKAAEEGRSCFVDQKCSASAPALKSIVKKLIENQD

SEQ ID NO: 6735 - protein, 174 aa, Oryza sativa
  Clone ID: PAT_MRT4530_32262C.1.pep
MSKARVYTDVNVLRPKEYSDYESLTLQWGDQDDYEVVRKVGRGKYSEVFEGINVNSNERCIIKILKPVKKKKIKREIKILQNICGGPNIVKLLDIVRDQHSKTPSLIFEYVNSTDFKVLYPTLTDYDIRYYIYELLKALDYCHSQGIMHRDVKPHNVMIDHELRKLRWIDWGLG

SEQ ID NO: 6736 - protein, 119 aa, Oryza sativa
  Clone ID: PAT_MRT4530_32410C.1.pep
MSTTRGVSSSSAAAALALLLLFALCFFSFHFAAAARAVPRDEHQENGGVKAVAAVAADQLVLQLEGDTGNGDEVSELMGAAEEEAAACEEGKNNDECVQRRLLSDAHLDYIYTQHKNKP

SEQ ID NO: 6737 - protein, 469 aa, Oryza sativa
  Clone ID: PAT_MRT4530_32481C.1.pep
MEVLLPLLLACSLLFTIATPIRDITDVCASQISDFQHLNSSGLHLTLHHPQSPCSPAPLPSDLPFSAVVTHDDARIAHLASRLANNHPTSPSSSSLLHGHRKKKAGGVGGSQASSSSVPLTPGASVAVGNYVTRLGLGTPATSYVMVVDTGSSLTWLQCSPCSVSCHRQAGPVFDPRASGTYAAVQCSSSECGELQAATLNPSACSVSNVCIYQASYGDSSYSVGYLSKDTVSFGSGSFPGFYYGCGQDNEGLFGRSAGLIGLAKNKLSLLYQLAPSLGYAFSYCLPTSSAAAGYLSIGSYNPGQYSYTPMASSSLDASLYFVTLSGISVAGAPLAVPPSEYRSLPTIIDSGTVITRLPPNVYTALSRAVAAAMASAAPRAPTYSILDTCFRGSAAGLRVPRVDMAFAGGATLALSPGNVLIDVDDSTTCLAFAPTGGTAIIGNTQQQTFSVVYDVAQSRIGFAAGGCS

SEQ ID NO: 6738 - protein, 700 aa, Oryza sativa
  UNSURE (1)..(700): unsure at all Xaa locations
  Clone ID: PAT_MRT4530_32658C.1.pep
  unsure (1)..(700): unsure at all Xaa locations
MASETETFAFQAEINQLLSLIINTFYSNKEIFLRELISNSSDALDKIRFESLTDKSKLDAQPELFIHIVPDKASNTLSIIDSGVGMTKSDLVNNLGTIARSGTKEFMEALAAGADVSMIGQFGVGFYSAYLVAERVVVTTKHNDDEQYVWESQAGGSFTVTRDTSGEQLGRGTKITLYLKDDQLEYLEERRLKDLVKKHSEFISYPISLWTEKTTEKEISDDEDEEEKKDAEEGKVEDVDEEKEEKEKKKKKIKEVSHEWNVMNKQKPIWLRKPEEITKEEYAAFYKSLTNDWEEHLAVKHFSVEGQLEFKAILFVPKRAPFDLFDTRKKQNNIKLYVRRVFIMDNCEELIPEWLSFVKGIVDSEDLPLNISREMLQQNKILKVIRKNLVKKCVELFFEIAENKEDYNKFYEAFSKNLKLGIHEDSTNRTKIAELLRYHSTKSGDELTSLKDYVTRMKEGQSEIYYITGESXKKAVENSPFLEKLKKKGYEVLYMVDAIDEYAVGQLKEFEGKKLVSATKEGLKLDESEDEKKRQEELKEKFEGLCKVIKEVLGDKVEKVVVSDRVVDSPCCLVTGEYGWTANMERIMKAQALRDSSMAGYMSSKKTMEINPENAIMDELRKRADADKNDKSVKDLVMLLFETALLTSGFSLEDPNTFGTRIHRMLKLGLSIDEDESAEADADMPPLEDDAGESKMEEVD

SEQ ID NO: 6739 - protein, 87 aa, Oryza sativa
  UNSURE (1)..(87): unsure at all Xaa locations
  Clone ID: PAT_MRT4530_32862C.1.pep
  unsure (1)..(87): unsure at all Xaa locations
KKEKNKPKPNQLLGKAGALPAGAFALYXKPKAKKAPENAPRPKITEEFAAPAAVGPGGYPFPEPPEKKKAPKSPEESPGKKKPPLLG

SEQ ID NO: 6740 - protein, 346 aa, Oryza sativa
  Clone ID: PAT_MRT4530_32961C.1.pep
MENGGGDVPENANDHCPGTQSEAAGKADACAGCPNQQICATAPKGPDPDLLAIIERMNTVKHKILVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQIAGIDGAIIVTTPQQVSLIDVKKEINFCKKVGVPVLGVVENMSGLRQAFSDMKFVKPSEAGETDATEWALNYIKEKAPELLSVVACSEVFDSSKGGAEKMCQEMEVPFLGKVPMDPQLCKAAEEGRSCFTDQKCSASAPALKSIIKKLVKTK

SEQ ID NO: 6741 - protein, 588 aa, Oryza sativa
  Clone ID: PAT_MRT4530_3350C.1.pep
MSSPPDSATTCNFLFSPPAAQMVAPSPGYYYVGGAYGDGTSTAGVYYSHLPVMPIKSDGSLCIMEGMMPSSSPKLEDFLGCGNGSGHDPATYYSQGQEAEDASRAAYQHHQLVPYNYQPLTEAEMLQEAAAAPMEDAMAAAKNFLVTSYGACYGNQEMPQPLSLSMSPGSQSSSCVSAAPQQHQQMAVVAAAAAAGDGQGSNSNDGGEQRVGKKRGPGKGGQKQPVHRKSIDTFGQRTSQYRGVTRHRWTGRYEAHLWDNSCKKDGQTRKGRQGGYDTEDKAARAYDLAALKYWGLSTHINFPLENYRDEIEEMERMTRQEYVAHLRRRSSGFSRGASIYRGVTRHHQHGRWQARIGRVAGNKDLYLGTFSTQEEAAEAYDIAAIKFRGLNAVTNFDITRHDVDKIMESSSLLPGEAARKVKAIEAAPDHVPIGRELGATEEASAATVTGTDWRMVLHGSQQQQAAACTEATADLQKGFMGDAHSALHGIVGFDVESAAADEIDVPGGKISGINFSNSSSLVTSLSNSREGSPERLGLAMLYAKHHPTAVSLAAMNPWMPMPAPAAAHVMRPPSAIAHLPVFAAWTDA

SEQ ID NO: 6742 - protein, 369 aa, Oryza sativa
  Clone ID: PAT_MRT4530_33578C.1.pep
MAMMVDPPNGMGNQGKHYYTMWQTLFEIDTKYVPIKPIGRGAYGIVCSSINRATNEKVAIKKINNVFDNRVDALRTLRELKLLRHLRHENVIALKDIMMPVHRRSFKDVYLVYELMDTDLHQIIKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSEADIEFIDNPKARKYIKTLPYTPGIPLTSMYPQAHPLAIDLLQKMLVFDPSKRISVTEALEHPYMSPLYDPSANPPAQVPIDLDIDENLGVDMIREMMWQEMLHYHPEVVAGVNM

SEQ ID NO: 6743 - protein, 369 aa, Oryza sativa; identical to SEQ ID NO: 6742
  Clone ID: PAT_MRT4530_33579C.1.pep

SEQ ID NO: 6744 - protein, 224 aa, Oryza sativa
  Clone ID: PAT_MRT4530_34086C.1.pep
MGRGKIEIKRIENATNRQVTYSKRRTGIMKKARELTVLCDAQVAIIMFSSTGKYHEFCSPSTDIKGIFDRYQQAIGTSLWIEQYENMQRTLSHLKDINRNLRTEIRQRMGEDLDGLEFDELRGLEQNVDAALKEVRHRKYHVITTQTETYKKKVKHSYEAYETLQQELGLREEPAFGFVDNTGGGWDGGAGAGAAADMFAFRVVPSQPNLHGMAYGGNHDLRLG

SEQ ID NO: 6745 - protein, 65 aa, Oryza sativa
  UNSURE (1)..(65): unsure at all Xaa locations
  Clone ID: PAT_MRT4530_34426C.1.pep
  unsure (1)..(65): unsure at all Xaa locations
DPHDALLQPRGSCLRRRHRXQRRCHRAHGEFRPPAAAXAAAVVVEAEAGARGSPGAEMTARAAER

SEQ ID NO: 6746 - protein, 679 aa, Oryza sativa
  UNSURE (1)..(679): unsure at all Xaa locations
  Clone ID: PAT_MRT4530_34852C.1.pep
  unsure (1)..(679): unsure at all Xaa locations
QGVARRGAAAGRGGALEIEKTPEAAEDMESEPALAAAREAERVPPWREQVTARGMVAALLIGVVYTVIVMKLSLTTGLIPTLNVSAALLAFLALRGWTHALDRLGIASRPFTRQENTVIQTCAVACYTIGYGGGFGSFLLGLNKKTYELSGASTPGNVPGSYKEPGIGWMTGFLLSTSFVGLLTLLPLRKVLVIDYKLTYPSGTATAVLINGFHTPQGDKNAKKQVRGFLRYFGISFLWSFFQWFYTGGDVCGFLQFPTFGLKAWKHTFFFDFSLTYVGAGMICSHLVNLSLLFGAILSWGIMWPLIGKQKGNWYSAKASESSMSGLFGYKSFICIALLVGDGFYNFVKVIVVTLKSVRERSRRRGLNNRVADADTMAIDDMQRNEVFNRDNIPXWMAYTGYTLLSVIAVVLIPVMFRQVKWYYVIIAYLLAPALGFCNAYGTGLTDMNMGYNYGKIALFIFAAWAGKDDGVVAGLVGCGLVKQLVLISADLMHDFKTGHLTLTSPRSMLVGQVVGTLMGCVVAPLTFFLFYKAFDVGDPNGYWKAPYALIYRNMAIIGVEGFSALPRHCLQLCAGFFAFAVLANLARDFLPRRYGRYMPLPMAMAVPFLVGASFAIDMCAGSLVVFLWHRFDGKRAALLVPAVASGLICGDGIWTFPSSLLALAKVKPPICMKFIPGN

SEQ ID NO: 6747 - protein, 782 aa, Oryza sativa
  UNSURE (1)..(782): unsure at all Xaa locations
  Clone ID: PAT_MRT4530_3553C.1.pep
  unsure (1)..(782): unsure at all Xaa locations
MNPSARISQVAMAAILPDLATQVLVPAAAVVGIAFALVQWGLVXKVKMPAERRGGEGSPGAAAGKDGGAASEYLIEEEEGLNEHNVVEKCSEIQHAISEGATSFLFTEYKYVGLFMGIFAVLIFLFLGSVEGFSTKSQPCHYSKDRMCKPALANAIFSTVAFVLGAVTSLVSGFLGMKIATYANARTTLEARKGVGKAFITAFRSGAVMGFLLAASGLVVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTVVMTVGIALVSWLGLPYSFTIFNFGAQKTVYNWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNSIPGLMEGTTKPDYATCVKISTDASIKEMIPPGALVMLSPLIVGIFFGVETLSGLLAGALVSGVQIAISASNTGGAWDNAKKYIEAGASEHARTLGPKGSDCHKAAVIGDTIGDPLKDTSGPSLNILIKLMAVESLVFAPFFATHGGILFKWF

SEQ ID NO: 6748 - protein, 784 aa, Oryza sativa
  Clone ID: PAT_MRT4530_3554C.1.pep
MAAILPDLATQVLVPAAAVVGIAFAVVQWVLVSKVKMTAERRGGEGSPGAAAGKDGGAASEYLIEEEEGLNEHNVVEKCSEIQHAISEGATSFLFTEYKYVGLFMGIFAVLIFLFLGSVEGFSTKSQPCHYSKDRMCKPALANAIFSTVAFVLGAVTSLVSGFLGMKIATYANARTTLEARKGVGKAFITAFRSGAVMGFLLAASGLVVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTVVMTVGIALVSWLGLPYSFTIFNFGAQKTVYNWQLFLCVAVGLWAGLIIGFVTEYYTSNAYSPSCPSHLEFPLSSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNSIPGLMEGTTKPDYATCVKISTDASIKEMIPPGALVMLSPLIVGIFFGVETLSGLLAGALVSGVQIAISASNTGGAWDNAKKYIEAGASEHARTLGPKGSDPHKAAVIGDTIGDPLKDTSGPSLNILIKLMAVESLVFAPFFATHGGILFKLF

SEQ ID NO: 6749 - protein, 110 aa, Oryza sativa
  UNSURE (1)..(110): unsure at all Xaa locations
  Clone ID: PAT_MRT4530_35991C.1.pep
  unsure (1)..(110): unsure at all Xaa locations
HYAVRPRGPETVCLLASAPSSLYGKPTCRTEFLFRALPMMFSQCSPSPETEAQRLQXTRGVSSVHALPSXRSYHDDLSAXRISSVGLRCXSAASSIAXIVLLLCTVRSFH

SEQ ID NO: 6750 - protein, 187 aa, Oryza sativa
  Clone ID: PAT_MRT4530_36022C.1.pep
GGEIVAIKKMKKKYYSWEECGNLREVKSLRRMSHPNIVKLKEVIRENDTLFFVFEYMECNLYQLMKNRGKGFTEAEVRNWCFQVFHALAHMHQRGYFHRDLKPENLLVTKNVIKIADFGLAREVSSEPPYTEYVSTRWYRAPEVLLQATFYNSAVDMWAMGAIIAELFTLRPLFPGANEADEMYKIC

SEQ ID NO: 6751 - protein, 778 aa, Oryza sativa
  Clone ID: PAT_MRT4530_36922C.1.pep
METIPCLILFSSLQILAFSSASPEHTLGTGSFLSVEEYEKPFLISPSNTFSFGFYETGDNAFSLSIWFTNTVEKTVVWAANSESPVNGHGSKLSFTQEGSLVLSDEKGFVVWDSKTMLGQDSRVALLDTGNLVITDSKGSVVWQSFDSPTDTLLPLQLLTKDKRLVSGYYSLYYDTDNVLRLIYNGPEISSPYWPNPSESIFDFGRTNYNSSRIGVLDNTGHFTSSDGLNIIASDSGLGINRRLTIDQDGNLKLYSLNKVEKSWIVTWEAMPQHCDVHGLCGRNSICEYSPGPRCSCLPGYEMADLENWSKGCQPMFTNNYGQAIGQVIFVEMRHVEFYGYDTGFNISVSLEDCEEFCSQQRSCVAYSYHAGSGYCYTKGMLYNGRKTQSITGSTYFKLPKTCNISEVKQHGLTCRHSHSTYEMHRQHGKWLYFYTCAAIFGGLELFFTTTACLFLRSKQNIPKSVMDGYELMTEHFRKFSYRELKEATGNFKEELGRGGSGVVYRGVLDRKKVVTVKRLTNATEAEEEFQSEISVIGRINHVNLVRTWGYCSEGKHKLLVYDYVENESLDKHLFESIDAKKLLRWNQRFTIALGTARGLAYLHHECLEWVVHCDVKPENILLTQDFEVKIADFGLAKLSKRDCSCLQLSHMRGTVGYMAPEWALNLPINAKVDVFSYGIVLLEIVMGARISSQTTTEGEKLDLTQIVEALKQVVACGDVTHIVDAKLHGQFNHLQAMEMVKISLSCIGERTKRPTMDEITKALMACGDEDKYADCTE

SEQ ID NO: 6752 - protein, 330 aa, Oryza sativa
  Clone ID: PAT_MRT4530_36991C.1.pep
MADFRTSTHRERWIFQTNDLMDRWGAANQRATETLVQYGTTRLKVDPVDGSLSYPEPAPDHVVGSSGVKPLSCEEERLMRVFYEQKIQEVCSAFKFPHKIQATAIIYFKRFYLQWSVMEHHPKHIMLTCIYSSCKVEENHVSAEELGKGIQQDHQIILNNEMIVLKSLDFDLIVYAPYRSIEGFVDDMEDFCRAGNGEHQRLQDLRQTAISQVDKMMLTDAPLLYTPGQLALAALHKSNDMHKILNFERYLESVFSRQHSDCPIEQFVGSINMINYLVEQLKIPTPKDMRHIDRKLKHCLDPSSQDEHKKKEKKSKHKSKRAANEAQLDS

SEQ ID NO: 6753 - protein, 78 aa, Oryza sativa
  UNSURE (1)..(78): unsure at all Xaa locations
  Clone ID: PAT_MRT4530_37018C.1.pep
  unsure (1)..(78): unsure at all Xaa locations
GELSTATTVHGPXRASSSSAPPEMASAVLPEXXXXKKKXNVQFAXGXXIXXSMTYILXXYDXGXMSXXXVYIXKDXNI

SEQ ID NO: 6754 - protein, 48 aa, Oryza sativa
  UNSURE (1)..(48): unsure at all Xaa locations
  Clone ID: PAT_MRT4530_37686C.1.pep
  unsure (1)..(48): unsure at all Xaa locations
LLKDYRPISLVHSFSKLAAKVMAXRLSTKLDVLVPCSQTTFIKGRCIH

SEQ ID NO: 6755 - protein, 369 aa, Oryza sativa
  Clone ID: PAT_MRT4530_37832C.1.pep
MDGAPVAEFRPTMTHGGRYLLYDIFGNKFEVTNKYQPPIMPIGRGAYGIVCSVMNFETREMVAIKKIANAFNNDMDAKRTLREIKLLRHLDHENIIGIRDVIPPPIPQAFNDVYIATELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQYPRRTFASMFPRVQPAALDLIERMLTFNPLQRITVEEALDHPYLERLHDIADEPICLEPFSFDFEQKALNEDQMKQLIFNEAIEMNPNIRY

SEQ ID NO: 6756 - protein, 39 aa, Oryza sativa
  Clone ID: PAT_MRT4530_37978C.1.pep
GLAVVMGRHLLVFFNRAPVLGCLKMSWFQGASIFPFENV

SEQ ID NO: 6757 - protein, 729 aa, Oryza sativa
  Clone ID: PAT_MRT4530_38425C.1.pep
MVGIDLNTVEEEEDEEEGGATGTVTAPAEARAGGAVCLELWHACAGPVAPLPRKGSAVVYLPQGHLEHLGAAPGSGPGAAVPPHVFCRVVDVSLHADAATDEVYAQVSLVADNEEVERRMREGEDGAACDGEGEDAVKRPARIPHMFCKTLTASDTSTHGGFSVPRRAAEDCFPPLDYSLQRPFQELVAKDLHGTEWRFRHIYRGQPRRHLLTTGWSGFINKKKLVSGDAVLFLRGEDGELRLGVRRAAQLKNASPFPALHNQISNTSSLSEVAHAVAVKSIFHIYYNPRLSQSEFIIPYWKFMRSFSQPFSVGMRFKLRYESEDASERRRTGIIIGSREADPMWHGSKWKCLVVKWDDDVECRRPNGVSPWEIELSGSVSGSHLSTPHSKRLKSCFPQVNPDIVLPNGSVSSDFAESARFHKVLQGQELLGLKTRDGTVNTASQATEARNFQYTDERSCSINMSNNILGVPRLGVKTPSGNPGFSYHCSGFGESQRFQEVLQGQEVFRPYRGGTLSDACIRGSGFRQPDGNHAPGAAFKWLAPQGCDHHGITTSVLPQASSPSSVLMFPQTSSKMPGLEYIYGCLDRNENSRHFKIGPTQDMTRTDQTLRLWPHLISGKVLDECTRNEKLHSPVSGAEHESNNKCLNTNGCKIFGISLTEKAQAGDEVDCGNASYHSRLQSLKPQMPKSLGSSCATHFHRLCYRIQDDDRGNADDTRRMLVKFVVMHF

SEQ ID NO: 6758 - protein, 718 aa, Oryza sativa
  Clone ID: PAT_MRT4530_38426C.1.pep
MVGIDLNTVEEEEDEEEGGATGTVTAPAEARAGGAVCLELWHACAGPVAPLPRKGSAVVYLPQGHLEHLGAAPGSGPGAAVPPHVFCRVVDVSLHADAATDEVYAQVSLVADNEEVERRMREGEDGAACDGEGEDAVKRPARIPHMFCKTLTASDTSTHGGFSVPRRAAEDCFPPLDYSLQRPFQELVAKDLHGTEWRFRHIYRGQPRRHLLTTGWSGFINKKKLVSGDAVLFLRGEDGELRLGVRRAAQLKNASPFPALHNQISNTSSLSEVAHAVAVKSIFHIYYNPRLSQSEFIIPYWKFMRSFSQPFSVGMRFKLRYESEDASERRRTGIIIGSREADPMWHGSKWKCLVVKWDDDVECRRPNGVSPWEIELSGSVSGSHLSTPHSKRLKSCFPQVNPDIVLPNGSVSSDFAESARFHKVLQGQELLGLKTRDGTVNTASQATEARNFQYTDERSCSINMSNNILGVPRLGVKTPSGNPGFSYHCSGFGESQRFQEVLQGQEVFRPYRGGTLSDACIRGSGFRQPDGNHAPGAAFKWLAPQGCDHHGITTSVLPQASSPSSVLMFPQTSSKMPGLEYIYGCLDRNENSRHFKIGPTQDMTRTDQTLRLWPHLISGKVLDECTRNEKLHSPVSGAEHESNNKCLNTNGCKIFGISLTEKAQAGDEVDCGNASYHSRLQSLKPQMPKSLGSSCATVHEQRPVVGRVVDISAVNTMI

SEQ ID NO: 6759 - protein, 342 aa, Oryza sativa
  Clone ID: PAT_MRT4530_38784C.1.pep
MVGKSGVAEEGGAAAAAAVRRWVEAGGGRLVMDGGLATELEANGADLNDPLWSAKCLLSSPHLVRKVHLDYLEAGANIIITASYQATIQGFESKGFSKEQSEDLLAKSVEIAREARDMFLKEHSDRPIQHPILVAASIGSYGAYLADGSEYSGDYGEAGTLEFLKDFHKRRLEVLAEAGPDLIAFETIPNKLEAQAYVELLDECNISIPAWFSFNSKDGVHIVSGDSLIECATIANGCSKVGAVGINCTPPRFIHGLILSIRKVTDKPILIYPNSGERYDAEKKEWVESTGVSDGDFVSYVNEWCKDGAVLIGGCCRTTPNTIKAISRSLNQRHSSLHLPVA

SEQ ID NO: 6760 - protein, 214 aa, Oryza sativa
  Clone ID: PAT_MRT4530_38870C.1.pep
GGTVTTAPVPPPTASLRRELALSPNLPARGGVAGQPNAATREAPAAAVSSARRVVVVSPSLAGYLDEQFCQVEDLQDEASPNFVEEVVTLFFKDSGRLMSNIEQALEKYPRDFNRWDTYMQQLKGSCSSIGASRMKNECMSFRDSCGQGNVEGCMRSFQKVKREHAVLRQKLESYFQLLRQAGPAGAATRPVMAHIGHASGSVLPTLFLFSEAC

SEQ ID NO: 6761 - protein, 397 aa, Oryza sativa
  Clone ID: PAT_MRT4530_38906C.1.pep
MATTEGCLVASTNRGCKAIAESGGAVSVVLRDGMTRAPVARLPTARRAAELKAFLEDSVNFNTLSMVFNRSSRFARLQGVQCAMAGRNLYMRFSCCTGDAMGMNMVSKGVQNVLDYLQDDFPDMDVISISGNFCSDKKPAAVNWIEGRGKSVVCEAVIKEDVVKKVLKTNVQSLVELNVIKNLAGSAVAGALGGFNAHASNIVTAIFIATGQDPAQNVESSHCITMLEAVNDGRDLHISVTMPSIEVGTVGGGTQLASQAACLDLLGVKGANRESPGSNARLLATVVAGGVLAGELSLLSALAAGQLVKSHMKYNRSSKDMSKRSRAHQTKVKDSEVYGDIVMAADADTNSSCSEERAALAAASDPYRYVEKRKPIPDPQDTGLIYGKKKDPTKSDN

SEQ ID NO: 6762 - protein, 226 aa, Oryza sativa
  Clone ID: PAT_MRT4530_39157C.1.pep
MAAAAQRLLAASTKIVGVGRNFVAHAKELGNPVPKEPVLFLKPTSSFLHAGVAGAAIEVPEPVESLHHEVELAVVISQRARDVPEASAMDFVGGYALALDMTARELQSAAKSAGLPWTLGKAQDTFTPISAVIPKSDVANPDDLELWLKVDDELRQKGSTSDMIFKIPSLISYISSIMTLMEGDVILTGTPEGVGPVRPGQKIKAGITGLIDVEFDVQKRKRSFST

SEQ ID NO: 6763 - protein, 213 aa, Oryza sativa
  Clone ID: PAT_MRT4530_39492C.1.pep
CPVTNMSTGGGDLSRSSNAPVASGSPSNSVSKSTGGSPPASGSAKGVPPAVQLPSPQQQSAKNPASTSGAKSAPTNHYSSMPMPSILGQQPNVPPGSNSGSKQQSHMMKQQPFPQGGHFFISNAYTPQAPGAAGGVALGLYQKRSADKTQQQQQPHQQSAMSAAASNNMKTHHPPAGSFMHLAAASQSSRRCASLSYVSGTIDFWGPNVNVCK

SEQ ID NO: 6764 - protein, 648 aa, Oryza sativa
  Clone ID: PAT_MRT4530_39564C.1.pep
MATAVLRRPLLAAAAAAAAVSSTSSSFRPSRFHLRRCRYPPPVFAVSSDSPKPVTSSSTGGDNPDEEPVLPLLQELADCLVLPPKFLSQLPRDLRLDLNDAAFDLSNGPVLDEAWEMADTSTSNNLVKQLPSMEPYLTGTFGKRLMSAGRRFTSMGQYGKGELKKIAETMSKTGKLLSKRPVVQSEVEAMKVKRKLKFLELEFELTAEKANIGAAVGLVFGFLSWQLARGIQNIPDGSMQYANDNALQMAKSLKVSLLVLGYTSTALSVFPSFSPPYLPQSVQGGGVKMASSTQGQVITCKAAVAWEANKPMTIEDVQVAPPQAGEVRVKILFTALCHTDHYTWSGKDPEGLFPCILGHEAAGIVESVGEGVTEVQPGDHVIPCYQAECRECKFCKSGKTNLCVKVRAATGVGVISKCSQCTFFNNGNAAKINPEAPLDKVCLLGCGVSTGLGAVWNTAKVEAGSIVAIFGLGTVGLAVAEGAKSAGASRIIGIDIDSKKFDVAKNFGVTEFVNPKDHDKPIQQVIVDLTDGGVDYSFECIGNVSVMRSALECCHKGWGTSVIVGVAASGQEISTRPFQLVTGRVWKGTAFGGFKSRSQVPWLVEKYLNKEIKVDEYVTHSMNLTDINKAFDLLHEGGCLRCVLATDK

SEQ ID NO: 6765 - protein, 257 aa, Oryza sativa
  UNSURE (1)..(257): unsure at all Xaa locations
  Clone ID: PAT_MRT4530_39566C.1.pep
  unsure (1)..(257): unsure at all Xaa locations
MASSTQGQVITCKAAVAWEANRPMTIEDVQVAPPQAGEVRVKILFTALCHTDHYTWSGKDPEGLFPCILGHEAAGIVESVGEGVTEVQPGDHVIPCYQAECRECKFCKSGKTNLCGKVRAATGVGVMMNDRKSRFSINGKPIYHFMGTSTFSQYTVVHDVSVAKINPQAPLDKVCLLGCGVSTGLGAVWNTAKVEAGSIVAIFGLGTVGLAVAEGAKSAGASRIIGIDIDSXKKXDVAKDFGXLQXFVNPKXDHDKP

SEQ ID NO: 6766 - protein, 87 aa, Oryza sativa
  Clone ID: PAT_MRT4530_39601C.1.pep
GFADRGAPRLGFGWGVPARWPLRRRSRRWWGWGWIHRRAPSLGMASRSLSGSNSLVAIWTRMHQVLMEHLRLAGAPLSLAHCRRSVT

SEQ ID NO: 6767 - protein, 61 aa, Oryza sativa
  Clone ID: PAT_MRT4530_39942C.1.pep
RHEARAEQADQAAAAIAAAATTYSHLLPATTRQQAVASLQCGLYLYRRQPGRLAGGSSAPS

SEQ ID NO: 6768 - protein, 530 aa, Oryza sativa
  Clone ID: PAT_MRT4530_39949C.1.pep
MAAAPPPKADELQPHPPKEQLASVSFCITSPPPWPEAIILGFQHFIVMLGTTVIIPSALVPQMGGGNDEKARVIQTLLFVAGINTLFQTFFGSRLPVVMGGSYTFVAPTISIILAGRYNNEADPREKFLRTMRGTQGALIIASTIQMILGFSGLWRNVVRLLSPLSAVPLISLVGFGLYELGFPGVAKCVEIGLPELILLVAFSQYLPQVLHFGKPIFGRFGVLFTVSIVWLYAYILTISGAYKNAPPKTQVHCRVDRSGLISGAPWIRVPYPFQWGAPTFDAGEAFAMMMTSFIALVETTGAFIAASRYASATMIPPSIISRGIGWQGISILIDSFFGTANGTSVSVENVGLLALTHVGSRRVVQISAGFMIFFAILGKFGALFASIPLPIFAGMYCIFFAYVGACGLSFLQFCNLNSFRTKFILGFAFFMGISVPQYFNEYTAVAGYGPVHTGARWFNDMINVPFSSKPFVAGLVAYFLDNTIETHNNTVRKDRGYHWWDKFRSFKKDARSEEFYSLPFNLNKFFPAV

SEQ ID NO: 6769 - protein, 349 aa, Oryza sativa
  Clone ID: PAT_MRT4530_40043C.1.pep
MASASLSLRLPTPSTAPSSGASSSFLSLPPTLLRQARGGAAASSALVARAASGGSPNPLFNPRADPFLSTLAAASPEELQAAAAGGGRRGDDHLPFLEIFQNAKLMASPAQVERSSSSYSQHRPRRPPPDLPSLLLHGRIVYIGMPLVPAVTELVVAQLMYLEWMNSKEPVYIYINSTGTARDDGEPVGMESEGFAIYDAMMRMKTEKIRIHTLCIGAAAGHACLVLAAGKKGKRYMFPHAKDSIMPAMIQQPRIPSYGMMQASDVVIRAKEVVHNRNTLVRLLARHTGNPPEKIDKVMRGPFYMDSLKAKEFGVIDKILWRGQEKYMADMLSPEEWDKVAGVRRPDIM

SEQ ID NO: 6770 - protein, 176 aa, Oryza sativa
  Clone ID: PAT_MRT4530_40136C.1.pep
MSGRGRGDPLVLGRVVGDVVDPFVRRVALRVAYGAREVANGCELRPSAVADQPRVAVGGPDMRTFYTLVMVDPDAPSPSDPNLREYLHWLVTDIPATTGVSFGTEVVCYESPRPVLGIHRLVFLLFEQLGRQTVYAPGWRQNFSTRDFAELYNLGLPVAAVYFNCQRESGTGGRRM

SEQ ID NO: 6771 - protein, 342 aa, Oryza sativa
  Clone ID: PAT_MRT4530_41010C.1.pep
MVSLMKLLFSALHGCHFCPILFFKWSAILGEHLFEMLYDPLRDKWITLPVMPSQIRNIARFGVASVAGKLYVIGGGSDRVDPLTGDHDRIFASNEVWSYDPLCRLWVQRAPMLVARAMFACCALDGNIIVAGGFTNCRKSISKAEIYNPEADTWEPLPDLRQAHSSACSGLVIKGKMHVLHKGLPTVQILEDGNAWAVEDYSWLQGPMAMVRGELYVLSNSCIMKQRGVNFPDKMVSCASEFQSRIGFGMIGLGDNIYLVGGVIGPGPRNQCIKPLSDVDILNVTSVVNCHEKWFIMQKPFSCISVLVYMLHAMEQRRLCLATNMDQRLASDQILKEKDVSY

SEQ ID NO: 6772 - protein, 69 aa, Oryza sativa
  Clone ID: PAT_MRT4530_41055C.1.pep
KHQAGCKSANELLPPSASFVKLSDMSPKQWSAFLDKLQELLPGALSARKHAAGVVGQRSMPRLGTPCQF

SEQ ID NO: 6773 - protein, 54 aa, Oryza sativa
  UNSURE (1)..(54): unsure at all Xaa locations
  Clone ID: PAT_MRT4530_41126C.1.pep
  unsure (1)..(54): unsure at all Xaa locations
FFFFFFFFFFFFFLKXKXKLAXIDQKLFXNRGAAKINTDEHNXPMQFVTTXNXX

SEQ ID NO: 6774 - protein, 893 aa, Oryza sativa
  Clone ID: PAT_MRT4530_41131C.1.pep
MRSLRRVLLQLVLLAGVAFRGVRFDDAADAAAAAQGSSDLFELPSPSPTLALPGGGDEGASTEIIAAPWPGRHGLFTPPRSTSQPARAVVQPAADFGSQLQFYDNGTIQLVDLLSKLPRWQFSTGPPLSKHITTSKPDLNYVIYLDGSETSDLIEVHNGSGVRLPWKLEEFIAETPYIRDSFVTIGSKVSTTFVVNADSGEIIYKHSLPVALNEVGGPLVEEIPSKLDAARSGTSANIIVVVRTDYSISASDLGEHLFNWTRTSFTANYYARYGHQDMLAQSSCLRGNIPCIRTEGPPIKLYLPDSSSDNAIVLRPVNEVSAVDALEPLLPPKKLPQPAGESNVALDSAQNQTADIALGHFVPADTELTNSVTKFSYRWLFPTFLMLLIMACLVKLADASKYCRQFVIRFLKPFMRDEKLMDPRGKSEGTSKRRKARKKDGLINSTQIFSASDKEGNGTGGSTEAQSNKAHDSTNVELPNGLNGRQIGKLCVYSKEIGKGSNGTVVFEGSYGGREVAVKRLLRSHNDIASKEIENLIASDQDPNIVRMYGFEQDNDFVYISLERCRCSLADLIQLHSVPPFSNTKGTDIELWRQDGLPSAQLLKLMRDVVAGIVHLHSLGIIHRDLKPQNVLISKEGPLRAKLSDMGISKRLQEDMTSVSHHGTGFGSSGWQAPEQLRHGRQTRAIDLFSLGCLIFYCITKGKHPFGEYYERDMKIINNQFDLFIVDHIPEAVHLISQLLDPDPEKRPTAVYVMHHPFFWSPELCLSFLRDTSDRIEKTSETDLIDALEGINVEAFGKNWGEKLDAALLADMGRYRKYSFESTRDLLRLIRNKSGHYREFSDDLKELLGSLPEGFVQYFSSRFPKLLIKVYEVMSEHCKDEEAFSKYFLGSSA

SEQ ID NO: 6775 - protein, 390 aa, Oryza sativa
  Clone ID: PAT_MRT4530_41161C.1.pep
MSVLTCVLDNMGSSCSRSHSLSEAETTKNAKSADIDRRILQETKAEQHIHKLLLLGAGESGKSTIFKQIKLLFQTGFDEAELRSYTSVIHANVYQTIKILYEGAKELSQVESDSSKYVISPDNQEIGEKLSDIDGRLDYPLLNKELVLDVKRLWQDPAIQETYLRGSILQLPDCAQYFMENLDRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKTSFILFLNKFDIFEKKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 6776 - protein, 399 aa, Oryza sativa
  Clone ID: PAT_MRT4530_41323C.1.pep
MAAAADAPPPPPEVAPPAPAPAPAPAPYQPPRLAVADGAGGGGGGGGKPCRHHAYSRKQKSLGLLCTNFVALYDREDVESVGLDDAARRLGVERRRIYDIVNVLESIGEMSLRAVSSVASPSLDETSAANVSDDEDDDKLDDAEGDAESEKLSLSQSIDNPSDKPDAPPCKLRSEHRKEKSLGLLTQNFVKLFLTMEIETISLDEAAKRLLGEGHAANNMRTKVRRLYDIANVLSSLNLIEKTQQADSRKPAFRWLGQAKRNEGVTVALPPTKTLPNKRAFGTDLTNIDNKRGKLDSTMENRGKPTQDGGNLFNNLQRQLGQENRSDFVYGPFHPAVARKQEHGNRTVQEKERKSIQDWENLASSFRPQYQNPGLNDLFGHYMEAWRSWYSDLRRDRAS

SEQ ID NO: 6777 - protein, 587 aa, Oryza sativa
  Clone ID: PAT_MRT4530_41649C.1.pep
MSYDRVTTFEDSEKAGEYGYVRKVSGPVVVADGMGGAAMYELVRVGNDNLIGEIIRLEGDSATIQVYEETAGLMVNDPVLRTRKPLSVELGPGILGNIFDGIQRPLKTIAIKSGDVYIPRGVSVPALDKDQLWDFEPKKLGVGDAITGGDLYATVFENTLMKHHVALPPGSMGKISYIAPAGQYSLQTWPVRSPRPVSSKLAADTPLLTGQRVLDALFPSVLGGTCAIPGAFGCGKTVISQALSKYSNSEAVVYVGCGERGNEMAEVLMDFPQLTMTLPDGREESVMKRTTLVANTSNMPVAAREASIYTGITIAEYFRDMGYNVSMMADSTSRWAEALREISGRLAEMPADSGYPAYLAARLASFYERAGKVKCLGSPDRTGSVTIVGAVSPPGGDFSDPVTSATLSIVQVFWGLDKKLAQRKHFPSVNWLISYSKYSKALESFYEKFDQDFIDIRTKSSLVGKDALAESDKITLETAKLLREDYLAQNAFTPYDKFCPFYKSVWMMRNIIHFNTLANQAVERAANADGQKITYSVIKHRMGDLFYRLVSQKFEDPAEGEDVLVAKFQKLYDDLTTGFRNLEDEAR

SEQ ID NO: 6778 - protein, 222 aa, Oryza sativa
  Clone ID: PAT_MRT4530_41651C.1.pep
MSYDRVTTFEDSEKESEYGYVRKVWGPVVVADGMGGAAMYELVRVGNDNLIGEIIRLEGDSATIQVYEETAGLMVNDPVLRTRKPLSVELGPGILGNIFDGIQRPLKTIAIKSGDVYIPRGVSVPALDKDQLWDFEPKKLGVGDAITGGDLYATVFENTLMKHHVALPPGSMGKIRYIAPAGQYSLQDTALELGFQGLKKQFTMLQTWPVRSPRPVSSKLAA

SEQ ID NO: 6779 - protein, 91 aa, Oryza sativa
  Clone ID: PAT_MRT4530_41696C.1.pep
MESTELKVEMVALHEKRVRKCLSKVKGVERVEVEGSLQKVVVTGYANRSKILKALRRVGLRAEPWSPRNELLSAYAAGSLMAANNYYHTFF

SEQ ID NO: 6780 - protein, 442 aa, Oryza sativa
  Clone ID: PAT_MRT4530_41750C.1.pep
MDSAARASQSAAPPPPGAGVRVRAPLVESVSCYCRLDTGLKTVVDARKFVPGAKMCMQPDVKPNKCKSRGSRKERSRTQAPLLPGLPDDLAIACLIRVPRVEHPNLRIVCKRWNRLLSGNYYYSLRKRNGMAEEWVYVFKRDREGKISWHAFDPLHQLWKSLPPVPAEYSEALGFGCAVLSGCYLYLFGGKDPLRGSMRRVVFYNARTNKWHRAPDMLRKRHFFGSCVINNCLYVAGGECEGIQRTLPSAEVYDPNRNRWACVAEMNNGMVPFIGVVYDGKWFLKGLDSHRQVTSEVYLPSSNLWSTIDDEMVTGWRNPSITFNGKLYSSDCRDGCKLRVYDPNTGTWAKFMDSKHHLGSSRAFEAAALVTLNGKLCIVRNNMSITLVDISDPTMSIETDSARMWETVARKGQHRSFVANLWSTIAGRNLKSHIIHCQVLQV

SEQ ID NO: 6781 - protein, 636 aa, Oryza sativa
  Clone ID: PAT_MRT4530_42077C.1.pep
MDGCDCIEPLWPTDELLIKYQYISDFFIALAYFSIPLELIYFVKKSSFFPYRWVLIQFGAFIVLCGATHLINLWTFTTHTKTVAMVMTVAKVSTAVVSCATALMLVHIIPDLLSVKTRELFLKNKAEQLDREMGLIRTQEETGRHVRMLTHEIRSTLDRHTILKTTLVELGGTLGLEECALWMPSRSGSSLQLSHTLRHQITVGSTVSINLPVVNQVFSSNRAIIIPHTSPLARIRPLAGRYVPPEVAAVRVPLLHLSNFQINDWPELSAKSYAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMSFIKPIAAIKRLSVSVMLAPDLPLCAIGDEKRLMQTILNISGNAVKFTKEGHITLVASVVKADSLREFRTPDFHPTASDDNFYLKVQIKDTGCGISPQDLPQVFTKFAQSQPGGNRGYSGSGLGLAICKRFVTLMGGHIWLDSEGTGRGCTVTFVIQLGICDNTNAYQQKLIPLVWPSSGDADFVGPVPNAPNEEKGQASLKSRYQRSI

SEQ ID NO: 6782 - protein, 972 aa, Oryza sativa
  Clone ID: PAT_MRT4530_42120C.1.pep
MYGNDNWINSYLDAILDAGKGAAASASASAVGGGGGAGDRPSLLLRERGHFSPARYFVEEVITGYDETDLYKTWLRANAMRSPQEKNTRLENMTWRIWNLARKKKELEKEEANRLLKRRLETERPRVETTSDMSEDLFEGEKGEDAGDPSVAYGDSTTGNTPRISSVDKLYIVLISLHGLVRGENMELGRDSDTGGQVKYVVELAKALSSCPGVYRVDLFTRQILAPNFDRSYGEPVEPLASTSFKNFKQERGENSGAYIIRIPFGPKDKYLAKEHLWPFIQEFVDGALSHIVKMSRAIGEEISCGHPAWPAVIHGHYASAGVAAALLSGALNVPMVFTGHFLGKDKLEELLKQGRQTREQINMTYKIMCRIEAEELALDASEIVIASTRQEIEEQWNLYDGFEVILARKLRARVKRGANCYGRYMARTVVVSASVIAGTRMDVEEQGNLSDCSEDLLARKIMGFFKNPRKSLVLAMARMYPETHITTFGHAFGECRTLREHANLTLIMGNREAISKMHNMSAAVLTSVLTLIDEYDLYGQVAYPKRHKHSEVPDIYRLAVRTKGAFVNVPYFEQFGVTLIEAAMHGLPVIATKNGAPVEIHQVLDNGLLVDPHDQHAIADALYKLLSEKQLWSKCRENGLKNIHQFSWPEHCKNYLSRISTLGPRHPAFASNEDRIKAPIKGRKHVTVIAVDSVSKEDLIRIVRNSIEAARKENLSGSTGFVLSTSLTIGEIHSLLMSAGMLPTDFDAFICNSGSDLYYPSCTGDTPSNSRVTFALDRSYQSHIEYHWGGEGLRKYLVKWASSVVERRGRIEKQVIFEDPEHSSTYCLAFKVVNPNHLPPLKELQKLMRIQSLRCHALYNHGATRLSVIPIHASRSKALRYLSVRWGIELQNVVVLVGETGDSDYEELFGGLHKTVILKGEFNTSANRIHSVRRYPLQDVVALDSPNIIGIEGYGTDDMRSALKQLDIRAQ

SEQ ID NO: 6783 - protein, 200 aa, Oryza sativa
  Clone ID: PAT_MRT4530_42195C.1.pep
MASHQDQASYRAGETKAHTEEKAGQVMGASKDKASEAKDRASEAAGHAAGKGQDTKEATKEKAQAAKERASETAQAAKDKTSSTSQAARDKAAESKDQTGGFLGEKTEQAKQKAAETAGAAKQKTAETAQYTKDSAIAGKDKTGSVLQQASEQVKSTVVGAKDAVMSTLGMTEDEAGTDDGANKDTSATAAATETTARDH

SEQ ID NO: 6784 - protein, 1120 aa, Oryza sativa
  Clone ID: PAT_MRT4530_4273C.1.pep
MVVVVVVGGAAWICASSSRAMLAESDLGENVVELMQRYFPTDMIRRIRMLSGNLIKKVVMPPGAISLDDVDIDQVSVDYVLNCAKKGEALDLGDAIRLFHDSLDYPYVNNSGTVEEFFLLTKPEYSGPAPAREPPPVPAIAPSPVVIPAPIVDPPPVAVHSPVSTTNLSKSQSFDSPTEKELTIDDIEDFEDEEDEFDSRRASRRHQSDANDLSLRLPLFETGITDDDLRETAYEILVAAAGASGGLIVPQKEKKKEKRNKLMRKLGRSKSESTQSQTQRQPGLVGLLETMRAQLEITESMDIRTRQGLLNAMVGKVGKRMDNLLIPLELLCCISRAEFSDMKAYLRWQKRQLNMLEEGLINHPVVGFGELGRKVNELRNLFRKIEESESLQPSAVEVQRTECLRSLREVATSLSERPARGDLTGEIHYQLQEVEEILELLKSTWRILGITETIHDTCYAWVLFRQFVFTGEQGLLKVVIEHLRKIPLKEQRGPQERLHLKSLRSSVDAEDSFQDFTFFQSFLSPVQKWVDKKLNDYHLHFSEGPSMMADIVTVAMLIRRILGEENNKGMESPDRDQIDRYITSSVKSAFVKMAHSVEAKADTSHEHVLASLAEETKKLLKKDTTVFSSVLSKWHPQSAVVSASLLHKLYGSKLKPFLEHAEHLTEDVVSVFPAADALEQYIMSVMASVVGDDGLDSICRQKLAPYQIESKSGTLILRWVNGQLERIETWVKRAAEQETWDPISPQQRHGASIVEVYRIIEEVPMRTGELNSLCRGFDKAFQVYTQLVTGPIVDREDLIPPVPVLTRYKKELGIKAFVKKEIHEVRTVDERKASEIIQLTMPKLCVRLNSLYYGISQLSKLEDSINERWARRKSESINIRRSMSEKSKSAVSSQKNQFDGSRKEINAAIDRICEFTGLKVIFWDLQQPFIDNLYKNNVSQARLDAIMEVLDTVLNQLCNVIVEQLRDRVVTGLLQASLDGLLRVILDGGPTRVFSPSDATLLEEDLEILKEFFISGGDGLPRGTVENLVSRVRPVIDLIKQETRVLIDDLREVTQGAKTNGMRLGLATWKSCPVSAPLLPFAIVPHSNQLFKVLPSLTRSKVSAVFIKQYRVRYDLLAPD

SEQ ID NO: 6785 - protein, 1107 aa, Oryza sativa
  Clone ID: PAT_MRT4530_4275C.1.pep
MLSGNLIKKVVMPPGAISLDDVDIDQVSVDYVLNCAKKGEALDLGDAIRLFHDSLDYPYVNNSGTVEEFFLLTKPEYSGPAPAREPPPVPAIAPSPVVIPAPIVDPPPVAVHSPVSTTNLSKSQSFDSPTEKELTIDDIEDFEDEEDEFDSRRASRRHQSDANDLSLRLPLFETGNSDDCYVIMKSSCWYGYIHWVKKVIDNGNCAVFPGITDDDLRETAYEILVAAAGASGGLIVPQKEKKKEKRNKLMRKLGRSKSESTQSQTQRQPGLVGLLETMRAQLEITESMDIRTRQGLLNAMVGKVGKRMDNLLIPLELLCCISRAEFSDMKAYLRWQKRQLNMLEEGLINHPVVGFGELGRKVNELRNLFRKIEESESLQPSAVEVQRTECLRSLREVATSLSERPARGDLTGEIHYQLQEVEEILELLKSTWRILGITETIHDTCYAWVLFRQFVFTGEQGLLKVVIEHLRKIPLKEQRGPQERLHLKSLRSSVDAEDSFQDFTFFQSFLSPVQKWVDKKLNDYHLHFSEGPSMMADIVTVAMLIRRILGEENNKGMESPDRDQIDRYITSSVKSAFVKMAHSVEAKADTSHEHVLASLAEETKKLLKKDTTVFSSVLSKWHPQSAVVSASLLHKLYGSKLKPFLEHAEHLTEDVVSVFPAADALEQYIMSVMASVVGDDGLDSICRQKLAPYQIESKSGTLILRWVNGQLERIETWVKRAAEQETWDPISPQQRHGASIVEVYRIIEEVPMRTGELNSLCRGFDKAFQVYTQLVTGPIVDREDLIPPVPVLTRYKKELGIKAFVKKEIHEVRTVDERKASEIIQLTMPKLCVRLNSLYYGISQLSKLEDSINERWARRKSESINIRRSMSEKSKSAVSSQKNQFDGSRKEINAAIDRICEFTGLKVIFWDLQQPFIDNLYKNNVSQARLDAIMEVLDTVLNQLCNVIVEQLRDRVVTGLLQASLDGLLRVILDGGPTRVFSPSDATLLEEDLEILKEFFISGGDGLPRGTVENLVSRVRPVIDLIKQETRVLIDDLREVTQGAKTNGMRLGLATWKSCPVSAPLLPFAIVPHSNQLFKVLPSLTRSKVSAVFIKQYRVRYDLLAPD

SEQ ID NO: 6786 - protein, 397 aa, Oryza sativa
  Clone ID: PAT_MRT4530_4336C.1.pep
MAAPKPIARLISHVILDLDGTLLNTDCVVSQVLKPFLVKNGKKWDSKKAHKLVGKTPYEAAAVVLEDYGLPYSTEEFLSMLTPMFNEQWCNIKALPGANRLIKHLKSNGVPAALASNSPRSNIDAKISCHQGWKESFSAIVGGDEVEKGKPSPDIFLEAAKRMNTNPPNCLVIEDSLPGVAAGKAAGMHVIAVPSVPKRTAEFSSADEVINSLLDVKPEKWGLPPFSDWIDDTLPIEPWFIGGPVIKGFGRGSKVLGIPTANLPAENFSDVLSEHTSGVYFGWAGLSTRGIFKMVMSIGWNPYFDNTEKTIEPWLLHDFGEDFYGEELRLVIVGYIRPEANFPSLESLIERIHEDARISDKALNLPLYAKYKDSPYLRNSLKEDNSANGNQSVIDSK

SEQ ID NO: 6787 - protein, 210 aa, Oryza sativa
  Clone ID: PAT_MRT4530_43475C.1.pep
MRTICDVCESAPAVLFCVADEAALCRSCDEKVHMCNKLARRHVRVGLADPNKVQRCDICENAPAFFYCEIDGTSLCLSCDMTVHVGGKRTHGRYLLLRQRVEVGDKPGHMDDVAMQQKDPENRTDQKKAPHSVTKEQMANHHNVSDDPASDGNCDDQGNIDSKMIDLNMRPVRTHGQGSNSQTQGVDVSVNNHDSPGVVPTCNFEREANK

SEQ ID NO: 6788 - protein, 1873 aa, Oryza sativa
  Clone ID: PAT_MRT4530_43893C.1.pep
MAADPAVASAVAAISAVMDWRSSPDARSAAFAYLESVKTGDVRALANTSFLLVRKDQSSEVRLHGFKMLQHLVRLRWEELSVAERNEFANLTVNLIPEVVGPHEEWALKSQTAALVAEVVRREGVALWNTLLPSIVSLSNNGPIEAELVAMILRWLPEDITVHNEDLEGDRRRALLRGLTESLPQILPLLYSLLEKHFVAALSAHTNQQMELAKQHVGTITAVLNAANAYAEWAPVTDLAKYGLIHGSCILADVARTLHFLQQMLEYYQHYKITLHFQSLLFWLVVLREPSKAKSVARVSSDTPAAGNSASTGGGSTEREKKGVSVLITDEMYSTILDVTFKRMLKKSTSASSGLLELWSEELEGKSDFCNYRAKLLDLIKVIASQRPGITATSIVQRINIVFGDANEATKSSQDLDAMEGAQLGLEAVVSAIFDGSSDYSKIDQDTKFQIHRIFEGLLQQLLSLKWSQPNLAVIHGHYLDSLGPFLRHYPDAVACIVNKLFEILTSLPITIQDPSNNFRQARLQICSSFIRISRAADKALLPHMKCNSVNFFMTIVKTFKCKQVVTTWYQSHSPWLPILSEFFVSWVANVYMNKNIADTMAYLQGEGRLLRAEHNHLCEAFLVMASSAGIQQQQEVLAWLLEPINKMWTQVEWQNAYLSDPSGLTHMFADSQFMWSIYHNITLFEKALKRGGSKKSASAPQALATTVLLRCIHMLWAEPFSQSLAGEVKAAKSMTVAEQTSLLGETNKLTKGQVASADGLLDVQREGESKENTIRNWLRGIRDSGYNVIGLSASLGDPFFRCIEGSSITAALMENVQAMEFRHLRQLIHLVIIPLVKYCPPELWRMWISNLLQPLFVHCQQALDFSWSSLLREGRAKVPDNFGNLSGSDLKVEVMEEKLLRDLTREVCSVLWVLASPGLNSGLPSLEQLGPANRINSSLKDLELFVSSSITGFLMLNVSTAVPALRITVEVFSWTDSEAVTKIIPFCGALIHLAVATNRAELSQFVAKDLFSSILHGLSVELNSITSSELVGLCREIYIYLSDRDPAPRQNTTGREEEDKKVTGIGTSKSNLCPARHPSAELVLGTEVPPLMVIFRTLPSSAKPATKQKVAPKKTDVRAILRPLTVINCQKKDIQLRFSTDNMKRVDMASAILLSIAIMAQLSSISAQPAPGCQSHCGDMEIPYPFGIGTECAIEPGFVIYCNKTADGSMKPFLINVEVLNISLLHGQTRALNALSTYCYNDVTKSMESSRWSLDFSTWPYRFSNLHNKFVVIGCNTLSYIYNGEYTTACASVCAKAPTNDSCDGVGCCQNNIAKGLNSYNVTFFTVYNDSSNLQSNPCSYAALVETDTFRFKTEYVTTMKFNETYNGQQPVVLDWAIGKVGCKEANMTSYACRSKHSECVDSINGPGYLCNCTLGYHGNPYITDGCIDVNECEQNQSPCPKGATCRNTEGWYHCSCPVGRKLAKETNTCNPDISLIIGVSIGSIVLVIIIFFVRIIFERRKLTDVKKKYIQEHGGLLLFEKMKSDQGLAFKVFTQAELEQATNKFEKSQILGHGGHGTVYKGITKDNITVAIKKCALIDDRHKKEFGKEMLILSQINHKNIVKLLGCCLEVDVPMLVYEFIPNGTLFDLIHGKNRTLHIPFSSLLRIVNEAAEGLAFLHSYANPPILHGDVKTSNILLDENYMAKVSDFGASILAPNDEAQFVTMVQGTCGYLDPEYLQTCQLTEKSDVYSFGVVILEILTGQMPLKLEGSELQKSLSSSFLLAMKENNLEAMLDSQIKGHESMELLSGLAELAKQCLDMCSENRPSMKDVAEEISRLRKLSKHPWIQRDSETEGYLSGPSTSNFEIEQSTEYTRKDEQMPINPSTSYFIR

SEQ ID NO: 6789 - protein, 102 aa, Oryza sativa
  Clone ID: PAT_MRT4530_44272C.1.pep
MRPTGRRSSPPVAAALALLLLLVLFFFSHCASAARPLPASAAAELVLQDGATGNGDEVSELMGAAEEEAAGLCEEGNEECVERRMLRDAHLDYIYTQKRNRP

SEQ ID NO: 6790 - protein, 336 aa, Oryza sativa
  Clone ID: PAT_MRT4530_44581C.1.pep
MAGMDPGGGGAGAGSSRYFHHLLRPQQPSPLSPLSPTSHVKMEHSKMSPDKSPVGEGDHAGGSGSGGVGGDHQPSSSAMVPVEGGSGSAGGSGSGGPTRRPRGRPPGSKNKPKPPIIVTRDSPNALHSHVLEVAGGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEGEEEEVAAPAAGGEAQDQVAQSAGPPGQQPAASQSSGVTGGDGTGGAGGMSLYNLAGNVGGYQLPGDNFGGWSGAGAGGVRPPF

SEQ ID NO: 6791 - protein, 232 aa, Oryza sativa
  UNSURE (1)..(232): unsure at all Xaa locations
  Clone ID: PAT_MRT4530_44878C.1.pep
  unsure (1)..(232): unsure at all Xaa locations
TSPLSSFLSAPPPPKGSSLGRRTTREGETRPIRTNAYHKRYRAXLKRRRHGKTDYRTSTKLTIRDNIIVNTPRFRFAVRFTHQEHITAHMGYATIAGDMGMAGAYFHELXAYGLEAGLTNYAAAYCTGLAXARRVLKLLGXDQEFKGYMDAAGEDYXVEPADERRTFRALLDGGLIKTATGHRVFGALTGATDGGLDISHSDKRDAGFKMDEKQLDVCFHRMNIYSGHVADY

SEQ ID NO: 6792 - protein, 850 aa, Oryza sativa
  UNSURE (1)..(850): unsure at all Xaa locations
  Clone ID: PAT_MRT4530_44906C.1.pep
  unsure (1)..(850): unsure at all Xaa locations
MVSRSYSNLLDLATGAADQAPAPAALGALRRRLPRVVTTAGLIDDSPLSPSTPSPSPXARTIVVANHLPIRAHRPASPSEPWTFXWDEDFLLRHLQHSCSSPAMEFIYIGCLRDDIPLADQDAVAQALLESYNCVPAFLPPDIXERYYHGFCKQHLWPLFHYMLPLSPDLGGRFDRALWQSYVSANKIFADKVLEVINPDDDFVWVHDYHLMVLPTFLRKRFNRIKLGFFLHSPFPSSEIYKTLPVREELLRALLNSDLIGFHTFDYARHFLSCCGRMLGLSYESKRGHICLEYYGRTVSIKILPVGVNMGQLKTVLALPETEAKVAELMATYSGKGRVVMLGVDDMDIFKGISLKLLAMEELLRQHPEWRGKLVLVQDVDEVKGETYAMVRRINEAYGAPGYEPVVLIDEPLQFYERVAYYVVAEVCLVTGVRDGMNLIPYEYIVSRQGNEALDRMLQPSKPEEKKSMLVVSEFIGCSPSLSGAVRVNPWNIEAVADAMESALVLPEKEKRMRHDKHYRYVDTHDVGYWATSFLQDLERTCKDHAQRRCWGIGFGLRFRVVSLDLSFRKLAMEHIVMAYRRAKTRAILLDYDGTLMPQAINKSPSANSVETLTSLCRDKSNKVFLCSGFEKGTLHDWFPCENLGLAAEHGYFLRSSRDAEWEISIPPADCSWKQIAEPVMCLYRETTDGSIIENRETVLVWNYEDADPDFGSCQAKELVDHLESVLANEPVSVKSTGHSVEVKPQGVSKGLVARRLLASMQERGMCTDFVLCIGDDRSDEEMFQMITSSTCGESLAATAEVFACTVGRKPSKAKYYLDDTAEVVRLMQGLASVSNELARAASPPEDDDE

SEQ ID NO: 6793 - protein, 860 aa, Oryza sativa
  Clone ID: PAT_MRT4530_44907C.1.pep
MVSRSYSNLLDLATGAADQAPAPAALGALRRRLPRVVTTAGLIDDSPLSPSTPSPSPRPRTIVVANHLPIRAHRPASPSEPWTFSWDEDSLLRHLQHSSSSPAMEFIYIGCLRDDIPLADQDAVAQALLESYNCVPAFLPPDIAERYYHGFCKQHLWPLFHYMLPLSPDLGGRFDRALWQSYVSANKIFADKVLEVINPDDDFVWVHDYHLMVLPTFLRKRFNRIKLGFFLHSPFPSSEIYKTLPVREELLRALLNSDLIGFHTFDYARHFLSCCGRMLGLSYESKRGHICLEYYGRTVSIKILPVGVNMGQLKTVLALPETEAKVAELMATYSGKGRVVMLGVDDMDIFKGISLKLLAMEELLRQHPEWRGKLVLVQVANPARGRGKDVDEVKGETYAMVRRINEAYGAPGYEPVVLIDEPLQFYERVAYYVVAEVCLVTAVRDGMNLIPYEYIVSRQGNEALDRMLQPSKPEEKKSMLVVSEFIGCSPSLSGAVRVNPWNIEAVADAMESALVLPEKEKRMRHDKHYRYVDTHDVGYWATSFLQDLERTCKDHAQRRCWGIGFGLRFRVVSLDLSFRKLAMEHIVMAYRRAKTRAILLDYDGTLMPQAINKSPSANSVETLTSLCRDKSNKVFLCSGFEKGTLHDWFPCENLGLAAEHGYFLRSSRDAEWEISIPPADCSWKQIAEPVMCLYRETTDGSIIENRETVLVWNYEDADPDFGSCQAKELVDHLESVLANEPVSVKSTGHSVEVKPQGVSKGLVARRLLASMQERGMCTDFVLCIGDDRSDEEMFQMITSSTCGESLAATAEVFACTVGRKPSKAKYYLDDTAEVVRLMQGLASVSNELARAASPPEDDDE

SEQ ID NO: 6794 - protein, 143 aa, Oryza sativa
  Clone ID: PAT_MRT4530_44970C.1.pep
GMAVAYITPSDYLFWFRSHTAKEIKWGGAKHHPEDKDDGQRMHPRSSFKAFLEVVKSRSLPWENAEMDAIHSLQLILRDSFRDSAEGTSNSKAIVNGQVQLEELELRGIDELSSVAKEMVRLIETATVPIFAVDTDGCINGWN

SEQ ID NO: 6795 - protein, 161 aa, Oryza sativa
  Clone ID: PAT_MRT4530_45342C.1.pep
MTSSSSPSRKALSKIACNRLQKELAEWQVSPPSGFKYRVSDNLQRWVIEVTGAAGTLYAGETYQLQVDFPEHYPMEAPQVIFLNPAPMHPHIYSNGHICLDILYDSWSPAMTVSSVCISILSMLSSSPAKQRPQDNDRYVRNCRNGRSPKETRWWFHDDKV

SEQ ID NO: 6796 - protein, 293 aa, Oryza sativa
  Clone ID: PAT_MRT4530_45422C.1.pep
MAAAARSLALLSTASASLGLGVARSSARPRSPFGRGLALRGLSSSSSSFAATAAVMGKAGTAEAADAGMDAVQQRLMFEDECILVDEQDNVIGHDSKYNCHLMEKINSGHVLHRAFSVFLFNSKYELLLQQRSATKVTFPLVWTNTCCSHPLYRESELIEDKSLGVRNAAQRKLFDELGIQAEELPVDQFIPLGRMLYKAPSDGKWGEHELDYLLFMVRDVELSPNPEEVADVKYVNRDELKELLKKADAGEGGIKLSPWFRLVVDNFLMRWWDHVEQGTLEEAIDMKTIHKL

SEQ ID NO: 6797 - protein, 1172 aa, Oryza sativa
  Clone ID: PAT_MRT4530_4549C.1.pep
MADNGNAKPGGGGSGAYTINLDNFSKRLKVFYDHWKEHNSDLWGSSNAIAIATPPPSEDLRYLKSSALDVWLLGYEFPETIIVFMHKQIHFLCSQKKANLIGTLKKASNDAVGADIVLHVKAKNDSGVGLMEDIVRAVCAQSKSDDPIVGHIAKEAPEEKVIDEERKVTHSSLMDETEKAILDPLKVKVKLKAENVDICYPPVFQSGGKFDLKPGASSNDDYLYYDSASVIICAIGARYGNYCSNMARTFLIDATPAQSKAYETLMKAHEAALEALKPGNRMSAVYQAAVDVIEKNAPELLPNLTKSAGTGIGLEFRESGLNLNPKNDRIIKAGMVFNVSLGLLNLQAETKSEKTKQYSLLLADTCLVPLENLTASCSKLLKDVAYSFNDEDEVLPVKKVEVNAKEALPPTKATLRSDNQEMSKEELRRQHQAELARQKNEETARRLAGVGSGSGDGRGPSRSSNELVAYKNVNDVPYARELVIQVDQKNEAVLLPIHGSMVPFHVSTVKSVTSHQDNRTCTIRIFFNVPGMPFSNDSNLKSQGAIYLKEITFRSKDPRHSSEVVPQIKTLRRQVASRESERAERATLVTQEKLQLASNRNKPVRLSDVWIRPAFGGRGRKLTGTLESHVNGFRYSTSRADERVDIMYGNVKHAFFQPAEKEIITLLHFHLHNHIMVGNKKTKDVQFYVEVMDVVQTLGGNRRSALDPDEIEEEQRERDRKNRINMDFQNFVNKVNDHWSQPQFKGLDLEFDVPLRELGFHARRRRRRLPVRRCDVCHFDLRTCCALPPATLENDMFEVSAFAFLAEPPAAPAAAGGRICDACGDGVRGFVYHSDDPRPRPPPMLRVPAQARRGAGRPPLRAPQARAAAPACAARGAAAAATSGRTGPTTTTANPCTCTSRASRTDTAGGARRRCGGEIVLVSSSPAMDGVLQSVPRRRTPRSGGFERFCKIVNVVVSVIIAVIFGSPMAMISAVAGPDGRSRAAASAPSSSSSPVVVVGAVVIVVARRGRGRGGSRRRADVGRGGELAARGRRRRRGGSRPAAEVGSQRRADVGEEGAGWWRMDVGRGGEPASRSSSSPAHGGGVAVVVVVGGGGGKPVARGRWRGGSRPAARGRRERRGAGRRRGVAASRSSSSPAAEVGSRGGSQPQRSQTWGTDIYGYTYFGTEIISP

SEQ ID NO: 6798 - protein, 997 aa, Oryza sativa
  Clone ID: PAT_MRT4530_4550C.1.pep
MADNGNAKPGGGGSGAYTINLDNFSKRLKVFYDHWKEHNSDLWGSSNAIAIATPPPSEDLRYLKSSALDVWLLGYEFPETIIVFMHKQIHFLCSQKKANLIGTLKKAANDAVGADIVLHVKAKNDSGVGLMEDIVRAVCAQSKSDDPIVGHIAKEAPEEKVIDEGRKVTPSSSMHETEKTIRDPVKVEVKLKAENVAICYPPVFQSGGKFDLKPGASSNDDYLYYDSASVIICAIGARYGNYCSNMARTFLIDATPTQIKAYETLMKAHEAALEALKPGNRMSAVYQAAVDVIEKNAPELLRNLTKSAGTGIGLEFRESGLNLNPKNDRIIKAGMVFNVSLGLHNLQAEKKSEKTKQYSLLLADTCLVLLENLTASCSKLVKDVAYSFNDEDEVLPVKKVEVNAKEALPPTKATLRSDNQEMSKEELRRQHQAELARQKNEETARRLAGVGSGSGDGRGPSRSSNELVAYKNVNDVPYARELVIQVDQKNEAVLLPIYGSMVPFHVSTVKSVTSHQDNRTCTIRIFFNVPGMPFSNDSNLKSQGAIYLKEITFRSKDPRHSSEVVQQIKTLRRQVASRESERAERATLVTQEKLQLTSNRNKPVRLSDVWIRPAFGGRGRKLTGTLESHVNGFRYSTSRADERVDIMYGNVKHAFFQPAEKEMITLLHFHLHNHIMVGNKKTKDVQFYVEVMDVVQTLGGNRRSALDPDEIEEEQRERDRKNRINMDFQNFVNKVNDHWSQPQFKGLDLEFDVPLRELGFHGVPYKASAFIIPTSTCLVELIETPFLVVTLSEIEIVNLERVGFGTKNFDMAIVFKDFKKDVLRIDSIPSTSLDAIKEWLDTTDLKYYESRLNLNWRPILKTIIDDPQKFIDDGGWEFLNMEASDSETEETEESDQGYEPSDAEPESESEDEDSDSESLVESDEDDEDDSEEDSEEEKGKTWEELEREASNADRENGAESDSEEERRRRKVKTFSKSRPPPERSSFKGGPSKKPKFR

SEQ ID NO: 6799 - protein, 404 aa, Oryza sativa
  Clone ID: PAT_MRT4530_45989C.1.pep
MKLHFVLRFLFGPVPVYFSALAILILLTNAQYFGLVGVTVPRATKLASSAPVVSVMKYCDIFRGEWVPDSDAPYYNHKTCYMIQEHQNCLKYGRPDLEFLKWRWRPSGCELPRFDPVQFLQFNRHKSLAFVGDSLARNHMQSLLCLLSQVAYPKDMSANPTTQNKVYHYRGYNFTVSMFWSPFLVKAREPDHDGPAHTGHWSLYLDEPDQSWVSEISRFDYVLVSAANWFSRPSLFYEKRRLVGCSFCSRQYGVPDLTLYYSQRRAWRVALKAINDLESLRGRVIVRMLSPMSHFENGTWDQGGNCKRTQPLRSNETVMEGRDLHFYTAQMEEYRAAEKVAEAKGRRMMLMDATAAMLMRPDGHPSRYGHLPNQKVQLYNDCIHWCLPGPIDIWNDMLFQMLLV

SEQ ID NO: 6800 - protein, 496 aa, Oryza sativa
  Clone ID: PAT_MRT4530_45999C.1.pep
MGENGVVASKLCYPAAAMEVVAAELGHTAGSKLYDDDGRLKRTGTMWTASAHIITAVIGSGVLSLGWAIAQLGWVAGPAVMLLFSFVTYYTSALLADCYRSGDESTGKRNYTYMDAVNANLSGIKVQVCGFLQYANIVGVAIGYTIAASISMLAIKRANCFHVEGHGDPCNISSTPYMIIFGVAEIFFSQIPDFDQISWLSILAAVMSFTYSTIGLGLGVVQVVANGGVKGSLTGISIGVVTPMDKVWRSLQAFGDIAFAYSYSLILIEIQDTIRAPPPSESRVMRRATVVSVAVTTLFYMLCGCTGYAAFGDAAPGNLLTGFGFYEPFWLLDVANAAIVVHLVGAYQVYCQPLFAFVEKWAQQRWPKSWYITKDIDVPLSLSGGGGGGGRCYKLNLFRLTWRSAFVVATTVVSMLLPFFNDVVGFLGAVGFWPLTVYFPVEMYIVQKRIPRWSTRWVCLQLLSLACLAITVASAAGSIAGILSDLKVYKPFATTY

SEQ ID NO: 6801 - protein, 216 aa, Oryza sativa
  Clone ID: PAT_MRT4530_46101C.1.pep
MALVYSESSLTGIQLIICKAARPGDQAQPNRKLPRNSSNLKTPKEFHATDPWGHMVRVYQLLLKGRDALMKLGITGKKYTQPARCYMIAFVLVYTNTINHLWLMPLALELPLPTAHWAKWCGCLRIDPLEYAVEMESVVAGAPDERAIVAGELTIRAAAVECHPAYTTGFILGVPCPRSHRMPLKNLDLHLWSGCLRIDPTSVCSGDGKRGCRSPR

SEQ ID NO: 6802 - protein, 262 aa, Oryza sativa
  Clone ID: PAT_MRT4530_46195C.1.pep
MSAQAELSREENVYMAKLAEQAERYEEMVEFMEKVAKTVDSEELTVEERNLLSVAYKNVIGARRASWRIISSIEQKEESRGNEDRVTLIKDYRGKIETELTKICDGILKLLESHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDTAEEIREAPKRDSSEGQ

SEQ ID NO: 6803 - protein, 109 aa, Oryza sativa
  UNSURE (1)..(109): unsure at all Xaa locations
  Clone ID: PAT_MRT4530_46419C.1.pep
  unsure (1)..(109): unsure at all Xaa locations
LDRPAIETAAGDRYTRGGGTRSTACCADRSMXSSNYRPKAWRPSSTFYGKSWRVNTGRCAACGRHCKEASRTGLAPEXEIWDSMEEFLTKETPDNNLIRLLISMGEAMR

SEQ ID NO: 6804 - protein, 73 aa, Oryza sativa
  Clone ID: PAT_MRT4530_4653C.1.pep
GFLFLTRVSGLGQLKADRWGREFSLGCLIFFAALPFGGPNKWGGWPSPGHGPMDFFLGFGQVEQYLWNLGFFR

SEQ ID NO: 6805 - protein, 762 aa, Oryza sativa
  Clone ID: PAT_MRT4530_46959C.1.pep
MAILSDVATEVLIPIAAIIGIGFSIAQWVLVARVKLAPSQPGASRSKDGYGDSLIEEEEGLNDHNVVAKCAEIQNAIAEGATSFLFTEYQYVGVFMSIFAVVIFLFLGSVEGFSTKTHPCTYSKDKECKPALFNALFSTVSFLLGAITSVVSGFLGMKIATYANARTTLEARKGVGKAFITAFRSGAVMGFLLASNGLLVLYIAINLFKMYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSMGIIVCLITTLFATDFFEIKAVKEIEPSLKKQLIISTALMTVGIALVSWLALPYKFTIFNFGEQKEVTNWGLFLCVSIGLWAGLIIGYVTEYYTSNAYSPVQDVADACRTGAATNVIFGLALGYKSVIIPIFAIALGIYVSFTIAAMYGIAVAALGMLSTIATGLSIDAYGPISDNAGGIAEMAGMSHRIRERTDALDAAGNTTAAIGKGFAIGSAALVSLALFGAFVSRAGVKVVDVLSPKVIIGLIVGAMLPYWFSAMTMKSVGSAALKMVEEVRRQFNTIPGLMEGTGKPDYANCVKISTDASIKQMIPPGALVMLTPLIVGTLFGVQTLSGVLAGALVSGVQVAISASNTGGAWDNAKKYIEAGASEHARSLGPKGSDCHKAAVIGDTIGDPLKDTSGPSLNILIKLMAVESLVFAPFFATHGGILFKLF

SEQ ID NO: 6806 - protein, 256 aa, Oryza sativa
  Clone ID: PAT_MRT4530_47006C.1.pep
MKLAVVAVAALLLAAGVASADEFDFFYLVQQWPGSFCDTQAGCCFPDTGKPAAEFGIHGLWPNYAKCRPAAGAVADDDDGVVEMVVDGGAAVERHHRRRQKCWPEYCDDGNKLRPWEIKDLVAELDANWPTLSCKGGKSFEFWSYEWKKHGTCSGMGQHGYFAAALELKKRHDLAAVLAGAGIVPSDDESYSLGSIRDAIAAATGAVPNLECNRDAAGETQLFQVYQCVDRSGKKLVDCQLPMQGKCRDKVKLPTF

SEQ ID NO: 6807 - protein, 131 aa, Oryza sativa
  Clone ID: PAT_MRT4530_47125C.1.pep
SARAFGENMVMSELVECCKELDEVHHALAGHKKEAAWRLSRVELQLESEKAGRRREKMEEIEAKIKALREEQTAALDRIEAEYREQLAGLRRDAESKEQKLAEQWAAKHLRLTKFLEQVGCRSRLTEPNGR

SEQ ID NO: 6808 - protein, 135 aa, Oryza sativa
  Clone ID: PAT_MRT4530_47568C.1.pep
MAGRGKAIGSGAAKKAMSRSSKAGLQFPVGRIARFLKAGKYAERVGAGAPVYLAAVLEYLAAEVLELAGNAARDNKKTRIVPRHIQLAVRNDEELSRLLGTVTIASGGVMPNIHNLLLPKKAGGSAKAAAGDDDN

SEQ ID NO: 6809 - protein, 67 aa, Oryza sativa
  Clone ID: PAT_MRT4530_47854C.1.pep
QWFYSLPFKLLVQKQVGVCGTRPGWGWGSLLNCLVALPVFLFAFLLVFIVMVKKKKKKKKKKKKKQQ

SEQ ID NO: 6810 - protein, 892 aa, Oryza sativa
  Clone ID: PAT_MRT4530_47879C.1.pep
MAAAALRLAVLAVAIGALVASSSAAVCPHANHTAPFAADFTMLQHQLRGTVRLADDDSCALRLTRFDLLAASPSARFWAARGDSLADLAAGRAFSPHPLNSTFRNATLLLPFSAPLPPLLALFDPDTSSDLGHVFLPVSASASASNATDDSGVASPSPSPEPVPTMFDNCLPLAENKYRLRWTLNASAGTVEIGLEAAVGSEYYMAFGWADPKANSPAMIHSDVAVAGFTEEGMPFAEDYYITDYSECTLGTDESPVSGVCPDKVYDEGKNDSLLVYGHRRDGVSFVRYQRKLDTGDTKYDVLVSATEEMAVVWAIGKLRPPDTLRPHYLPQNHGGPRDTTYGFARVNLSETVDSCNGPLDADNKEDQERIIADAKTPLVVTSAPAVRYPNPPNPDKVIYINKKEAPLLKVERGVPVKFSVQAGHDVALYITSDPIGGNATLRNKTEVIYAGSRDAHGVPATPTELLWLPDRNTPDLVYYQSLYEPKMGWKVQVVDGGLSDMYNSSVLLDDQQVTLFWTLSHDSISIAARGEKKSGYLAVGFGSGMLNSYAYVGWVGNDGVGRVKSYWIDGKSAAGIHPTSENLTYVRCRSENGIITFEFTRPLRPSCSGRVECKNIIDPTTPLKVVWAMGASWSGNSLTDSNMHSITSSRPIRVLLLRGSAEAEQDLRPVLAVHGFMMFVAWGILLPGGILAARYLKNLKGDGWYQIHVYLQYSGIAIMFLGVLFAAAELRGFYVSSVHVKFGVTALLLAGLQPLNAYFRPKRPANGEASSWNRVLWEYLHVITGRSAIIVGIVALFTGMKHLGHRYDSENVEELTWALMLWVLSAIVITLYLEYKEVKRRSGDTSSRGHWVLGNTEEDDSVDLLHPDSTDRNSESSPSGVMEVQLEPLAR

SEQ ID NO: 6811 - protein, 206 aa, Oryza sativa
  Clone ID: PAT_MRT4530_48062C.1.pep
MAEVEAAPIAAAETPEVAAAEGAAAAKAPHKLHRQWAFWYDIQSKPKPGAAWGTSLRKAYTFDTVEEFWGLYDQIFRPSKVTVNADFHLFKAGVEPKWEDPECANGGKWTVPCSRKTTLENMWLETLMALIGEQFDESEEICGVVASVRQRGDKLALWTRTASNEAVQVNIGKKWKEIVDYNDKMVYSFHDDAKREKPSRGGRYNV

SEQ ID NO: 6812 - protein, 303 aa, Oryza sativa
  Clone ID: PAT_MRT4530_48097C.1.pep
MATASSINKRFSLAGATALVTGGSKGIGRAIVEELASFGATVHTCARNQAELSRCQEEWTAKGLAVTVSVCDVAVRADREALAGRVSAMFDGKLSILVNNAGTAYLKPAADLTPEETSRLMTTNFESCFHLSQLFYPLLKDSGRGSIVNISSVASVLAFHSLPIYSAAKGAMNQVTRNLACEWASDGIRVNSVAPGYIQAPLLAAFVAGNDFAQVEFNRLPLGRLGKPEDISSLVAFLCMPAASYITGQIICVDGGRLPAVTLKYSKQPQTRTKITCTNLVDGIKIEPVRMKPIGRASTGDHK

SEQ ID NO: 6813 - protein, 135 aa, Oryza sativa
  Clone ID: PAT_MRT4530_48394C.1.pep
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATIASGGVMPNIHQHLLPKKAGSSKASHADDDDN

SEQ ID NO: 6814 - protein, 194 aa, Oryza sativa
  Clone ID: PAT_MRT4530_49221C.1.pep
MDSAGFFTFVVARRKEVDALRAELPDALKRCVDPARFAMDAVSEVFPIDKRAVRSPTDLAWACVLILEAVVPSLADPDPEIGAARPMVPQAARERARGMAREWKDAAEKKGGVEGAKPPDAHAFLQHVATFAVAEKEDKELYRRIVVSFSWRRQMPRLAITLGLEDEMDDIIEELITKGQQLDAVNFAYEAGLQ

SEQ ID NO: 6815 - protein, 369 aa, Oryza sativa
  UNSURE (1)..(369): unsure at all Xaa locations
  Clone ID: PAT_MRT4530_49446C.1.pep
  unsure (1)..(369): unsure at all Xaa locations
SARACRRDRRAIISKEXEGTLLGMGNPLLDISAVVDEDFLKKYDITSNNAILAEDKHKPMYQELAEKYNVEYIAGGATQNSIKVAQWMLQVPGATSYMGGIGKDKFGEEMKKNSKLAGVNVHYYEDETTPTGTCAVCIVGGERSLVANLAAANCYKSDHLKRPENWALVEKAKYIYIAGFFLTVSPDSIQLVAEHSAANNKIFSMNLSAPFICEFFRDVQEKALPYTDFVFGNETEARTFSKVHGWETDNVEEIAVKISQWPKASGTHKRITVITQGADPICVAEDGKVKKFPVKLLPKEKLVDTNGAGDAFVGGFLSQLVQEKPIEECVRAGCYAAXCYHPKGLACTVPRRTPDFLLRCFSSVSCSPL

SEQ ID NO: 6816 - protein, 99 aa, Oryza sativa
  Clone ID: PAT_MRT4530_49943C.1.pep
RHEGSRGETKSVAGDSSTHNTVEGERKKSAAAKYPGDSQQHSLSFSRQDNKSYVPPFLSGSTNDSSSRTLSLVGSEASNGFSLGGKSGNTSAPAATSAA

SEQ ID NO: 6817 - protein, 351 aa, Oryza sativa
  Clone ID: PAT_MRT4530_49986C.1.pep
MARIHADPVLEADQFDRLPDSLVLVILNNVEDVRSLGRCSAVSKRFYGLVPLVHDVYVKIDRVVTVDGEAEDALNLSSPKPRNILSHFLKMMLFTIIKPFHSMRGPNGAGRPLFPQLAQHSPAQVLRNFTHIRNLRVELPSGDVGTEEGVLLKWRAEYGSTLQNCVILGGTQVDRKPVGAEHELYSEDNGSMPESFYTNGGLKLRVVWTISSLIAASTRHYLLRSIIKDHPTLTSLVLTDADGQGTLSMGAEQLKEFRENQLSASACSNRTQVPACNMKLKYAPYLELPGGIALQGATLVAIKPSPEGSNGGHTSRKETDAFVSGAFDGPFKFAVKALMKRRTYLLEMNGF

SEQ ID NO: 6818 - protein, 173 aa, Oryza sativa
  Clone ID: PAT_MRT4530_50367C.1.pep
MMRPPAARGERKRKVMASVDTHDHGNTELPDSNENADESLRSPENGERLASGSGCVDSNGDVEKKKMPLASCSSGSKKQKRRVEATSPAEHGEDAPSAPKLVENSSSSKKKGKKKPAAPEAVTDAVVVDEPAPVLPEVNVVVVEPEKPKKKYVPITPTIHTGFSFSIVHLLTA

SEQ ID NO: 6819 - protein, 527 aa, Oryza sativa
  Clone ID: PAT_MRT4530_50542C.1.pep
MICAISGEVPDEPVVSKKSGLLFERRLVERYIEDHGKCPVTKEELTMDDIVAVKTNKVVKPRQLQAASIPGLLGMFQNEWDAIMLSSFALEQQLHTARQELSHALYQHDAACRVIARLKKERDEARALLAQAERQIPASMAGAAPTAVVSNGKRAFEDEVGPDGKKIRPGINPVMIDELTECNTMLSAHRKKRQVPPTLASIDAIERYTQISSHPLHKTNKPGILSMDIHPSKDIIATGGIDTNAVLFDRPSGQILCTLTGHSKKITSLKFVPRDELFVTGSADKTVKIWQGSEEGNYNCIHTLKDHTAEVEAVTVHATQKYFVTASKDNTWCFYDIPSGSCLTQVGESSGQEGYTSASFHPDGLILGTGTTEAVVKIWDVKTQSNVAKFEGHVGPVTAMSFSENGYFLATAALDGVKLWDLRKLRNFRTISPYDSDTPTNSVEFDFSGSYLAVGGSDTRVYQVANVKLEWNLVKTLPDLSGTGKVTNVKFGTDAKYIAVGSMDRNLRIFGHPGEDDQMDDAKPSEE

SEQ ID NO: 6820 - protein, 110 aa, Oryza sativa
  UNSURE (1)..(110): unsure at all Xaa locations
  Clone ID: PAT_MRT4530_5060C.1.pep
  unsure (1)..(110): unsure at all Xaa locations
MGMGEVAEDIYTXDGTVDLKGGPGTRMNTGTWHACRYILCNECCKRLGYYGMSTNLVIYMKTRVGQESAIVDNNVTNWSVTRYMTRLDSALLADAYMGRLWTIASSMSIY

SEQ ID NO: 6821 - protein, 260 aa, Oryza sativa
  Clone ID: PAT_MRT4530_50714C.1.pep
MSPAEASREENVYMAKLAEQAERYEEMVEFMEKVAKTTDVGELTVEERNLLSVAYKNVIGARRASWRIISSIEQKEESRGNEAYVASIKEYRSRIETELSKICDGILKLLDSHLVPSATAAESKVFYLKMKGDYHRYLAEFKSGAERKEAAENTLVAYKSAQDIALADLPTTHPIRLGLALNFSVFYYEILNSPDRACNLAKQAFDDAIAELDTLGEESYKDSTLIMQLLRDNLTLWTSDNAEDGGDEIKEAAKPEGEGH

SEQ ID NO: 6822 - protein, 394 aa, Oryza sativa
  Clone ID: PAT_MRT4530_50741C.1.pep
MDRPPPDQQRQKQAPLFSPYQMPRFRLNHRVVLAPMTRCRAIGGVPGPALAEYYAQRTTQGGLLISEGTVVSPAGPGFPHVPGIYNQEQTDAWKKVVDAVHAKGGIFFCQLWHVGRASHQVYQPNGAAPISSTDKPISARWRILMPDGSYGKYPKPRRLAASEIPEIVEQYRQAAINAIEAGFDGIEIHGAHGYIIDQFLKDGINDRTDEYGGSLSNRCRFLLEVTRAVVSAIGADRVAVRISPAIDHLDAYDSDPIKLGMAVVERLNALQQQSGRLAYLHVTQPRYTAYGQTESGQHGSAEEESRLMRTLRGTYQGTFMCSGGYTRELGLEAVESGDADLVSYGRLFISNPDLVERFRLNAGLNKYVRKTFYTPDPVVGYTDYPFLGQPKSRM

SEQ ID NO: 6823 - protein, 414 aa, Oryza sativa
  Clone ID: PAT_MRT4530_50815C.1.pep
MSQLFFHCCPRVRSFADSLSSPSLSSLARSSSAARAPATRRVGPADNRREGEAPSPWGAPMTSCGCLVLEKVEDHGGEAAGRGRGRLAQGGGGGGGGCGSCAGEWRSRSETMFPIYVMGSSRASSAAAARGIVDAAGDPIWEAVKSEAKSEAEKEPILSSFLYASVLSHDCLERALSFVLANRLEDPTLLATQLIDIFNDVMMNNKDIRRSIRLDAQAFKDRDPACAQYSWALLYLKGYHSVQSYRIAHVLWNQGRKVLALALQSRISEVFAVDIHPAARIGEGILLDHGTGLVIGETAIVGNWVSLMQGVTLGGTGKENGDRHPKIGQGALLGAGATILGNINVGEGAMIAAGSLVLKDVPPHSMAVGNPAKVVGYKDKEDPSLTMKHDARRDYFEHVAVSFSDDKANGSVVK

SEQ ID NO: 6824 - protein, 55 aa, Oryza sativa
  Clone ID: PAT_MRT4530_5101C.1.pep
PRVRHQAVAYTTYYVTEEEKEGVAKKLDEAKAWVKPWMVFKELHEFTPANACANA

SEQ ID NO: 6825 - protein, 86 aa, Oryza sativa
  Clone ID: PAT_MRT4530_51172C.1.pep
PVVSLGGEQQRIAIWSKNAATAAAQMSLCKQWQPFLDHTHSIAFLVHCHATVTQFDLSTPVQISNKVVYPHAGWVFCYAVVFVIRM

SEQ ID NO: 6826 - protein, 176 aa, Oryza sativa
  UNSURE (1)..(176): unsure at all Xaa locations
  Clone ID: PAT_MRT4530_513C.1.pep
  unsure (1)..(176): unsure at all Xaa locations
SPGREHIAPPLLSRASVRRLVSVKNRRLPPSASAAALPNSGDDYSQGXQWKCKQFLWKDRKGIHLLNGIKASSLLEPSCWPXKLFISGLQHLNGVSVLPMLRTLLSLLKRYPILSKSLWLALESFGLATVWLSHRKTGIFSALMLQWLVQACISFLVKXRKDYFSDEKDAAASLEG

SEQ ID NO: 6827 - protein, 392 aa, Oryza sativa
  Clone ID: PAT_MRT4530_51503C.1.pep
METVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLIEKAGGYSSDGKQSVLDKVINNLDERTQVAYGSKNEIIRFEETLYGSSRLTAGATVGAAA

SEQ ID NO: 6828 - protein, 356 aa, Oryza sativa
  Clone ID: PAT_MRT4530_51616C.1.pep
MWRLKVAQGGGALLRSTNGFAGRAVWEFDPDHGTPEDRANVERVRRDFTDHRLRRPESADLLMRMQFARENNHQRRGDRIPPAVNKLGEKEQVTEETVMASLRRALDEFSSLQADDGHWPGDLSGAIFIMPVLIFSLYATGSLDTVISSEHRREICRYIYNHQNEDGGWGMLILGSSTMFATCLNYVTLRLIGEEPSNEQLARGHAWIISHGGATLVPQWGKICLSFIIRGKFWGPTRVVYVPMAYLYGKKFVGPITPTILALREEIYTDPYHTIDWAQACNACSKEDLVCPRTLLQNVVWTSLYKWVEPVLGSRPMNKLRERALDRLMEHIHYEDENSQYLCLCPVNKGKKWRQR

SEQ ID NO: 6829 - protein, 273 aa, Oryza sativa
  Clone ID: PAT_MRT4530_51694C.1.pep
MSPAADSAASKRQAELLKQEGNAFFKKDRISAAIDAYTGAIALCPKVAVYWTNRALCYKRRNEWVRAEEDCRTAIQLDSHSVKAHYMLGLALLNKDELAEGIKELEKSLELGRGAHPASYMVEEIWQELSKAKYIEWENLSSERVRQLHKLKEACKEALRNYNSLDNPPAYVPEEQLNELEEVFRNARKSDIPTEVPDHLCCKITLDIFRDPVITPSGITYERAVILDHLHRVGKFDPVTRETLEPHQLVPNLAIKEAVHAFLSEHGWAYRMR

SEQ ID NO: 6830 - protein, 259 aa, Oryza sativa
  Clone ID: PAT_MRT4530_51807C.1.pep
MVSPDTIRTAIGVVGNGTALVLFLSPVPTFIRIWKKGSVEQYSAVPYVATLLNCMMWVLYGLPAVHPHSMLVITINGTGMAIELTYIALFLAFSLGAVRRRVLLLLAAEVAFVAAVAALVLNLAHTHERRSMIVGILCVLFGTGMYAAPLSVMKMVIQTKSVEYMPLFLSLASLVNGICWTAYALIRFDLYITIPNGLGVMFAVAQLILYAIYYKSTQQIIEARKRKEADHVAMTDVVVDSAKNNPSSGAAAAAANGRY

SEQ ID NO: 6831 - protein, 346 aa, Oryza sativa
  Clone ID: PAT_MRT4530_51828C.1.pep
GHHDCSPGLSDNSMSKEDAMSTGDSTESLDIDCLDDGDSEVVSSLQHLADDKLHISDNRDVAGVASKWTKHGCNSVEIDYIVDIDNNHEDPQLCATLAFDIYKHLRVAEQTKKRPSTDFVETIQKNIDTSMRAVLIDWLVEVTEEYRLVPETLYLTVNYIDRKYEEICPPQVEELCYISDNTYTKDEVLKMEASVLKYLKFEMTAPTTKCFLRRFLRAAQVCHEAPVLHLEFLANYIAELSLLEYSLICYVPSLIAASSIFLAKFILKPTENPWNSTLSFYTQYKPSDLCNCAKGLHRLFLVGPGGNLRAVREKYSQHKYKFVPKKYSPPSIPSEFFEDPSSYKPD

SEQ ID NO: 6832 - protein, 506 aa, Oryza sativa
  UNSURE (1)..(506): unsure at all Xaa locations
  Clone ID: PAT_MRT4530_52012C.1.pep
  unsure (1)..(506): unsure at all Xaa locations
MALNLAQSAAAAACFATAGDARRAASVVAMPSSSSSATTSLRMKRQAACEPVACRAVARHVAAAAASSRRNGVPVFVMMPLDTVSKCGSALNRRKAVAASLAALKSAGVEGIMVDVWWGIVESEGPGRYNFDGYVELMEMARKTGLKVQAVMSFHQCGGNVGDSVNIPLPRWVVEEMEKDNDLAYTDQWGRRNFEYISLGCDAMPVFKGRTPVECYTDFMRAFRDHFASFLGDTIVEIQVGMGPAGELRYPSYPESNGTWRFPGIGAFQCNDRYMRSSLKAAAEARGKPEWGHGGPTDAGGYNNWPEDTVFFRGDCGGWSTEYGEFFLSWYSQMLLEHGERVLSGATSVFGDGAGAKISVKVAGIHWHYGTRSHAPELTAGYYNTRHRDGYLPIARMLARHGAVLNFTCVEMRDHEQPQEAQCMPEALVRQVAAXAARAAGVGLAGENALPRYDGTAYEQVVAAAADRAAGDRMVAVTYSVMLPDRXEPQNQLRFRAFNYGGRGGD

SEQ ID NO: 6833 - protein, 461 aa, Oryza sativa
  Clone ID: PAT_MRT4530_52053C.1.pep
MAFFRGLTAVSRLRSRVAQEATTLGGVRWLQMQSASDLDLKSQLQELIPEQQDRLKKLKSEHGKVQLGNITVDMVLGGMRGMTGMLWETSLLDPDEGIRFRGLSIPECQKVLPTAVKDGEPLPEGLLWLLLTGKVPTKEQVDALSKELASRSSVPGHVYEAIDALPVTAHPMTQFTTGVMALQVESEFQKAYDKGMSKSKFWEPTYEDCLNLIARLPAVASNVYRRISRGMKANFSHMLGFDDPKTLVSLPVYSQWTTDHEGGNVSAHTGHLVGSALSDPYLSFAAALNGLAGPLHGLANQEVLLWIKSVIGETGSDVTTDQLREYVWKTLKSGKVVPGFGHGVLRKTDPRYTCQREFALKYLPEDPLFQLVSKLYEVVPPILTELGKVKNPWPNVDAHSGVLLNHFGLSEARYYTVLFGVSRSIGIGSQLIWDRALGLPLERPKSVTMEWLENHCKKVAA

SEQ ID NO: 6834 - protein, 167 aa, Oryza sativa
  Clone ID: PAT_MRT4530_52055C.1.pep
KVPTKEQVDALSKELASRSSVPGHVYEAIDALPVTAHPMTQFTTGVMALQVESEFQKAYDKGMSKSKFWEPTYEDCLNLIARLPAVASYVYRRIFKGGKTIAADNALDYAANFSHMLGFDDPKMLELMRLYITIHTDHEGGNVSAHTAHLVGSALSDPYLSFAAALN

SEQ ID NO: 6835 - protein, 471 aa, Oryza sativa
  Clone ID: PAT_MRT4530_52057C.1.pep
MAFFRGLTAVSRIRSRMAQEATTLGGVRWLQMQSPSDLDLKSQLQELIPEQQDRLKKLKSEHGKVQLGNITVDMVLGGMRGMIGMLWETSLLDPEEGIRFRGLSIPECQKVLPTAIKGGEPLPEGLLWLLLTGKVPTKEQVDALSKELVTRSSVPGHVYKAIDALPVTAHPMTQFTTGVMALQVESEFQKAYDKGMSKSKFWEPTYEDCLNLIARLPAVASYVYRRIFKGGKTIAADNALDYAANFSHMLGFDDPKMLELMRLYITIHTDHEGGNVSAHTGHLENPGVSVWPFNALGKVGSALSDPYLSFAAALNGLAGPLHGLANQEVLLWIKSVIGETGSDVTTDQLKEYVWKTLKSGKIVCHDTFIRRLFLALVMEFYVSKLYEVVPPILTELGKVKNPWPNVDAHSGVLLNHFGLSEARYYTVLFGVSRSIGIGSQLIWDRALGLPLERPKSVTMEWLENHCKKAAA

SEQ ID NO: 6836 - protein, 324 aa, Oryza sativa
  Clone ID: PAT_MRT4530_52242C.1.pep
MAFTVKASSPSSPAASSSSSSAPAKLGAAPGRVAVRKLTAAATSLRLDRAPAAPATERGLSSVSRTMSRLMEKGKTAFIPYITAGDPDMGTTAEALRLLDACGADVIELGVPFSDPYNDGPVIQASAARALSAGATMDGIMSMLAEVTPELSCPVVLFSYLGPIVRRGPANFTAAAKEAGVQGLIVPDLPYLEACSFRSEVIKNNLELVLLTTPTTPPDRMKAITAASGGFVYLVSVNGVTGSRQDVNPRVEHLLQEIKQVTDKAVCVGYGISTPDHVRQIAEWGADGVIIGSAMVRQLGEAASPKQGLKRLEKYARSLKNALP

SEQ ID NO: 6837 - protein, 391 aa, Oryza sativa
  UNSURE (1)..(391): unsure at all Xaa locations
  Clone ID: PAT_MRT4530_52965C.1.pep
  unsure (1)..(391): unsure at all Xaa locations
MDPNDAFSAAHPFRWDLGPPAPAPVPPPPPPPPPPPPANVPRELEELVAGYGVRMSTVARISELGFTASTLLAMTERELDDMMAALAGLFRWDLLLGERFGLRAALRAERGRLMSLGGRHHGHQSGSTVDGASQEVLSDEHDMAGSGGMGDDDNGRRMVTGKKQAKKGSAARKGKKARRKKVDDLRLDMQEDEMDCCDEDGGGGSESTESSAGGGGGERQREHPFVVTEPGEVARAKKNGLDYLFHLYEQCRLFLLQVQSMAKLHGHKSPTKVTNQVFRYAKKVGASYINKPKMRHYVHCYAXLHCLHEEASDALPRPYQAXAAKNVGPWSQACYAPLVDISARHGFDIDAVFAAHPRLAIWYVPTRLRQLCHQARSSHAAAAAALPPPLF

SEQ ID NO: 6838 - protein, 103 aa, Oryza sativa; identical to SEQ ID NO: 3555
  Clone ID: PAT_MRT4530_53245C.1.pep

SEQ ID NO: 6839 - protein, 139 aa, Oryza sativa
  Clone ID: PAT_MRT4530_53246C.1.pep
HSYGRLGPSRPAGTSKIPKSSRSSSSSTSSSYASSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6840 - protein, 276 aa, Oryza sativa
  Clone ID: PAT_MRT4530_53248C.1.pep
MPQVLPGGSLLYRSLVRVRLFPSVDFVKDFLSVRGKYPYARGEKNLSKAKRQVPTPIVPWPRRRPNLAAPAGQNFELAASQTTKIPTIPPNHRSAPHATSTIRSSPRDPDPHRPFPPPSNGSRLPTPSSRPLLKPPPLSSPNPTPITTTSSPIPLAFLSLSCVEPPESSSSAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6841 - protein, 407 aa, Oryza sativa
  UNSURE (1)..(407): unsure at all Xaa locations
  Clone ID: PAT_MRT4530_53359C.1.pep
  unsure (1)..(407): unsure at all Xaa locations
LRDATTVSECLHTFCRKCIYEKLNDEEVESCPVCKIDLGCTPVEKLRADHNLQDVRSKIFPFKRKKISADEVAAPVLLPSKRKERSISSLVVDTPTVTPTGLTGRRTRAVTRKAAALRGLGPGIDDPVKKEIDNGEKHAQNSSLPTNLGKVPQTRRQMSSNAEASNHSSNKDTEGDRKDLADKTDELWRPLNCLVEAANRTKSSRSSSQSPFVKREQLSDSPGSTSVNKTKSREYMQKSKIEDDKKDVPLLKRKNQRTGRRRELHAQSDSKPEAAATQNEKKFSSIWFSLVASFEQEGDPPLPQIPSHYLRIKDGNIPASSIQKYLMQKLGLPNEAEIMETFIELSQLHXVEINCCGQPVNPTQPLCNLVEVWLRGRSTQTTQTMIGSPAKEFVMVLTYGRPKAITP

SEQ ID NO: 6842 - protein, 813 aa, Oryza sativa
  Clone ID: PAT_MRT4530_53617C.1.pep
MACSFLCKPWLPLTESAKPARSPAPSSRARTVVQQLAVLLLLLGGVGGGGGALLAAAASTTDTILPGESITGNQTLVSKNGEFELGFFNPGVGIHYFLGVRLRKLAAYSPTFWIGDRVYVVDLPRAALELFGDSLYIKEDGASLWWSSPSSSSSSSGGGRGGGAAVAVLLDTGDLVVRDQRNSSLVLWRSFDYPGDALLPGGRLGLDVATGENVSLTFEGFTHNGSLRADASRRNGFVLTTDGRDTRGAFPDWMVTTQDNGGSLVLNHPDATNSTEFLQLKVGQVSLVRWSGADAGWVPRWTFPSGCKSGGGFFCGDFGVCTTATGGECRCVDGFAPSDTKEWGLGYFVTGCSRSLPLSCDANGQTEHGDSFAILDNLQGLPYNAQDEPATTDEDCREACLNKCYCVAYSTETGCKLWYYDLYNLSSADKPPYSKIYVRLGSKLKSKRGLATRWMVLLVVGSVAVASAMLAVLLLCRYRRDLFGSSKFVVEGSLVVYSYAQIKKATENFSDKLGEGGFGSVFRGTLPGSTTVVAVKNLKGLGYAEKQFRAEVQTVGMIRHTNLVRLLGFCVKGNRKLLVYEYMPNGSLDAHIFSQKSSPLSWQVRYQIAIGIARGLAYLHEECEHCIIHCDIKPENILLDEEFRPKIADFGMAKLLGREFNAALTTIRGTRGYLAPEWLYGQPITKKADVYSFGIVLFEMISGIRSTVTMKFGSHRYYPSYAAAQMHEGDVLCLLDSRLEGNANVEELDITCRVACWCIQDREGDRPSMGHVVRMLEGVVDTEMPPIPASFQNLVDGDDSDIYEENWRLRTQD

SEQ ID NO: 6843 - protein, 399 aa, Oryza sativa
  UNSURE (1)..(399): unsure at all Xaa locations
  Clone ID: PAT_MRT4530_53892C.1.pep
  unsure (1)..(399): unsure at all Xaa locations
MMMTSGRPSGGAGGGRYPXFTAWQWQERERQALIYKYMASGTPIPSDLTLXPLRRSFLLDSALATSPSLAFPPQPSLGWGCFGMGFGRKAEDPEPGRCRRTDGKKWRCSKEAYPDSKYCEKHMHRGKNRSRKPVEMSLATPPPPSSSATSAASNTSAGVAPTTTTTSSPAPSYSRPAPHDAAPYQALYGGPYAAATARTPAAAAYHAQVSPFHLQLDTTHPHPPPSYYSMDHKEYAYGHATKEVHGEHAFFSDGTEREHHHAAAGHGQWQFKQLGMEPKQSTTPLFPGAGYGHTAASPYAIDLSKEDDDEKERRQQQQQQQQQHCFLLGADLRLEKPAGHDHAAAAQKPLRHFFDEWPHEKNSKGSWMGLEGETQLSMSIPMAANDLPITTTSRYHNDD

SEQ ID NO: 6844 - protein, 775 aa, Oryza sativa
  Clone ID: PAT_MRT4530_53979C.1.pep
MWHLGSGSCSFSSPLSPFVLTRRDRRGVKMSGAALVAIAASIGNLLQGWDNATIAGAVLYIKKEFKLESEPTVEGLIVAMSLIGATIITTFSGPVSDWIGRRPMLILSSILYFLSSLIMLWSPNVYVLLLARLIDGFGIGLAVTLVPLYISETAPSEIRGLLNTLPQFSGSGGMFLSYCMVFGMSLLPSPDWRIMLGVLAIPSLFFFGLTIFYLPESPRWLVSKGRMAEAKKVLQKLRGREDVSGEMALLVEGLEVGADTSIEEYIIGPAIEPADEHVVDGDKDQITLYGPEEGQSWIARPSKGPSILGSVLSLTSRHGSMVNQSVPLMDPIVTLFGSVHENMPHAGGSMRSTLFPNFGSMFSVTDQHPKVDQWDEENLHRDDEEYASDGAGGDYEDNVHSPLLSRQTTSAEGKDIAHHAHRGSALSMRRRSLLEEGGEAVSSTGIGGGWQLAWKWSEREGEDGKKEGGFKRIYLHQEEVPGSRRGSVISLPGGGDAPEGSEFIHAAALVSQPALYSKDIIEQRMSGPAMIHPSEAAAKGSSWKDLFEPGVRRALLVGVGIQILQQFAGINGVLYYTPQILEQAGVAVLLSNLGLSSASASILISSLTTLLMLPSIGLAMRLMDISGRRFLLLGTIPVLIASLVVLVVSNVIDLGTVAHAALSTISVIIYFCCFVMGFGPIPNILCAEIFPTRVRGICIAICALTFWIGDIIVTYSLPVMLNAIGLAGVFGIYAVVCSIAFVFVFLKVPETKGMPLEVITEFFAVGAKQMQATKA

SEQ ID NO: 6845 - protein, 398 aa, Oryza sativa
  Clone ID: PAT_MRT4530_54020C.1.pep
MDAGAQPPDTEMAEAGGGQQPPAAAAAAGAGAGAGMMENIQATLSHGGRFIQYNIFGNVFEVTAKYKPPILPIGKGAYGIVCSALNSETGEQVAIKKIANAFDNKIDAKRTLREIKLLRHMDHENIVAIRDIIPPPQRNSFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEADLDFVNENARRYIRQLPRHARQSFPEKFPHVHPLAIDLVEKMLTFDPRQRITVEGALAHPYLASLHDISDEPVCSSPFSFDFEQHALSEEQMKDLIYQEGLAFNPDYQ

SEQ ID NO: 6846 - protein, 245 aa, Oryza sativa
  Clone ID: PAT_MRT4530_54118C.1.pep
MAAAGGRRRRRRRGLEASVRAVLQPPARLLVGFGAEAVRRRRVRAPTPIDFIPPPGTLVAGSRLSHPLAHPPPTTSVGFWGRLEMSDSEEHHFESKADAGASKTYPQQAGTIRKNGHIVIKNRPCKVVEVSTSKTGKHGHAKCHFVAIDIFNGKKLEDIVPSSHNCDVPHVNRTDYQLIDISEDGFVSLLTESGGTKDDLRLPSDEALLTQIKDGFAEGKDLIVTVMSAMGEEQICALKDIGPKN

SEQ ID NO: 6847 - protein, 659 aa, Oryza sativa
  Clone ID: PAT_MRT4530_54608C.1.pep
MLHLASISAQPNPWCKKQCGDVKIPYPFGIGTGCAIGEGFEIICNRNADGIDQPFTGNIEVLDISVVYGRSRVLGSITTNCYNSSTGSANVNSWWMDLSTSPYRFSDAYNTFVVIGCNTLAYIYNGLNRTSYTTACASVCGGPEDLTNGSCLGVGCCQNANAIPKGLTRQDIYLYTIYNTSESDSWKFNPCSYAALVETESFSFSTEYITTMRFNDTYEGQQPLVLDWAIGDVSCEVAKNMTSYACHSGNSICIGSVALVITIFFMRLMFERRKLTDVKKKYFQQHGGLILFDKMKSDQGLAFKVFTQAELEHATNKFEKSQILGHGGHGTVYKGITKDNITVAVKKCALIDDRHKKEFGKEMLILSQINHKNIVKLLGCCLEVDIPMLVYEFIPNGTLFDLIHGKNRTFHIPFSSLLRIVNEAAEGLAFLHSYANPPILHGDVKTSNILLDENYMAKVSDFGASILALSDEDQFVTMVQGTCGYLDPEYLQTCRLTDKSDVYSFGVVLLEVMTGQMPLKFEGPEIQKSLSSSFLLAMKENNLEAMLDSQIKDHESMELLSGLADIAKKCLDMCSDNRPSMKEVSEELSRLRKFSKHPWIQRDTEIESFLSGPSTSNLETEHSYLSGPSTSNFEIEHNTEYRRKDEEMPINPSTSYFIR

SEQ ID NO: 6848 - protein, 291 aa, Oryza sativa
  Clone ID: PAT_MRT4530_54679C.1.pep
MAAPVVDAEYLRQVDRARRHLRALISSKGCAPIMLRLAWHDAGTYDVNTKTGGANGSIRYEEEYTHGSNAGLKIAIDLLEPIKAKSPKITYADLYQLAGVVAVEVTGGPTVEFIPGRRDSSVCPREGRLPDAKKGALHLRDIFYRMGLSDKDIVALSGGHTLGRAHPERSGFEGAWTQEPLKFDNSYFLELLKGESEGLLKLPTDKALLEDPSFRRYVDLYARDEDTFFKDYAESHKKLSELGFTPRSSGPASTKSDLSTGAVLAQSAVGVAVAAAVVIVSYLYEASKKSK

SEQ ID NO: 6849 - protein, 267 aa, Oryza sativa
  Clone ID: PAT_MRT4530_54995C.1.pep
MDPKLVEVTQLFSRFKAAFARNDFDTCVDLLSQLKVRLTKFPSLPPSFQQTPNAVEELKIARDIYEHAVVLSVKIEDQDAFERDFCQLKPYYMDTCGIIPPSPQEYPILGLNLLRLLVQNRIAEFHTELELLPVTALENPCIKHAVELEQSFMEGAYNRVLSARQAVPHETYVYFMDLLAKTVRDELAGCSEKGYDYMSIAEARQVLMFSSDKELHQYIAEEHPEWEVKDGSVFFQKAKETQPCKEIPSLQVINQTLSYARELERIV

SEQ ID NO: 6850 - protein, 1367 aa, Oryza sativa
  Clone ID: PAT_MRT4530_55252C.1.pep
MYRVKSESDCEMIHQEQMDSPVADDGSSGGSPHRGGGPPLKKGPWTSAEDAILVDYVKKHGEGNWNAVQKNTGLFRCGKSCRLRWANHLRPNLKKGAFTAEEERLIIQLHSKMGNKWARMAAHLPGRTDNEIKNYWNTRIKRCQRAGLPIYPTSVCNQSSNEDQQCSSDFDCGENLSNDLLNANGLYLPDFTCDNFIANSEALPYAPHLSAVSISNLLGQSFASKSCSFMDQVNQTGMLKQSDGVLPGLSDTINGVISSVDQFSNDSEKLKQAVGFDYLHEANSTSKIIAPFGGALNGSHAFLNGNFSASRPTSGPLKMELPSLQDTESDPNSWLKYTVAPALQPTELVDPYLQSPAATPSVKSECASPRNSGLLEELIHEAQTLRSGKNQQTSVISSSSSVGTPCNTTVLSPEFDMCQEYWEEQHPGPFLNDCAPFSGNSFTESTPPVSAASPDIFQLSKVSPAQSTSMGSGEQVMGPKYEPGDTSPHPENFRPDALFSGNTADPSVFNNAIAMLLGNDLSIDCRPVLGDGIMFNSSSWSNMPHACEILQTCVTSGSDDARIGQVSGHTEIGVVILQQAESSSPDASMTDIAPILDEIDPLLGASSTHPDTIPKDDSDTDSHVSSQDHQTDDDSNDETDNNDAKENGEEKNKEQGKEAAFIWTADDEKNLMDLGYSEMERNRRLELLMARRRSRKNIRRSGNSGSAPSVLHTRKNPFDLPLDQSNDGDVSADNNEDHKDLDEKDLPNEHGSPALQRQDSDLADVGSECSDGINSVDVELDNSDIDDREIALQHFVFERSQEREAYLSSTKGKGPEDDYLLSSVGNSKTLHPVADLFSWEDGNGESSLGVNSSHNMSVEFSDWVSSPKPIAEHDSGPENLQEFLNTEVASSSKTIVLGARNPAENNGNVDSISYSNNEMPSDNLGHGSMEFPSEFCNESLPVISRDLHPIPEERVVENFNVQEKHEAEETAAGYPLDSDDDADKIYPEPMEDNVIDESFLSELDAVGDFRVEATRSDQQMPDVDSHIDNNTSNGVAESSLISPQISSNIFSNMKYASMLEHEENSPLVDDLNGTGPEFGWSLGASYDDPEQTVYNPRRRILGASRFEETNTEMKPLFDETEASFVNAPIEANLVVGPSKVDVANESELTKTDTNMIVLDANSLEDIETAFKQASNGVVESTVDNETPQEHTTAAMNSSFEENEDKHGCGDTVKFTMHDELPEGTHIEGNTVGDGKEPEPMGITSSMDVIDAKSIDDIYAALKKQSSAAANSSFEQNEGKNGCGDTVTFTTHDELPEGTHIEDRDNTVEDGKEPEPIGTTSSMDTIEVKTIDDIDAVFKKLSDGGTKSAAQAVDCENTCEASDESEQH

SEQ ID NO: 6851 - protein, 215 aa, Oryza sativa
  Clone ID: PAT_MRT4530_55374C.1.pep
MASQQERASYHAGETKARAEEKTGRMMGTAQEKAREAKDTASDAAGRAMGRGHGAKEATKEKAYETKDATKEKAYEAKDAASDATGRAMDKGRGAAGATRDKAYDAKDRAADTAQSAADRARDGAGQTGSYIGQTAEAAKQKAAGAAQYAKETAIAGKDKTGAVLQQAGEQVKSVAVGAKDAVMYTLGMSGDNKNNAAAGKDTSTYKPGTGSDYQ

SEQ ID NO: 6852 - protein, 299 aa, Oryza sativa
  UNSURE (1)..(299): unsure at all Xaa locations
  Clone ID: PAT_MRT4530_5542C.1.pep
  unsure (1)..(299): unsure at all Xaa locations
GYIFFRESCFHQSGDSKRKVNPTHYREPRFYTKVFKECQALDQDGNSFELSVLTCKCVGAYVKSKKNQNQICWLWQKVDSTEDRGFQRFLDNVQYKASGILRYERIFGEGFVSTGGIETTKEFVDRLDLKPGQNVLDVGCGIGGGDFYMADKYDVHVVGIDLSINMVSFALERAIGRKCSVEFEVADCTKKTYPDNTFDVIYSRDTILHIQDKPSLFKSFFKWLKPGGKVLISDYCKCPGKPSEEFAAYIKQRGYDLHDVRAYGQMLENAGFHDVIGEDRTDQFLXVLERDLVKLKDQN

SEQ ID NO: 6853 - protein, 448 aa, Oryza sativa
  Clone ID: PAT_MRT4530_55761C.1.pep
MEVESPPRPAEEEGEGSPTRREIVLGRNVHTASFAVKEPDADDEETGEREAAMASVLALYRRNLVERTKHHLGYPYNLDFDYGALGQLQHFSINNLGDPFIESNYGVHSRQFEVGVLDWFARIWELEKNEYWGYITNCGTEGNLHGILVGREVFPDGILYASRESHYSVFKAARMYRMDCVKVDTLISGEIDCEDFQRKLLLNRDKPAIINVNIGTTVKGAVDDLDLVIKTLEEGGFKDRFYIHCDGALFGLMIPFVKKAPKVSFKKPIGSVSVSGHKFVGCPMPCGVQITRLEHINRLSSNVEYLASRDATIMGSRNGHAPIFLWYTLNRKGYRGFQKEVQKCLRNAHYLKDRLKEAGIGAMLNELSSTVVFERPKDEEFVRRWQLACEGNIAHVVVMPSVTIDKLDYFLNELTEKRATWYQDGSCQPPCLAKDVGEENCLCSIHKK

SEQ ID NO: 6854 - protein, 93 aa, Oryza sativa
  UNSURE (1)..(93): unsure at all Xaa locations
  Clone ID: PAT_MRT4530_56041C.1.pep
  unsure (1)..(93): unsure at all Xaa locations
GGRHHHLFHHKKDDXPATGVYSYGGGVYTSETVTTEVVAGGHDEYXRYKKGEKHHMHKQHLGEGGSLAGWAFSLYEKHDANNDPENAHRHKIT

SEQ ID NO: 6855 - protein, 333 aa, Oryza sativa
  Clone ID: PAT_MRT4530_56399C.1.pep
MSKARVYTDVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDSLNSYLNKYRIELDPQLEALVGRHSRKPWSKFINADNQHLVSPEAIDFLDKLLRYDHQDRLTAREAMAHPYFLQVRAAENSRPRAQ

SEQ ID NO: 6856 - protein, 68 aa, Oryza sativa
  UNSURE (1)..(68): unsure at all Xaa locations
  Clone ID: PAT_MRT4530_5639C.1.pep
  unsure (1)..(68): unsure at all Xaa locations
LLILIRNKSXHYRXFGGGLKGVGGXXXXGFXQYFSSRFPKVVIKGCGGMSEHWKGEEAFSKYFLGSSA

SEQ ID NO: 6857 - protein, 428 aa, Oryza sativa
  Clone ID: PAT_MRT4530_56655C.1.pep
MSLKSIVRELREMRDGIGSMSRRAADGRAGGGRGGSRHSWPVLWSEQQQPPQQQQLQRQEHQQQQGRWANLPPELLLDVIQRVEASEATWPARRQVVACAAVCRSWREVTKEVVKTLEECGRITFPISLKQPGPREHPVQCFVRRDRATSTYLLYLGLSPSLHGENDKLLLAARKIRRATRTSFVISLVSNDFSLSSSTYVGKLKPNFLGTKFTIFDSQPPCDAVVLPNNRPSKRHFKQVSPRLPLGNYNVATVSYELTVLRNRGPRRMQCTMHSIPALCIQEGGKAPTPTGIIHSLDEQVPALSTSKGKEPAIEFSSTSLSADLSGPVCTNEVPLVLKNKAPRWHEQLQCWCLNFRGRVTVASVKNFQLVASVDPSLGIPAAEQEKVILQFGKIGKDIFTMDYRYPLSAFQAFAICLTSFDTKPACE

SEQ ID NO: 6858 - protein, 385 aa, Oryza sativa
  UNSURE (1)..(385): unsure at all Xaa locations
  Clone ID: PAT_MRT4530_56936C.1.pep
  unsure (1)..(385): unsure at all Xaa locations
MEYGAATRGALLAATLLAGARRSRLPLSPPPSPPSIQIQNRLYSMSSLPLKARGVRRCEASLASDYTKASEVADFDWENLGFGIVQTDYMYITKCGQDGNFSEGEMIPFGPIALNPSSGENALRMRTGAERMCMPAPSVEQFVDAVKQTVLANKRWVPPTGKGSLYIRPLLMGSGAVLGLAPAPEYTFIIFVSPVGNYFKEGLAPINLIVEDKFHRATPDXIGSFRAYGFFSEKIKKKPMAQKIAKEKGYSDVLYLDAVHKKYLEEVSSCNIFVVKGNVISTPAVKGTILPGITRKSIIDVALSKGFQVEERLVSVDELLEADEVFCTGTAVVVSPVGSITYQGKRVEYAGNKGVGVVSQQLYTSLTSLQMGQAEDWLGWTVQLS

SEQ ID NO: 6859 - protein, 635 aa, Oryza sativa
  Clone ID: PAT_MRT4530_5736C.1.pep
MDGSCDCIEPLWQADDLLVKYQYISDFFIALAYFSIPLELIYFVKKSAFFPYRWVLIQFGAFIVLCGATHLINLWTFAIYTKTIAVVLTVAKAATAVVSCITALMLVHIIPDLLNVKLRERFLKDKADELDREMGIIRTQEETGRHVHMLTHEIRSTLDRHTILRTTLVELGRTLALAECALWMPTRSGSALQLSHTIYNSAAIGSVVPINLPIVSKVFNSNRVVKIPHTSPLASITADKSRYVPPEVVAIRVPLLHLTNFQINDWPELSAKSFAVMVLMLPPDSAREWRPHERELVEVVADQVAVALSHAAILEESMRARDLLMEQNIALDAARREAEMAICARNDFLAVMNHEMRTPMRAIVSLSSLLLETNLSAEQRLMVETILKSSDLLATLTNDVLDVSKLENGSLELEIAPFNLHSTFTDVVNLIKPVAACKRLSVMVTLAPELPLHAIGDQKRLMQIILNVAGNSIKFTKEGHVSITASMARPDALRGPHEPDYHPVVSDGFFYLAVQVKDTGCGISPQDMPHTFRKFAHPENAGKWNSGSGLGLALSRRFVSLMEGNIWLESEGVGKGCTAMFFVKLGMPEKPNANLRRMAPHPLQPNQGAGGPDALSISIMDSNPRVPRVRYQSSV

SEQ ID NO: 6860 - protein, 312 aa, Oryza sativa
  Clone ID: PAT_MRT4530_57465C.1.pep
AKLMIVLHSAIGGQDCPTRPFSFFDKNGKYVQALLTANTRSRMDGEAIGAFCFLQIASPELQQAFEIQRHHEKKCYARMKELAYIYQEIKNPLNGIRFTNSLLEMTDLKDDQRQFLETSTACEKQMSKIVKDASLQSIEDGSLVLEKGEFSLGSVMNAVVSQVMIQLRERDLQLIRDIPDEIKEASAYGDQYRIQQVLCDFLLSMVRFAPAENGWVEIQVRPNIKQNSDGTDTMLFLFRFACPGEGLPPEIVQDMFSNSRWTTQEGIGLSICRKILKLMGGEVQYIRESERSFFHIVLELPQPQQAASRGTS

SEQ ID NO: 6861 - protein, 261 aa, Oryza sativa
  Clone ID: PAT_MRT4530_57804C.1.pep
MCQNGHTLCSTCKARVHNRCPTCRQELGDIRCLALEKVAESLELPCKYCSLGCPEIFPYYSKIKHEAQCMFRPYNCPYAGSECAVVGDIPYLVAHLRDDHKVDMHSGCTFNHRYVKSNPREVENATWMLTKYWHIESLSGEEVFHCFGQYLCVHFEAFQLGMAPVYMAFLRFMGDENEARNYSYSLEVGANGRKMVWEGTPRSVRDSHRKVRDSHDGLIIQRNMALFFSGGDRKELKLRITGRIWKEQQTPDGACIPNLCS

SEQ ID NO: 6862 - protein, 622 aa, Oryza sativa
  Clone ID: PAT_MRT4530_57841C.1.pep
MKSMRLSYIPPAASAAPQSPSYGRKKNASAAPPSAAASTTVLTSPPVTTTRTPKQTGQEDEQLVAKTKTTRTVIATTNGRAAPSQSRPRRRPAPAAAASAASLPMTFCNALEEVINTFIDPPALRPAVDPRNVLTSNFVPVDELPPTPCPVVRGAIPRCLAGGAYIRNGPNPQHLPRGPHHLFDGDGMLHSLLLPSPASSGDDPVLCSRYVQTYKYLVERDAGAPVLPNVFSGFHGVAGMARGAVVAARVLTGQMNPLEGVGLANTSLAYFAGRLYALGESDLPYAVRVHPDTGEVTTHGRCDFGGRLVMGMTAHPKKDPVTGELFAFRYGPVPPFVTYFRFDPAGNKGADVPIFSVQQPSFLHDFAITERYAIFPEIQIVMKPMDMVVGGGSPVGSDPGKVPRLGVIPRYATDESEMRWFEVPGFNIMHSVNAWEEAGGEELVLVAPNVLSIEHALEHMELVHSCVEKVRINLRTGVVTRTPLAAGNFDFPVINPAFLGRRNRYGYFGVGDPAPKIGGVAKLDFDRAGEGDCTVAQRDFGPGCFAGEPFFVADDVEGNGNEDDGYLVCYVHDEATGENRFVVMDARSPDLEIVAEVQLPGRVPYGFHGLFVTQAELQSQHQ

SEQ ID NO: 6863 - protein, 492 aa, Oryza sativa
  Clone ID: PAT_MRT4530_5803C.1.pep
MDPYKHRPSSGSNSTFWTTNSGAPVWNNNSALTVGERGPILLEDYHLIEKLAQFDRERIPERVVHARGASAKGFFEVTHDISHLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFSFLFDDVGIPLNYRHMEGFGVNTYTLINKDGKPHLVKFHWKPTCGVKCLLDDEAVTVGGTCHSHATKDLTDSIAAGNYPEWKLYIQTIDPDHEDRFDFDPLDVTKTWPEDIIPLQPVGRMVLNKNIDNFFAENEQLAFCPAIIVPGIHYSDDKLLQTRIFSYADTQRHRLGPNYLMLPVNAPKCAYHNNHHDGSMNFMHRDEEVNYFPSRFDAARHAEKVPIPPRVLTGCREKCVIDKENNFQQAGERYRSFDPARQDRFLQRWVDALSDPRITHELRGIWISYWSQCDASLGQKLASRLNLKPNM

SEQ ID NO: 6864 - protein, 420 aa, Oryza sativa
  Clone ID: PAT_MRT4530_58916C.1.pep
MDRASENRRLAAVGKPVPGIGEMGNRRPLRDINNLVGAPPHPSAIAKKPMLEKSGKEEQKPALVVSHRPMTRNFAASLTRKEQLDHQVSVADAAVVCTDPQKNPIPDGTVDDDVESCESNDYIAVDECNDTDEDESMMDIDSADSGNPLAATEYVEELYKFYRENEEMSCVQPDYMSSQGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLQLLSFFILELSLVEYQMLKYRPSLLSAAAVYTAQCALTRCQQWTKTCELHSRYTGEQLLECSRMMVDFHQKAGAGKLTGVHRKYSTFKFGCAAKTEPALFLLESGAGGYNLQKQPC

SEQ ID NO: 6865 - protein, 1175 aa, Oryza sativa
  UNSURE (1)..(1175): unsure at all Xaa locations
  Clone ID: PAT_MRT4530_59607C.1.pep
  unsure (1)..(1175): unsure at all Xaa locations
MASGRPLLDASPRPTQQPPASSLLPPPQPEPPLRADRLAFSLEVPDPFRREPDPSSAASQRGEEEGGGEEESRAVVVGEPSSSEAAAGFAGNGVRTAKYSVLTFLPRNLFEQFRRLSYVYFLAITVLNQLPQVAVFGRGASVLPLAFVLFVTAVKDAYEDLRRHRSDRQENNRLARVLLAPPAAGEFAPKKWKHIRVGDVVRVASSETLPADMVLLATSDPSGVAHVQTVNLDGETNLKTRYAKQETQLRFSQDGGIGGVLHCERPNRNIYGFQANLEIDGKRVSLGPSNIVLRGCELKNTTWAIGVVVYAGKETKVMLNSSGAPSKRSRLETQLNRETVILSIMLIGMCTTASVLAGIWILNHRGDLEFTQFFREKDYTTGKNYNYYGMGMQIFITFLMAVIVYQVIIPISLYISMELVRLGQAYFMGADRDLYDESSRSKFQCRALNINEDLGQIKYVFSDKTGTLTENKMEFQCASIRGVDYCSGKDSCGYSVVVDDLLWTPKMAVKIDHRLLKLLRGGGTDEETKLVLEFFLALAACNTIVPLVLDTRDSKQKLIDYQGESPDEQALVYAAASYGIVLVERTSGYVVIDVLGDRQRFDILGLHEFDSDRKRMSVIVGCPDKTVKLYVKGADSSLFGITKNSLDLDIVRATEAHLHKYSSFGLRTLVIGMRELSQPEFEEWQLAYENASTSVLGRGNLLRSVAANIENNIRILGATGIEDKLQDGVPETIESLRQADIKVWILTGDKQETAISIGYSCKLLTNDMTQIVINNNSKESCKRSLEEAHATIKKLRIASTGTQSPELASESAGVTLALIVDGNSLVYILETELQEELFKVARECSVVLCCRVAPLQKAGIVALIKNRTDDMTLAIGDGANDVSMIQMADVGVGISGQEGRQAVMASDFAMGQFRFLVPLLLVHGHWNYQRMSYMILYNFYKNATFVLVLFWYVLYTAFTLTTAITEWSSLLYTVLYTSLPTIVVGILDKDLSKETLLAYPKLYGSGQRDEKYNVNLFVLNMLEALWQSLVVFYMPYFAYRQSTIDMSSLGDLWALAPVIVVNMLLAMDIFRWNWIVHAFVWGTIAATTICLFVIDSIWFLPGYGYPRKXMGTGLFWLLLLIIVVAAMVPHFVIKAFTEYFTPSDIQVAREIEKFENVNQVNRSEVPMTRLHDPRR

SEQ ID NO: 6866 - protein, 197 aa, Oryza sativa
  Clone ID: PAT_MRT4530_59646C.1.pep
MAATAMDHDGGEVVTPGELLGNSSLLAGLGAYADGRCVRASITGHRRLVPPPPGSTDQRSTVEVVGHKAHGAVPQPGSVVIARVTKVMARMASADIMCVDSKAVKEKFTGMIRQQDVRATEIDKVDMFQSYRPGDIVRALVLSLGDARAYYLSTAQNELGVVSAQSITGGTLVPISWTEMQCELTGQIEQRKVAKVE

SEQ ID NO: 6867 - protein, 500 aa, Oryza sativa
  Clone ID: PAT_MRT4530_59818C.1.pep
MAGSGRPPAAQKKILQSLRPPLPFAASSRSPFAAPNDYHRFPAGGAAAAAASGSGGIGAGGAGGGGDIEEGLVIRTPTRDADRYGKNLIHAVVGAKQKRKAPEESDVAESSDCMITSPGFAVSPMLTPVSGKAVKTSKSKTKNNKAGPQTPTSNVGSPLNPPTPVGTCRYDSSLGLLTKKFINLLKQAPDGILDLNNAAETLEVQKRRIYDITNVLEGIGLIEKTLKNRIRWKGLDDSGVELDNGLSALQAEVENLSLKEQALDERISDMREKLRGLTEDENNQRWLYVTEDDIKGLPCFQNETLIAIKAPHGTTLEVPDPDEAGDYLQRRYRIVLRSTMGPIDVYLVSQFDEKFEDLGGGATPSGHANVPKHQPTEVFNTTNAGVGQCSNSVAVDNNIQHSQTIPQDPSASHDFGGMTRIIPSDIDTDADYWLISEGDVSITDMWKTALLNMETADVQWDESLDTDVFLSEDVRTPSSHNQQPSAVGGPQMQVSDMHKP

SEQ ID NO: 6868 - protein, 406 aa, Oryza sativa
  Clone ID: PAT_MRT4530_59856C.1.pep
MSFRSVIQEVKGEIGAISRRGFRSRPGRVRRVAAAAEEPPDESSAAALVMRESCWTQLPPELLREVLARVEESEGWWPRRRDVVACAGVCRSWRGIVREIVRTPEASGNLTFPISLKQPGPRDAPMKCFIVRNRTTQTYYLYIGLTDALTDDGKFLLAARKCRRTTCTEYLISLDMNDISKRTDSYVGKLRSNFLGTKFTIYDAHPPYAGDVISKGQSARVIGSNHLSPRIPAGNYPVSHISYELNVLGSRGPRRMHCAMDSIPVSAIEQGGTAPTQTEFPLSYHESFTSIPFFKSKSVRANNSTASLLTQNGSKLVLKNKSPRWHEHLQCWCLNFHGRVTVASVKNFQLVASDESNPTNQEHDDVILQFGKVGKDMFTMDYRYPISAFQAFAICLSSFDTKIACE

SEQ ID NO: 6869 - protein, 425 aa, Oryza sativa
  Clone ID: PAT_MRT4530_59858C.1.pep
MSFRSVIQEVKGEIGAISRRGFRSRPGRVRRVAAAAEEPPDESSAAALVMRESCWTQLPPELLREVLARVEESEGWWPRRRDVVACAGVCRSWRGIVREIVRTPEASGNLTFPISLKQTGGQMAQLVLKADKMQLYSPGPRDAPMKCFIVRNRTTQTYYLYIGLTDALTDDGKFLLAARKCRRTTCTEYLISLDMNDISKRTDSYVGKLRSNFLGTKFTIYDAHPPYAGDVISKGQSARVIGSNHLSPRIPAGNYPVSHISYELNVLGSRGPRRMHCAMDSIPVSAIEQGGTAPTQTEFPLSYHESFTSIPFFKSKSVRANNSTASLLTQNGSKLVLKNKSPRWHEHLQCWCLNFHGRVTVASVKNFQLVASDESNPTNQEHDDVILQFGKVGKDMFTMDYRYPISAFQAFAICLSSFDTKIACE

SEQ ID NO: 6870 - protein, 1578 aa, Oryza sativa
  Clone ID: PAT_MRT4530_60150C.1.pep
MITLKSSDGEPVEVTEASARISKVIGDKIDAGRGGEAIPLPHVDKKTLKKVIEYCDEHANENSDTDEQKEELKNWDKAFIDELDEDDGSFLFLVLLASSYLKIDGLLDLTYQRVADNSKAKTTEEIRKTFSTIEIELSDKEEEEQQQEEEIRPENMKKKTATAMMIVTPRPTVTTVPVAGEEVAGGTTTTTPGLIKTGDAGIETTTIGMNGDETLGVAAANNVRLIKTTAVNAHAPRASATGEGTVTMAAGVITLVPPTWTTSPILSTPSHTWQRSLCLPASRSFTPRKSRRDQLLRLALVADKAMAAPPPTAMEDLAIRSSTGTEAWFSGTAWKPVPVARVFGRIREALPATPAVETPTTYQQIEEALMRLELAAAAARTPGDDTLLPQPMSPAPLAASPPRRLEDLASDAVADKILPAPLPGALLPQEMTHMPATPPLSALEPGSLPERASSPCAIAGLFTSPPPAIIASPLRSTLPCLRPVVLTRKVKLRPRQHSQAIRRSEHLAKQPARPMMERCQRILFRRLGILHDEEDASVERVLSQYMAMFDGPLPPHAIAALTAIFGLDDDDECAMDASLLPLVGEGITDVADELACRRWPACRLPSISMEPQLLEHMSMSHSLDFISWNVRGLNSPAHCNTVHEMMLDTKCNLACLQETKLQNIYDGLARFLGGYKLDSFAFKPATGTRGGILILWNSAVLVLQDIRIGRFSISAQVTVPLTGATFLMTGVYGPTRHRLKDGFLRHIRRLKPNAGEGWLLFGDFNMIYRARDKNNGNLNLARMRRFRATIDRCELREIPLQNRRFTWSNERQRPTLVKLDRCFCNENWDLAFHHHVLHALPTGPSDHCPLVLSNPAAPRKPRPFRFENFWTRIPGFKDMVKASWTQPSPHTEPMHRLNYKLQRTASCIKTWAKSLFTEVKIQFHMALDVIQRLDVAQEHRDLSGPELRLRAALKRKTLTLATIERARKRHASRLTHIREGEANIKFFHLRVNARRRKNSIQRPSKENGWAVTHDEKEMTILDHFAHLMGRPGPRPNELNWEALDIQPFDLSTLEEPFLEQEIHQAIKEMPVDKAPGPNGYTGIFFKICWDIVKEDVSLVFNSIFNLRYASLGLLNSANIVLIPKKEGAESVSDYRPINLIHSIAKIFSKLLALWLRPHMHSLVSINQSAFIKGRSIHDNFLFVRNMARRFHRTNRPMLLFKLDITKAFDSIRWDYLMALLQRLGFPVKWRDWLDDAAIFVNPTRGDVQALTEILQRFGTATGLVTNFQKSQVAAIKCNNIDLDDVLEGVPAAGTGDITGGKCKVNWTKTCLPIRQGGLEVLNLERFMRALRLRWLWHEWKDPNKPWVGLEIPCDEVDKSLFAASTKITIGDGNIARFWDTAWIDGRRPKDLMPLVYAISKKRKKNLRQGKENDAWVGDLALETNPVITVALVEQLVALWTAVCNVQLEEEESDQIAWKFTPHGHYSASSAYKAQYTRRIWNLVATWVGFHQLEPRRWGVAQSVKDWWEMLASVSGVPKKGLRTLILLIVWEVWKERNRRIFDHKEATTSYLLSKIKEEAGMWALAGAKRLGEIISQFV

SEQ ID NO: 6871 - protein, 527 aa, Oryza sativa
  Clone ID: PAT_MRT4530_60372C.1.pep
MHSTNLLLEEPIRMASILEPSKPSFFPAMTKIVGTLGPKSRSVDTISSCLKAGMSVARFDFSWGDAEYHQETLENLKVAIKSTKKLCAVMLDTVGPELQVVNKSEASISLEENGTVILTPDQGQEASSQVLPINFAGLAKAVKPGDTIFVGQYLFTGSETTSVWLEVSQIKGDDVVCVIKNTATLAGSLFTLHCSQIHIDLPTLSDEDKEVIRKWGAPNKIDFLSLSYTRHVEDVRQAREFLSKLGDLSQTQIFAKIENVEGLNNFDEILQEADGIILSRGNLGIDLPPEKVFLFQKSALHKCNMAGKPAVVTRVVDSMTDNLRPTRAEATDVANAVLDGSDAILLGAETLRGLYPVETISIVGKICAEAEKVFNQDLYFKRTVKHVGEPMTHLESIASSAVRAAIKVKASVIICFTSSGRAARLIAKYRPTMPVLSVVIPRLKTNQLRWSFTGAFEARQSLIVRGLFPMLADPRHPAESTNATNESVLKVALDHGKVSGVIKSHDRVVVCQKVGDSSVVKIIELDD

SEQ ID NO: 6872 - protein, 1013 aa, Oryza sativa
  Clone ID: PAT_MRT4530_60464C.1.pep
MGVGGGGGGGGGEAAAAVAVEGDEAGKGRRWWRVKVKLSTVAVVAWVLASAALWAGLHWRFRRAALHKAEEALVCMCEERARMLQDQFAVSVNHVHALAILVATFHYDKHPPALDQDTFAVYAARTSFERPLLSGVAYAQRVVHADRESFERQQGWIIKTMKHEPSPAQDEYAPVIYSQETISYIEGLDVMSGEEDRENILRARATGKAVLTRPFRLMSNHLGVVLTFPVYLVDLPNDTAVEDRVAATAGYLGGAFDVESLVENLLRQLAGNQELVVNVYDVTNHSNPLVMYGSEVPLGIPSPSHTYTLDFGDPLRKHQMVCRYRNKLHVSWSAITTPSGVFVICMLVGYIIYAAWSRYDNVKEDCRKMEALKKRAEAADIAKSQFLATVSHEIRTPMNGVLGMLDMLLDTELKSTQRDYAQTAQVCGKALISLINEVLDRAKIEAGKIDLESVPFDLRSILDDVISLFSSKSREKGIELAVYVSERVPEILLGDPGRFRQIITNLVGNSIKITIFTLSQFTERGHIFVQVHLADHSNLATEAKIEPVVNGMNGHKDEAIAIPTSGSHNTLSGFEAADSRNNWENFKLLLSYEKNEMPYESDSDKVTLVVSVEDTGIGIPLHAQGRVFTPFMQADSSTSRNYGGTGIGLSISKCLVEIMGGQINFVSRPLVGSTFTFTAVLRRCDKNAISDSKTVALHPLPSSFKGLSALLVDKRPVRATVTKYHLQRLGITSEVVGTIDPTFGVLSGRNGSSLTSIGKKQPCMLLIESDSWGPQMDVSLHARLQEMKQSDRIHVLPKVFLLSAAESDKVKKIHAVDSVIPKPLKASALAACLFQALGITQPSHEKRDDSGSLHGRDGSGSLHGLLLGKNILVVDDNKVNLRVAAGTLKKYGAKVECVESGKDALSLLQVPHKFDLCLMDIQMPEMDGFEATRQIRAMEGKANEQADDSESGSEIAAKTAKWHLPILAMTADVIQATHEECTKCGMDGYVSKPFEEKQLFQAVQKFLGPCVSS

SEQ ID NO: 6873 - protein, 667 aa, Oryza sativa
  Clone ID: PAT_MRT4530_60549C.1.pep
MIMSAELLLLFQRKFKDGIEVSEKFRDKRLQHDKENGSAEEYNLLQVYHCWSLKLNGFIGESRDAGANHHRLRVPPWRGTTTSGVTPWRPAPAAAATTIRSGDGDDDDARRKPAATGVLRATASLAAPAGLGQSRDLHRLHAISAHRAATSPRRWSQPAEAAASPHRRSQLAESRPPYRRPELARRVAASLPLGHCLSLPREPAHRVATSRPPVRRLSARPELADRITAGACPLGRRLSAPPELANRIATACDCDLWPLVAVAVTSSQPGARALNPAGAQQQWRARAGHPSQAAQGRSGERERRSTRGVPSAGGKIQANPMDDNSIQQSLLADNPNVLQRKPSEGVNRFRRCRSTPSTDPLQGPPEKGSSVKAKELFKEMRPSFRLVGLLLFIYLLVGVLAFYAVMDEISGKRTNRVLDALYFCVVTMTTVGYGDLVPNNDTTKLLACAFVFMGMAVVALFVSKVADYLVEKQEVLFFKALHTNLKGGETKMLRAIETNRIKYKFYTNALLLVLSIISGTVFLWKVEKLSLVDSFYCVCATITTLGYGDKSFSSKLGRVFAVFWIITSTIIMAQFFMYLAEIYTERRQKMLANWVLTRKMTKMDLEAADLDDDRQVGAAEFVVYKLKELGKINQEEISSFLEEFEKLDVDHSGTLSPYDLTLAQSAQ

SEQ ID NO: 6874 - protein, 574 aa, Oryza sativa
  Clone ID: PAT_MRT4530_6072C.1.pep
MAEVTVVRAEREEESTLEQGLLAIPEESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVVASFRKWNVHVPEDSSRLYELPDGASAIEGSRQLEHTDELRCLDKAATITDLDVKADSFTNPWRICTVTQVEELKILMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAA

SEQ ID NO: 6875 - protein, 593 aa, Oryza sativa
  Clone ID: PAT_MRT4530_6073C.1.pep
MAEVTVVRAEREEESTLEQGLLAIPEESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVEGIRKGSFFNWFYFSINMGALISSSCLVWVQDNIGWGIGFGIPTIFMGLAIISFFSGTSLYRFQKPGGSPITRVCQVVVASFRKWNVHVPEDSSRLYELPDGASAIEGSRQLEHTDELRCLDKAATITDLDVKADSFTNPWRICTVTQVEELKILVRMFPVWATTIVFSAVYAQMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAA

SEQ ID NO: 6876 - protein, 770 aa, Oryza sativa
  Clone ID: PAT_MRT4530_60906C.1.pep
MAAAAILPELAAQVVIPVAAAVGIAFAVLQWALVSKVKLTAEPRRGEAGGAAGGKSGPSDYLIEEEEGLNDHNVVSKCAEIQTAISEGATSFLFTEYKYVGLFMSIFAVLIFLFLGSVEGFSTKSQPCHYSKDKTCKPALANAIFSTIAFVLGAVTSLVSGFLGMKIATYANARTTLEARKGVGKAFITAFRSGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVSEIEPALKKQLIISTAFMTVGIALVSWLGLPYTFTIFNFGAQKTVQSWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTTKPDYATCVKISTDASIKEMIPPGALVMLTPLIVGILFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGILFKLF

SEQ ID NO: 6877 - protein, 236 aa, Oryza sativa
  UNSURE (1)..(236): unsure at all Xaa locations
  Clone ID: PAT_MRT4530_60938C.1.pep
  unsure (1)..(236): unsure at all Xaa locations
FVLFNATQNFDGANFSSGEILXFIGNFLYLFATSTFLGVAAGLLSAYIIKKLYFSRHSTDREVSIMMLMAYLSYMLAELLDFKGILTVFFCGIVMSHYTWHNVTESSRVTTKHAFATLSFIAETFLFLYVGMDALDMEKWKIVGETFSPMKSIALSSTILFLVLVARAAFVFPLSFLANLTKKTEEGKISIKQQVIIWWAGLMRGAVSIALAYNKFTRSGHTQLPSNAIMITSTIT

SEQ ID NO: 6878 - protein, 1080 aa, Oryza sativa
  Clone ID: PAT_MRT4530_60954C.1.pep
MANSKRLPYSTAGGGGGGRRGVVAPLVVVVFLFVLAPSIFFVACNGGHVGSGSGGGGDWGVMCSGLISDVVVCLPADPMDMEGTQETEWQKQLPTNNLKSILSKEMFDALASSQQEAGALSVDFFIKRASPSWKTDDLVNDLSNASLDIDDKVCKKINFLSVQMNIKSTRLQKMFEGIWRKENENENSDLTVRLMRDQIIMARVYSVLAKSKNKNDLYQELQTRIKESQRAVGEATADSDLHHSAPEKVRVMGQLLSKAREDVYDCKAVTQRLRAMLQSADEQVRSLKKQSTFLSQLAAKTIPNSIHCLSMRLTIDYYLLPLEKRKFPRSENLENPELYHYALFSDNVLAASVVNSTIMNAKEPEKHVFHLVTDKLNFGAMNMWFLLNPPGKATIHVENVDEFKWLNSSYCPVLRQLESAAMKEYYFKADRPTTLSAGSSNLKYRNPKYLSMLNHLRFYLPQVYPKLDKIFFLDDDIVVQKDLTGLWDVDLNGKVTGAVETCGESFHRFDKYLNFSNPHIARNFDPNACGWAYGMNIFDLNEWKKKDITGIYHRWQNMNEDRVLWKLGTLPHGLLTFFKLTHPLDKSWHVLGLGYNPSIDRSEIDNAAVVDYNGNMKPWLELAMTKYDQVQTILDKFVGLTVCIILIFGQLTEKIMTGKLTDFTSAYAYKCRLFFIRILSAWPAGSIDCCEEMINRCFCCVTGGDSDPEPAATSSRRRTNPARASKNRTSVDYPWETYTLKELLQATGNFSESNKLGEGGFGTVYWGRTSKGVEIAVKRLKAMTAKAEMEFAVEVEILGRVRHRNLLSLRGFYAGGDERLIVYDYMPNHSLLTHLHPHRGTPSSHHHVPLEWPRRVAIAVGAAEGLSYLHHEASPHIIHRDIKASNVLLDAEFVPKVADFGFAKLIPDGVSHLTTRVKGTLGYLAPEYAMWGKVSESCDVYSFGVLLLELVSARRPLEKLPGGVKREIVQWAAPLVERRRWERLADPRLAGRFDAAQLRAVVETAMLCTQSSAESRPAMAEVVDMLRFSGGERRTKEIVPVAATVAGSSDEITMTTDQDDVTAGSSEPLDRRNWKLTRLR

SEQ ID NO: 6879 - protein, 250 aa, Oryza sativa
  Clone ID: PAT_MRT4530_61243C.1.pep
MRVAATTRPASSSAAAPLPLFLLLAVAAAAAALFLVGSASLAMAGHVLGGAHDAPSAANSVETDALARFAVDEHNKRENALLEFVRVVEAKEQVVAGTLHHLTLEALEAGRKKVYEAKVWVKPWLDFKELQEFRNTGDATTFTNADLGAKKGGHEPGWRDVPVHDPVVKDAADHAVKSIQQRSNSLFPYELLEIVRAKAEVVEDFAKFDILMKLKRGNKEEKFKAEVHKNLEGAFVLNQMQQEHDESSSQ

SEQ ID NO: 6880 - protein, 226 aa, Oryza sativa
  Clone ID: PAT_MRT4530_61245C.1.pep
MAGHVLGGAHDAPSAANSVETDALARFAVDEHNKRENALLEFVRVVEAKEQVVAGTLHHLTLEALEAGRKKVYEAKVWVKPWLDFKELQEFRNTGDATTFTNADLGAKKVTHSCLVEFVICALLNLKGGHEPGWRDVPVHDPVVKDAADHAVKSIQQRSNSLFPYELLEIVRAKAEVVEDFAKFDILMKLKRGNKEEKFKAEVHKNLEGAFVLNQMQQEHDESSSQ

SEQ ID NO: 6881 - protein, 459 aa, Oryza sativa
  Clone ID: PAT_MRT4530_61496C.1.pep
MDVYLPRTQGDVDDDGKERRTGTVWTATAHIITAVIGSGVLSLAWAMAQLGWVAGPITLLLFAAITFYTCGLLSDCYRVGDPATGKRNYTYTDAVKSYLGGWHVWFCGFCQYVNMFGTGIGYTITASISAAAINKSNCYHWRGHGTDCSQNTSAYIIGFGVLQALFCQLPNFHQLWWLSIIAAVMSFSYAAIAVGLSLAQTIMDPLGRTTLTGTVVGVDVDATQKVWLTFQALGNVAFAYSYAIILIEIQDTLRSPPPENATMRRATAAGISTTTGFYLLCGCLGYSAFGNAAPGNILTGFGFYEPYWLVDVANACIVVHLVGGFQVFCQPLFAAVEGGVARRCPGLLGGGAGRASGVNVFRLVWRTAFVAVITLLAILMPFFNSILGILGSIAFWPLTVFFPVEMYIRQRQLPRFSAKWVALQSLSLVCFLVTVAACAASIQGVLDSLKTYVPFKTRS

SEQ ID NO: 6882 - protein, 192 aa, Oryza sativa
  Clone ID: PAT_MRT4530_61692C.1.pep
MANSRASRFKMSNLSEPSKEAASADDSSAVQKTGAWSNTLNILLQQASVYGVAAGYCLSASLLSIINKWAVMKFPYPGALTALQYFTSVVGVLLCGQLKLIEHDGLNLRTMWKFLPAAVMFYISIFTNNELLLHANVDTFIVFRSAVPIFVAIGETLYLHQPWPSLKTWLSLSTILGGSVIYVFTDNQVTVT

SEQ ID NO: 6883 - protein, 353 aa, Oryza sativa
  Clone ID: PAT_MRT4530_62143C.1.pep
VYRGPRYHAAAAFILGFWLLDFSNNTVQGPARALMADLSGRHGPSAANAIFCSWMALGNILGYSSGSTNDWHKSVFLGLSTAVTMVFAREVALDPVAAAKRNEGEASGLLAVFKGMKNLPVGMPSVLIVTGLTWLSWFPFILFDTDWMGREIYHGRPDGSPAEVTAFQEGVRQGAFGLLLNSIVLGISSFLIEPMCRRLGARAVWVMSSAVVCVAMAAVSVLSAWSLGDFGGSVQDAARAPAEEGGVRASALALFVFLGLPFAVLCSVPFAVTAQLAASRGGGQGLCTGVLNISIVVPQMAIALGAGPWDELFGEGNIPAFAMASVFAAAAAAAGVVLLPKVSVRSVSMAGGH

SEQ ID NO: 6884 - protein, 506 aa, Oryza sativa
  Clone ID: PAT_MRT4530_62144C.1.pep
MAVDMELDGGGDGKGKAPPQISLSGLFLACMVAGGVQYGWALQLSLLTPYVQTLGIPHALTSVMWLCGPIAGLIVQPCVGLYSDKCTSSLGRRRPFILTGCIIICISVIVIGFSSDIGYALGDTTEDCKVYRGPRYHAAAAFILGFWLLDFSNNTVQGPARALMADLSGRHGPSAANAIFCSWMALGNILGYSSGSTNDWHKWFPFLMTRACCEACANLKAAFLVAVVFLGLSTAVTMVFAREVALDPVAAAKRNEGEASGLLAVFKGMKNLPVGMPSVLIVTGLTWLSWFPFILFDTDWMGREIYHGRPDGSPAEVTAFQEGVRQGAFGLLLNSIVLGISSFLIEPMCRRLGARAVWVMSSAVVCVAMAAVSVLSAWSLGDFGGSVQDAARAPAEEGGVRASALALFVFLGLPFAVLCSVPFAVTAQLAASRGGGQGLCTGVLNISIVVPQMAIALGAGPWDELFGEGNIPAFAMASVFAAAAAAAGVVLLPKVSVRSVSMAGGH

SEQ ID NO: 6885 - protein, 1020 aa, Oryza sativa
  Clone ID: PAT_MRT4530_62177C.1.pep
MRGGEEEERRLGEEEEVVEKSWKALWKINAPGKMKINLWRAVQDCLPTGFQLRRRHIDSNDGYVFWKQGTMQEMGLAPCILGAWLRSERVNNIVLPEMAEALAIRRALVLATEEGFQQVLVASDCIFPGAAVSSLFSHHGAIASTPVRLPPQRGCRIQPAVPRPPSHRDSRGAIGLAAAAAGHPGCQTRCGDVDIPFPFGIGDHCAIHEGFRLECDNATKGTSNQKPFWGDFEVIKISMEDGKVWVKAYMSRQCYDQSTGGMSYSDASANLSGSSFWLSDTDNKITVIGCKTLAYMTTDSANVPKSIQYYQGYFNEGYNTTKIWMSSPCSYMAVMETAAFNFSTSYLTSSVFYDTYKGGVPVVYDWAITSKTCTESRRNKTSYACISNNSQCIDNLTNAQGYRCKCSNGYEGNPYIKDGCKDIDECLNNATYPCKGICTNTLGNFTCSCSPGSYMMNGDCASIISVVLEATNRFNEQQILGQGGHGTVYKGLLKGNMEVAVKRCMTINEHQKKEFGKEMLILSQINHKNIVKLLGCCLEVEVPMLVYEFIPNGTLFDLIHGNHGQQISLATRLQIAHESAEALTYLHSCASPPILHGDIKSSNILLDRNLIAKVSDFGASILAPTDESQFVTLVQGTCGYLDPEYMQLCQLTDKSDVYSFGVVLVELLTCQKAFNLNAPEHEKSLSMRFLNAMKNNKLADILDDQIKNSENMPFLEEIAELAAQCLEMSGVNRPSMKHIADNLDRLRKVMQHPWAEQNSEELESLLGESSMVSSRLSVATFQFQLFQGFSPVLQAGFSVVKGYHEGFPCTHHRFLRLLRHRRALGFVLQDVLAPLLEVAALRSGPFIWPAPDTVAFLTPGDGADRGGGGAKGGGERFMGFRSDGDRKAMRAAGREAEVVDGGTGDDVDFKLHTCCHHRSLVHTGMTLVVCEKSWHGRGRVRGWGRKQSLPFHLFLTGQRSTGPSGPPGWDGADSRDVGKRKGPAATLHRNRCSSSVPHYHLVKLRSSSIAGLSTSGAPRG

SEQ ID NO: 6886 - protein, 122 aa, Oryza sativa
  Clone ID: PAT_MRT4530_62336C.1.pep
MAGVWVFKDGIVRRVENPGSEESSSAGDGGGGGRRKVLVHVPSGEVVASYEVLERRLRELGWERYLTDPCLLQFHQRSTVHLISVPRDFSKFKLVHMYDIVVKTRNVFEVRDAAAPAVSPAT

SEQ ID NO: 6887 - protein, 264 aa, Oryza sativa
  Clone ID: PAT_MRT4530_62420C.1.pep
MAAAAGGGTREEMVYMAKLAEQAERYEEMVEFMEKVVTAAAAGGGGELTVEERNLLSVAYKNVIGARRASWRIVSSIEQKEEGRGAAGHAAAARSYRARVEAELSNICAGILRLLDERLVPAAAAVDAKVFYLKMKGDYHRYLAEFKTGAERKDAADATLAAYQAAQDIAMKELSPTHPIRLGLALNFSVFYYEILNSPDRACTLAKQAFDEAISELDTLGEESYKDSTLIMQLLRDNLTLWTSDMQDDGGDEMRDATKPEDEH

SEQ ID NO: 6888 - protein, 370 aa, Oryza sativa
  UNSURE (1)..(370): unsure at all Xaa locations
  Clone ID: PAT_MRT4530_62783C.1.pep
  unsure (1)..(370): unsure at all Xaa locations
MEQEAAMVVFSCNSGSGGSSSTTDSKQEEEEEEELAAMEEDELIHVVQAAELRLPSSTTATRPSSRYKGVVPQPNGRWGAQIYERHARVWLGTFPDEEAAARAYDVAALRFRGRDAVTNRAPAAEGASAGELAFLAAHSKAEVVDMLRKHTYDDELQQGLRRGSRAQPTPRWAREPLFEKAVTPSDVGKLNRLVVPKQQAERHFPFPLRRHSSDAAGKGVLLNFEDGDGKVWRFRYSYWNSSQSYVLTKGWSRFVREKGLRPGDTVAFSGSGXYGPDKLLFIDCKKNKHGGRPPATRSQITSRRSNTASVRLFRHGHHRRRRQIARKRERQVEMGQEAVLDEEAMQWFISSTPALGAPAVITSNQFIYTS

SEQ ID NO: 6889 - protein, 52 aa, Oryza sativa
  UNSURE (1)..(52): unsure at all Xaa locations
  Clone ID: PAT_MRT4530_62821C.1.pep
  unsure (1)..(52): unsure at all Xaa locations
TITINTXKKGDRKTGSATKQFKRLPHPQPVLAPQTPTCFATSSLNAKLHNHL

SEQ ID NO: 6890 - protein, 750 aa, Oryza sativa
  Clone ID: PAT_MRT4530_63568C.1.pep
MGVCGMNTQNIKDFTFFQRHLLETPSFKSYIIKGFGFSTPRFLEIRFLRGLFGSARQWLYSRSAAVVLVQIYLVDPVGVAAAQPLLALPNTAIIKDFVGFCHIATTSSSPKTGQGHEPTTCFRPVLLAPSPLCLTRGPHTITHQIEAPQADHVEDSVSSPKYVKPAVAKQNGEVVSRATKSDAPVSKPKVDPSVPASKAEADGNAQAVESKAALDKKEDVGVAEPLEAKADAGGDAGAVSSADDSENKESGPLAGPNVMNVIVVASECSPFCKTGGLGDVVGALPKALARRGHRVMVVIPRYGEYAEAKDLGVRKRYRVAGQDSEVSYFHAFIDGVDFVFLEAPPFRHRHNDIYGGERFDVLKRMILFCKAAVEVPWFAPCGGSIYGDGNLVFIANDWHTALLPVYLKAYYRDNGMMQYTRSVLVIHNIAYQGRGPVDEFPYMELPEHYLDHFKLYDPVGGEHANIFGAGLKMADRVVTVSPGYLWELKTTEGGWGLHDIIRENDWKMNGIVNGIDLGEWNPEVDVHLQSDGYANYTVASLDSSKTRCKEALQRQLGLEVRDDVPLIGFIGRLDHQKGVDIIGDAMPWIAGQDVQVVMLGTGRPDLEEMLRRFESEHNDKVRGWVGFSVQLAHRITAGADVLLMPSRFEPCGLNQLYAMAYGTVPVVHAVGGLRDTVSAFDPFEDTGLGWTFDRAEPHKLIEALGHCLETYRKYKESWRGLQVRGMSQDLSWDHAAELYEEVLVKAKYQW

SEQ ID NO: 6891 - protein, 694 aa, Oryza sativa
  Clone ID: PAT_MRT4530_63570C.1.pep
MSGAIASSPAATLFLAGSSSSSPRRRRSRVSGVWWHLYGGTGLRLHWERRGLVRDGAVVCSASAAGGEDGVAKAKTKSAGSSKAVAVQGSTAKADHVEDSVSSPKYVKPAVAKQNGEVVSRATKSDAPVSKPKVDPSVPASKAEADGNAQAVESKAALDKKEDVGVAEPLEAKADAGGDAGAVSSADDSENKESGPLAGPNVMNVIVVASECSPFCKTGGLGDVVGALPKALARRGHRVMVVIPRYGEYAEAKDLGVRKRYRVAGQDSEVSYFHAFIDGVDFVFLEAPPFRHRHNDIYGGERFDVLKRMILFCKAAVEVPWFAPCGGSIYGDGNLVFIANDWHTALLPVCLKAYYRDNGLMQYTRSVLVIHNIAHQGRGPVDDFATMDLPEHYIDHFRLYDPVGGEHSNVFAAGLKMADRAVTVSHGYLWEIKTMDGGWGLHEIINHNDWKLQGIVNGIDMAEWNPEVDEHLQSDGYANYTFETLDTGKKQCKEALQRQLGLQVRDDVPLIGFIGRLDHQKGVDIIGDAMPWIAGQDVQVVMLGTGRPDLEEMLRRFESEHNDKVRGWVGFSVQLAHRITAGADVLLMPSRFEPCGLNQLYAMAYGTVPVVHAVGGLRDTVAPFDPFADTGLGWTFDRAEANRMIDALGHCLNTYRNYKESWRGLQARGMAQDLSWDHAAELYEDVLVKAKYQW

SEQ ID NO: 6892 - protein, 497 aa, Oryza sativa
  UNSURE (1)..(497): unsure at all Xaa locations
  Clone ID: PAT_MRT4530_63782C.1.pep
  unsure (1)..(497): unsure at all Xaa locations
MDVEKVERKEVAVDDDGRVRTAALIWQSLQCTASLLMFMLNQPGVPRDQEGKNVTRTVWTATTHAITAVIGSGVLALPWSVAQMGWVLGPIALVVCAYITYYTAVLLCDCYRTPDPVHGKRNYTYMDVVRSCLXYAILWGAMVGYTITTATSIMIWAVRMXSVVRTNCHHYKXGPDATCGSSGTMYMVLFGLAEVVLSQCPSLEGVTLISVVAAVMSFTYSFVGLFLSAAKVASHGAAHGTLLGVRVGAGGVTASTKAWHFLQALGNIAFAYTYSMLLIEIQDTVKSPPSENVTMKRASLYGIGVTTVFYVSIGCVGYAAFGNAAPGNVLTGFLEPFWLVDIANVAVVIHLVGAYQVYAQPVFACYEKWLASRWPESAFFHREYAVPLGGGRAVRFTLCKLVLRTAFVAVTTVVSLVLPFFNAVLGLLGAVAFWPLTVYFPVTMYMAQAKVQRGSRKWVALQALNVGALVVSLLAAVGSVADMAQRLRHVTIFQTQL

SEQ ID NO: 6893 - protein, 329 aa, Oryza sativa
  Clone ID: PAT_MRT4530_63823C.1.pep
MDPSAPSGSSADASASSSSSAVEDLAPGMAAMSLQDRFELLRGIGEECIQEDELMNLLQKKPVPICYDGFEPSGRMHIAQGIVKTINVNKMVRAGCKVKIWIADWFAQLNNKMGGDLKKIQTVGRYMIEIWRAAGMNLDGVEFLWSSEEINNRANEYWPLVMDIACKNNVKRIMRCCQIMGRNDSDELTAAQIFYPCMQCADIFFLKADICQLGMDQRKAQVNLKIKQAFCPPNVVDGNPCLEYIKYIVFPWFEMFEVVRKEANGGNKTFTNMDELIDDYKTGALHPADVKPALAKAINQILQPIRDHFNNNSEAKILLNTVKKYRVTN

SEQ ID NO: 6894 - protein, 295 aa, Oryza sativa
  Clone ID: PAT_MRT4530_63826C.1.pep
DAWVWLPSSFKGIVKTINVNKMVRAGCKVKIWIADWFAQLNNKMGGDLKKIQTVGRYMIEPTRPAGMNLDGVEFLWSSEEINNRANEYWPLVMDIACKNNVKRIMRCCQIMGRNDSDELTAAQIFYPCMQCADIFFLKADICQLGMDQRKVNVLAREYCTDIKRKNKPIILSHHMLPGFKEGQEKMSKSDPSSAIFMEDDEAQVNLKIKQAFCPPNVVDGNPCLEYIKYIVFPWFEMFEVVRKEANGGNKTFTNMDELIDDYKTGALHPADVKPALAKAINQILQPIRDHFNNNS

SEQ ID NO: 6895 - protein, 133 aa, Oryza sativa
  UNSURE (1)..(133): unsure at all Xaa locations
  Clone ID: PAT_MRT4530_6392C.1.pep
  unsure (1)..(133): unsure at all Xaa locations
EPQFAFSVIVKQVLGLSPEEPVTAMILEDFLAFMKGLISFPLYIPGTPYAKAXITSSFSRISSTVKGIIEERRNAGSSNKGDFLDVLLSSNELSDEEKVSFVLDSLLGGYETTSLLISMVVYFLGQSAQDLEL

SEQ ID NO: 6896 - protein, 288 aa, Oryza sativa
  Clone ID: PAT_MRT4530_64041C.1.pep
MAKDIEASAPEGGEFSAKDYTDPPPAPLIDVEELTKWSLYRAVIAEFIATLLFLYITVATVIGYKHQSDATVNTTDAACSGVGILGIAWAFGGMIFILVYCTAGISGGHINPAVTFGLFLARKVSLIRAVLYIIAQCLGAICGVGLVKGFQSSYYARYGGGANELSDGYSKGTGLGAEIIGTFVLVYTVFSATDPKRNARDSHIPVLAPLPIGFAVFMVHLATIPITGTGINPARSLGAAVIYNKDKAWDDQWIFWVGPLIGAAIAAAYHQYVLRASAAKLGSYRSNA

SEQ ID NO: 6897 - protein, 1048 aa, Oryza sativa
  UNSURE (1)..(1048): unsure at all Xaa locations
  Clone ID: PAT_MRT4530_64237C.1.pep
  unsure (1)..(1048): unsure at all Xaa locations
MGRHQRSGSLSVTSSATPSSDATELDFAAAADVGCPFGRVDALGPVELRETAYEIFFMSCRSSSGGNTAGAAEVSSPVAGPRGGGGSRVKKALGLKARRLSSSSAAMVAQPMMVRTLSQTSGPASPGRGRRPMTSAEIMRQQMRVTEQSDARLRRTLMRAVVGQVGRRPDTIVLPLELLRQLKPAEFADGEEYHQWQFRQVKLLEAGLILHPSLPLDRLNSAVLRFREVMRATEIRAIDTAKSSDAMRTLTSAVHALAWRSGVGSGGGDACHWADGYPLNVLLYASLLHAIFDHRDCTVVLDEVDELLDLIRKTWPTLGVTRPVHNVCLAWAFFQQYVVTGQVEPELAAAALAVLADVAADARGTRDAVYGKALLGALGAMQEWSEKRLLDYHDSYEKGIGGAPTEVMEILLSISLAAGKIIADRDAAADADDAANFAGDRVDYYIRCSMKNAFTXDSRERNGRRRRRAGGGADAAGEGHGGARRRGAAELQPGAEAVAPGAGGRRGGHPARLLRRRAEAVPRQGDHPHGGARPRAPVGEQDGEGHGADDGGGRRRLPRRPGQGHRRRHGALRGGFRRYGLAQGVDGRQVQDHHGLPRQSQRNRELDTKIQRXPFAGSAMEMMKLAKYTVEEFSEIPASAKDEVVQDLVDGLEAIFQEYISFVASCGAKQNYLPPLPPLTRCNQDSGFFKLWRKTVLPSCQAPEGGPRGVGVGGGSHHVPRPSISRGTQRLYVRLNTLEYVLTHLHAIDKSLVAAPSPRFDGARAAAKSAIARVAEVAAFRLVFLDSRHSFYHGLYLRGVAGARLLRRPAVSNLPMAAAAAAASATAAISGALLPHAVACHRLPPRPQLLAVSSSFRRLSLTASPRRASRLVPRADASAEAGEPEPAAEAEAEAVAASTDAEVEEGEAEAAVAVAEEEQEEEDEPPPPSKPPVKFGEIIGILNKQFIEEAEKVKTLPDLRPGDIIELRMQRPNKRRLSLFKGIIIAKHKSGVHTTIRVRRIIAGVGVEITFPIYSPRIKEIKVIRHKKVRRAKLYYLKHKLPRFSTFK

SEQ ID NO: 6898 - protein, 138 aa, Oryza sativa
  Clone ID: PAT_MRT4530_64414C.1.pep
MAEEKHHHHLFHHKKDDEPATGVDSYGEGVYTSETVTTEVVAGGQDEYERYKKEEKQHKHKQHLGEAGALAAGAFALYEKHEAKKDPENAHRHKITEEIAATAAVGAGGYAFHEHHEKKKDHKSAEESTGEKKHHLFG

SEQ ID NO: 6899 - protein, 24 aa, Oryza sativa
  Clone ID: PAT_MRT4530_64758C.1.pep
GYAFHEHHEKKKDHKSAEESTGEK

SEQ ID NO: 6900 - protein, 111 aa, Oryza sativa
  Clone ID: PAT_MRT4530_65023C.1.pep
PGPGRACSSNETKKSIVPAKKKKKKEESMAARTVAVAAALAVLLIFAASSATVAMAGRPTPTTSLDEEAAQAAAQSEIGGGCKEGEGEEECLARRTLTAHTDYIYTQQHHN

SEQ ID NO: 6901 - protein, 597 aa, Oryza sativa
  Clone ID: PAT_MRT4530_6575C.1.pep
MGGEGAEARRLDRAMSFGGAGSIPEEALHLVLGYVDDPRDREAVSLVCRRWHRIDALTRKHVTVPFCYAASPAHLLARFPRLESLAVKGKPRAAMYGLIPEDWGAYARPWVAELAAPLECLKALHLRRMVVTDDDLAALVRARGHMLQELKLDKCSGFSTDALRLVALSCRSLRTLFLEECSIADNGTEWLHDLAVNNPVLETLNFHMTELTVVPADLELLAKKCKSLISLKISDCDFSDLIGFFRMAASLQEFAGGAFIEQGELTKYGNVKFPSRLCSLGLTYMGTNEMPIIFPFSALLKKLDLQYTFLTTEDHCQLIAKCPNLLVLAVRNVIGDRGLGVVADTCKKLQRLRVERGDDDPGLQEEQGGVSQVGLTTVAVGCRELEYIAAYVSDITNGALESIGTFCKNLCDFRLVLLDREERITDLPLDNGVRALLRGCTKLRRFALYLRPGGLSDTGLGYIGQYSGIIQYMLLGNVGETDDGLIRFALGCENLRKLELRSCCFSEQALACAIRSMPSLRYVWVQGYKASKTGHDLMLMARPFWNIEFTPPSSENANRMREDGEPCVDSQAQILAYYSLAGKRSDCPRSVVPLYPA

SEQ ID NO: 6902 - protein, 605 aa, Oryza sativa
  Clone ID: PAT_MRT4530_65929C.1.pep
MELALVGNPSNGVAKPSCNSVGSLPVVSSNAVINPPVTSAAGATLGRHLARRLVQIGATDVFAVPGDFNLTLLDYLIAEPGLKLIGCCNELNAGYAADGYARARGVGACAVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEYAVEAAADFLNKAVKPVMVGGPKIRVAKAKKAFAGIAESSGYPFAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKEMLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 6903 - protein, 211 aa, Oryza sativa
  Clone ID: PAT_MRT4530_66026C.1.pep
AAAAAASACREVWPPVAGSRRYTYTSMILGLAMHGHGEDALSLFAGMQRAGVTPNEVTLLGVLTACCHAGLVEEGLQQLDAMPEPRIEHYGCVVDMLDRAGRLDEAEELVAAMPAHPDALIWGSLLAACRAHDDVERAERVMWRRTTDADADAGDYVLMSNTYASNGRHGEVVKVRRQMRRNEIDKVPDCSLIEIDGVVHEFKAIPANSIR

SEQ ID NO: 6904 - protein, 110 aa, Oryza sativa
  Clone ID: PAT_MRT4530_66161C.1.pep
KNPPRTTPSRPSKMGRSIDQWLRMLLEPIDLDAPCCGPHNEWILLRFNKNVFLPGPPSSLFLGFYKGGTGQISSSQCFAFGPSGPFGLIVFLWICLSCGLAPERVLLTNI

SEQ ID NO: 6905 - protein, 231 aa, Oryza sativa
  Clone ID: PAT_MRT4530_66445C.1.pep
LDGSPRIKIEQHSLTQNMHADTQLGHSRIKEALMRKRITGGILDSNSLRTLKDRRDLFYPFSLILHNTKPVGHQDLVGLVISILLLADFSLVLLTFLQLYSYSMADVLLVLFVLPLGILSPFPAGINALFSHGPRRSAGLARVYALWNITSLVNVVVAFACGLVHYKSSTKRHPSTQPWNLGTDESGWWLFPTGLMLLKCIQARLVDWHVANLEIQDRAVYSNDPSIFWQS

SEQ ID NO: 6906 - protein, 759 aa, Oryza sativa
  Clone ID: PAT_MRT4530_67017C.1.pep
MASGNSSSSSGSMAATAGGVGGWLGFSLSPHMATYCAGGVDDVGHHHHHHVHQHQQQHGGGLFYNPAAVASSFYYGGGHDAVVTSAAGGGSYYGAGFSSMPLKSDGSLCIMEALRGGDQEQQGVVVSASPKLEDFLGAGPAMALSLDNSAFYYGGHGHHQGHAQDGGAVGGDPHHGGGGFLQCAVIPGAGAGHDAALVHDQSAAAVAAGWAAMHGGGYDIANAAADDVCAAGPIIPTGGHLHPLTLSMSSAGSQSSCVTVQAAAAGEPYMAMDAVSKKRGGADRAGQKQPVHRKSIDTFGQRTSQYRGVTRHRWTGRYEAHLWDNSCKKEGQTRKGRQGGYDMEEKAARAYDLAALKYWGPSTHINFPLEDYQEELEEMKNMSRQEYVAHLRRKSSGFSRGASIYRGVTRHHQHGRWQARIGRVSGNKDLYLGTFSTQEEAAEAYDVAAIKFRGLNAVTNFDITRYDVDKILESSTLLPGELARRKGKVGDGGGAAAVADAAAALVQAGNVAEWKMATAAALPAAARTEQQQQHGHGGHQHHDLLPSDAFSVLQDIVSTVDAAGAPPRAPHMSMAATSLGNSREQSPDRGVGGGGGGGVLATLFAKPAAASKLYSPVPLNTWASPSPAEQRVGFAKPNSLWWCLSSQSKLKAHSRSNGGRKPSRGSEKNPPNPCMTFSASLDRTNEFEDATLHVDVILLKVHLVYTLGVSSVAASPRVTEDVALSCVFLHYSLTWELIPSAQPSFVRYVQPSSECKLTD

SEQ ID NO: 6907 - protein, 315 aa, Oryza sativa
  Clone ID: PAT_MRT4530_67035C.1.pep
MADHAAAEAAPQSSQEEEEDWKEAEGGDGDVEVADRGGGGGAANGGIPEGRPIRVYADGIYDLFHFGHAKSLEQAKRLFPNTYLLVGCCNDELTHKYKGRTVMTEDERYESLRHCKWVDEVIPDAPWVVTEEFLNKHNIDFVAHDSLPYADASGAGNDVYEFVKKLGKFKETQRTDGISTSDIIMRIVKDYNEYVMRNLARGYTRKDLGVSYVKEKRLRVNMGLKNLRDKVKQHQEKVGEKWNTMAKLQEEWVENADRWVAGFLEKFEEGCHSMGTAIKERIQERLKAQSRDFSLLQYDGEDVDEDEDDDEYVRE

SEQ ID NO: 6908 - protein, 863 aa, Oryza sativa
  Clone ID: PAT_MRT4530_67341C.1.pep
MGAPAAPATAPPAEAAAVVEEVHRTRSGNSDTTSKRVDQINSKWQFHLSIDDNTDSSCLFKERLTQALRYFKESTDQHLLVQVWAPVKSGDRYVLTTSGQPFVLDQQSIGLLQYRAVSMMYMFSVDGENAGELGLPGRVYKQKVPEWTPNVQYYSSTEYPRLNHAISYNVHGTVALPVFDPSVQNCIAVVELIMTSKKINYAGEVDKVCKALEAVNLKSTEILDHPNVQICNEGRQSALVEILEILTVVCEEHKLPLAQTWVPCKYRSVLAHGGGVKKSCLSFDGSCMGEVCMSTSDVAFHVIDAHMWGFRDACVEHHLQKGQGVSGKAFIYRRPCFSKDISQFCKLEYPLVHYARMFGLAGCFAICLQSMYTGDDDYILEFFLPPNCRNEDDQNALLESILARMKKCLRTLKVVGNGDTNEVCLQISNVLIIETEDLKTNVHFENSEGCFRESPESNGSQRVHEVDNDGNKVSIMSERHLLADDNSQNNGASVGRPNGSGASDSLHKSNKPPERRRGKAEKTISLDVLQQYFSGSLKNAAKSLGVCPTTMKRICRQHGISRWPSRKINKVNRSLSKLKQVIESVQGSDAAFNLTSITGPLPIPVGPSSDSQNLEKASPNKVAELSNLAVEGDRDSSLQKPIENDNLAILMSQQGFIDANNNLQLEADKASHSRSSSGEGSINSRTSEASCHGSPANQTFVCKPIASTFAEPQLIPEAFTKEPFQEPALPLSRMLIEDSGSSKDLKNLFTSAVDQPFLARSSNLALMQNSGTVTIKASFKEDIVRFRFPCSGSVTALKDEVAKRLRMDVGMFDIKYLDDDHEWVKLACNADLEECMEISGSHVIRLLVSDVAAHLGSSCGSSG

SEQ ID NO: 6909 - protein, 243 aa, Oryza sativa
  Clone ID: PAT_MRT4530_67576C.1.pep
MGQSKKKFRGVRQRHWGSWVSEIRHPLLKRRVWLGTFETAEEAARAYDEAAILMSGRNAKTNFPVARNATGELTPAAAVAGRDGRVGGGSGSSSSMTANGGGNSLSQILSAKLRKCCKTPSPSLTCLRLDPEKSHIGVWQKRAGARADSSWVMTVELNKDTAVSSAATVAAATAVSSSDQPTPSDSTVTTTSTSTTGSPSPPPPAMDDEERIALQMIEELLGRSGPGSPSHGLLHGGEGSLVI

SEQ ID NO: 6910 - protein, 227 aa, Oryza sativa
  UNSURE (1)..(227): unsure at all Xaa locations
  Clone ID: PAT_MRT4530_67628C.1.pep
  unsure (1)..(227): unsure at all Xaa locations
MGRGRVELKRIENKINRQVTFAKRRNGLLKKAYELSVLCDAEVALIIFSNRGKLYEFCSGQSMTRTLERYQKFSYGGPDTAIQNKENELVQSSRNEYLKLKARVENLQRTQRNLLGEDLGTLGIKELEQLEKQLDSSLRHIRSTRTQHMLDQLTDLQRREQMLCEANKCLRRKEKLEESNQLHGQVWEHGATLLGYERQSPHAVQQXFTPEQMNNSCVTAFMPTWLP

SEQ ID NO: 6911 - protein, 388 aa, Oryza sativa
  Clone ID: PAT_MRT4530_67786C.1.pep
MTDAPPPRSRPHPPSSSVAVPAAAAAVIAAALASSFLALLQPPRRAPVAAGSRVGMSKARVYADVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTEALNAYLNKYHIELDPQLEALVGRHSRKPWSKFINADNQHLVSPEAVDFLDKLLRYDHQDRLTAREAMAHPYFLQVRAAENSRARPQ

SEQ ID NO: 6912 - protein, 380 aa, Oryza sativa
  Clone ID: PAT_MRT4530_67800C.1.pep
MATAGKVIKCKAAVAWEAGKPLSIEEVEVAPPQAMEVRLKILYTALCHTDVYFWEAKGQTPVFPRIFGHEAGGIVESVGEGVTELSPGDHVLPVFTGECGDCRHCLSEESNLCDLLRINTDRGAMIGDGQTRFTARGGQPVYHFLGTSTFSEYTVVHVGCVAKIHPAAPLDKVCVLSCGISTGFGATVNVAKPPKGCTVAIFGLGAVGLAAMEGARISGASRIIGVDLNPAKFELAKKFGCTDFVNPKDYDKPVQQVIIEMTNGGVDRSVECTGNAAAMISAFECVHDGWGVAVLVGVAGKDAAFKTHPTNFLNERTLRGTFFGNYKPRTDLPGVVEMYMNKELELEKFITHSVPFSEINTAFDLMLSGESLRCIIRMED

SEQ ID NO: 6913 - protein, 185 aa, Oryza sativa
  Clone ID: PAT_MRT4530_67886C.1.pep
MARVYVGNLDPRVTARELEDEFRVFGVLRSVWVARKPPGFAFIDFDDRRDAQDAIRDIDGKNGWRVELSRNASSGRGGRDRYGSSESKCYECGETGHFARECRLRIGSGGLGSGRRRSRSRSRSRSPRYRRSPSYGRRSYSPAGRSPRRRSVSPARARSYSRSPQYNRGRDESPAYDNGYRRSRS

SEQ ID NO: 6914 - protein, 248 aa, Oryza sativa
  Clone ID: PAT_MRT4530_68165C.1.pep
MVKLAFGSLGDSFSATSVKAYVAEFIATLLFVFAGVGSAIAYGQLTNGGALDPAGLVAIAIAHALALFVGVSVAANISGGHLNPAVTFGLAVGGHITILTGLFYWIAQLLGASIACLLLKFVTHGKAIPTHGVAGISELEGVVMEIVITFALVYTVYATAADPKKGSLGTIAPIAIGFIVGANILAAGPFSGGSMNPARSFGPAVAAGNFAGNWVYWVGPLIGGGLAGLVYGDVFIGSYQPVADQDYA

SEQ ID NO: 6915 - protein, 471 aa, Oryza sativa
  Clone ID: PAT_MRT4530_6816C.1.pep
MGAFLLFVCVLAPFLLVCAVRGRRRQAGSSEAAACGLPLPPGSMGWPYVGETFQLYSSKNPNVFFNKKRNKYGPIFKTHILGCPCVMVSSPEAARFVLVTQAHLFKPTFPASKERMLGPQAIFFQQGDYHAHLRRIVSRAFSPESIRASVPAIEAIALRSLHSWDGQFVNTFQEMKTYALNVALLSIFGEEEMRYIEELKQCYLTLEKGYNSMPVNLPGTLFHKAMKARKRLGAIVAHIISARRERQRGNDLLGSFVDGREALTDAQIADNVIGVIFAARDTTASVLTWMVKFLGDHPAVLKAVTEEQLQIAKEKEASGEPLSWADTRRMKMTSRVIQETMRVASILSFTFREAVEDVEYQGYLIPKGWKVLPLFRNIHHNPDHFPCPEKFDPSRFEVAPKPNTFMPFGNGTHSCPGNELAKLEMLVLFHHLATKYRWSTSKSESGVQFGPFALPLNGLPMSFTRKNTEQE

SEQ ID NO: 6916 - protein, 157 aa, Oryza sativa
  UNSURE (1)..(157): unsure at all Xaa locations
  Clone ID: PAT_MRT4530_68543C.1.pep
  unsure (1)..(157): unsure at all Xaa locations
MKGAKSKGAAKPDAKLAVKSKGAEKPAAKGRKGKAGKDPNKPKRAPSAFFVFMEEFRKEFKEKNPKNKSVAAVGKAAGDRWKSLTEADKAPYVAKANKLKAEYNKAIAAYNKGESTAKKAPAKEEEEDDEGESXQSKSRGHDEDDDEGSEEDEDDDE

SEQ ID NO: 6917 - protein, 242 aa, Oryza sativa
  UNSURE (1)..(242): unsure at all Xaa locations
  Clone ID: PAT_MRT4530_68545C.1.pep
  unsure (1)..(242): unsure at all Xaa locations
IVSKKKKKKKKKKKQKKKKKVTIHHTTTTLKADAAXSKDEIQARVAQLKKELSETDSIYDTEKLAERIAKLSGGVAVIKVGAATETELEDRQLRIEDAKNATFAAIEEGIVPGGGTAYVHLSTTVPAIKETIEDHDERLGADIIQKALVAPASLIAHNAGVEGEVVVEKIKDGEWEVGYNAMNDKYENLIEAGVIDPAKVTRCALQNAASVAGMVLTTQAIVVEKPKPKAPVAEPAEGTLTV

SEQ ID NO: 6918 - protein, 174 aa, Oryza sativa
  UNSURE (1)..(174): unsure at all Xaa locations
  Clone ID: PAT_MRT4530_68571C.1.pep
  unsure (1)..(174): unsure at all Xaa locations
SLNCAKCPPEENVYMVKLADQAERYVDMGEYMGKVAKTAYVEEVTVEECNLLSVAXKSEIGDLRASCRNGSSIEXKEEARGNDEHGTLFMDXRDQIEYELSKICDGVLKLLVSLLVPSSTAAQYTVLYLMMKVDYHRYLAXFKTGAERHGAVEITMRAYKDAQDIALFGSCSHP

SEQ ID NO: 6919 - protein, 441 aa, Oryza sativa
  Clone ID: PAT_MRT4530_68696C.1.pep
MEPNAGGGVVSCDLGLIDMGVLCFGASNILLCAEDSSSVLGLGGFGGGGGEVAAELGCGGGGGFDFFGFGGGAVFPIDSDEFVALLVEKEMDHQPQRGYLEKLELGGLECSWRKDAIDWICKVHSYYNFGPLSLYLAVNYLDRFLSSFNLPHDESWMQQLLSVSCLSLATKMEETVVPLPMDLQVFDAEYVFEARHIKRMELIVMKTLKWRLQAVTPFSFIGYFLDKFNEGKPPSYTLASWCSDLTVGTLKDSRFLSFRPSEIAAAVVLAVLAENQFLVFNSALGESEIPVNKEMVMRCYELMVEKALVKKIRNSNASSSVPHSPITVLDAACFSFRMSVKTTPEMGEEEAAAMPTAILLMQCKELKTSVLTPAMLASACTLHLHGRCTTTASPSIAATPRAEEHEEYSTLSQAIRLSLQAASEEEAGRMHSTAQLAAGKM

SEQ ID NO: 6920 - protein, 196 aa, Oryza sativa
  Clone ID: PAT_MRT4530_69125C.1.pep
EFKAILFVPRRAPFDLFDTRKKMNNIKLYVRRVFIMDNCEELIPEWLGFVKGVVDSDDLPLNISREMLQQNKILKVIRKNLVKKCIEMFFEIADNKEDYAKFYEAFSKNLKLGIHEDSQNRGKLADLLRYHSTKSGNELTSLKDYVTRMKEGQKEVYYITGESRKAVENSPFLEKLKKKGYEVLFMVDAIYEYAVG

SEQ ID NO: 6921 - protein, 901 aa, Oryza sativa
  Clone ID: PAT_MRT4530_69157C.1.pep
MDIVPVVALCCCLVLLPSWAYGLGSMASIAVSYGEDGPVFCGLNSDGSHLVTCFGADASVVYGAPSRIPFVGVTAGDGFACGLLLDTNQPYCWGSNSYVKIGVPQPMVEGAMYSELSAGDNHLCALRTSVKGFHSVNGDTSVIDCWGYNMTATHTVTGAVSAISAGSVFNCGLFARNRTVFCWGDESVSGVIGLAPRNVRFQSIGAGGYHVCGVLENAQVFCWGRSLEMQQMSTPSSTDDGDVNIVPMDAMVSVVGGRFHACGIRSLDHQVACWGFTLQNSTLAPKGLRVYAIVAGDYFTCGVPAETSLKPMCWGHSGPLALPMAVSPGICVSDSCSHGYYEYANHGEVGSGSKTCKPANSRLCLPCSVGCPDDSYESSPCNATADRVCQFDCSKCASDECVSFCLSQKRTKNRKFMAFQLRIFVAEIAFAVILVFSVTAIACLYVRYKLRHCQCSKNELRLAKNTTYSFRKDNMKIQPDVEDLKIRRAQEFSYEELEQATGGFSEDSQVGKGSFSCVFKGILRDGTVVAVKRAIKASDVKKSSKEFHTELDLLSRLNHAHLLNLLGYCEDGSERLLVYEFMAHGSLYQHLHGKDPNLKKRLNWARRVTIAVQAARGIEYLHGYACPPVIHRDIKSSNILIDEDHNARVADFGLSILGPADSGTPLSELPAGTLGYLDPEYYRLHYLTTKSDVYSFGVVLLEILSGRKAIDMQFEEGNIVEWAVPLIKAGDISALLDPVLSPPSDLEALKKIAAVACKCVRMRAKDRPSMDKVTTALERALALLMGSPCIEQPILPTEVVLGSSRMHKKVSQRSSNHSCSENDLVDGDDQRIEYRAPSWITFPSVTSSQRRKSSASEADMDGRTTTDGRNVGSSIGDGLRSLEEEISPASPQENLYLQHNF

SEQ ID NO: 6922 - protein, 571 aa, Oryza sativa
  Clone ID: PAT_MRT4530_69460C.1.pep
MDLHQLLKYRLTGANVVYEIPTENNLQNSPWQANPLKYEFSDSPYTPLSSQFECDNLSALTNTPDNQSSTETISAQPISPLEADSSYRQAGILLQENIQVGADPLYATSRHNMQHALREIETVLMAPDTDDATTSTKHEFEEIKPAQLVRQRSRTWSHESRQPLPGVGRSQFASGGYPTASYEFRPEKRQRELREDPQIIVKQLLTRCAEALSEDRTEEFHKLVQEARGVVSINGEPIQRLGAYLLEGLVARHGNSGTNIYRALKCREPESKELLSYMRILYNICPYFKFGYMAANGAIAEALRTENNIHIIDFQIAQGTQWITLIQALAARPGGPPRVRITGIDDPVSEYARGEGLDIVGKMLKSMSEEFKIPLEFTPLSVYATQVTKEMLEIRPGEALSVNFTLQLHHTPDESVDVNNPRDGLLRMVKGLSPKVTTLVEQESHTNTTPFLMRFGETMEYYSAMFESIDANLPRDNKERISVEQHCLAKDIVNIIACEGKDRVERHELLGKWKSRLTMAGFRPYPLSSYVNSVIRKLLACYSDKYTLDEKDGAMLLGWRSRKLISASAWH

SEQ ID NO: 6923 - protein, 472 aa, Oryza sativa
  Clone ID: PAT_MRT4530_6952C.1.pep
MATRGRIVAAVASVVVAWLAVAVGVNGGGCEAERDRVEALPGQPPVAFAQYAGYVAVSEASGRALFYWLTEAAAAAAAATKPLVLWLNGGPGCSSIAYGASEEIGPFRIKTNGTGLYLNKYSWNREANLLFLESPAGVGFSYSNTTSDLKTSGDERTAQDALQFLISWMSRFPQYRHRDFYIAGESYAGHYVPQLARKIVEFNKASPYPFINLKGILVGNGVTDNYYDNIGTVTYWWTHAMISDTTYKAIMSSCNFTSANVSRLCNRAMSYAMNHEFGDIDQYSIYTPSCAAAAANATGRRRGKAAVLRFKDTFLRRRSFGYDPCTETYAEKYYNRPDVQKAMHANITGIPYRWTACSDVLIKTWRDSEFSMLPTYKLLMKAGLRIWVFSGDTDSVVPVTATRFALSHLGLKTKIRWYPWYSAGQVGGWSEVYEGLTFASVRGAGHEVPLFQPRRAFRMFQSFLAGEPLPKS

SEQ ID NO: 6924 - protein, 2299 aa, Oryza sativa
  Clone ID: PAT_MRT4530_69536C.1.pep
MDASAASMLWTLIIILAAAAAASSVHPPQQQSYGVGCIAAERAALLSFKEGVMADPLRLLDSWQGAGDCCRWNGVGCSNRTGHVVKLDLRNTLYWDDQRQVRLDNPHAMRGQVSTSLLALRRLKYLYLSGNNLGGPGIAIPSFLGSLESLVYLNLSCIDFFGEVPTQLGNLSRLSYLDVGSMYYSGQIFSSDLSWLGRLSSLKYLDMSGVNLSMVSDWAHVVNMLPNLRVLNLELCQLTRSNPPLLHSNLTVLEKLVLSSNNFYGPLATNWFWGITTLRTLEVEFCSLYGPLPDSLGNMTALQVLDMQDNDNITGMFPPTLKNLCNLQEVFTGTNLSGDITEQMERLPKCAWDKLQALNLDATNMTGNLPVWLVNLTNLKDLSVSGNQLSGPVPLGLGALTKLTILYLGHNNLTGIISEDYLANLCNMVILDLSYTSLEVVVGSTWTPPFKLIRAQLASCQLGPGFPILFKHQKGIIYIDVSNAGIADAIPSWFWDEISYAFYVDMSHNQIDGELPAKLEARTRQELHLNSNQLKGSIPQLLRNITKLDISRNSLSAPLPSDFQAPELAALVLFSNYIPGSVPLSIYLEQQLLQILQCKKENFPLSYLGLPLSTHKLRIQDLRPTIAKVDKYLAGWEASLLSYAERIVLINAALNSIPVYAMSALKLPLGTIEEIDKKRKAFLWTGDDSCSGARCLVAWDRVCQPKECGGLGIKDLHLQNEALLIKRLFHLHHSNSSWANWIWEEFSDTSLLHLGTHWSSLQSLLPTMRRLSLVSIGDEAHTSFWFDNWLPDGPLCDSFAALLTHSLDLEITVQTVFQTGLQHCFVPRLSSVALAQLDALQDKLLSVHLHECPDFRAAKCSPQLPILSAKHIYEATQVWLDACPNWKFVWHNKAPLKAQLFAWLLAKERLPTKHNLRMRHLMVILSERATMIGPRRRAAARRGCRAPPQRREDPEDDEDDDGRRCHAEDIPPRRRSLRDVIIGRGRSVESRAAEGARHRSRTPHPSSRQRAHGNGRQGRSRTRHSSQCSCRCRSRRTRSPSSLTPRGQDGTGDAGGATTKVVAVSGQADGDQQPVNALVSLPDPLIQILCSSPLLPFSDEQGDHDPMLPLLAEIAPKSSREAENETKRTGGEEPILGEDKVASAAELGQEKMGHLGPDAQQAPKMDLLAQSTQDDEAQASTGDQPTLVQQADCEEQHQATVQTQPIHGGEGEREKVVLSPLFSQLQPPIILQAPLELAPPGAAKTKGCGRKVVQMPSRRSGRKARFSSVPVSKRAEVRLMEEMGLLTPGEPVGDAAVEAYAKSFDTPLPLHVIAGLRVLTRLDGVHDMPVPGEEGTTTTAVPLLAVWSMRLALPCSNGLKPELLSRLMRIALPVDTGLQLVSSRVDRLEDSEIASTCWNVRGLNNPARREAVLEAAELARAGILCLQETKLSSIDQWIGKEIGGNRLSNFNFLPANGTRGGIAIFWDDTIVNMANFSQGTHHLSVMATTITDNLSFIIIVVYGPSEDCDKENFLAELVTAKPPTDTPWLVMGDFNIIYEARDKNNQNLNRHLMGRFRLDVALETRTLTAEEHQFRKDLKIRILGLAAVEKARKKQASRVKWLKEGDANTRFFHIKMNARRRKKFIHCLQQDGNTLHTHEDKAAHLHAHFNSILGTRRQRGCTLNWEALGLSTIQDDSMDEPFTEDEIWEAIKNSPKEKVPGPDGFTGAFYKSCWHIIKKEIVDVFASFHNLTGGNFGSINRAMITLLPKKDSPRSVNDFRPISLIHSVAKLISKTLAMRLAALLGDLVSHAQSAFIKKRCIQDNFLYVRNMVRSLHMQRKPSLFFKLDITKAFDSVSWEYLVEMLQWRGFSQRWRNWIVLLLSTASSRILLNGIAGEPTTHRRGLRQGDPLSPYLFILAIDPIQRLLNKATQEGLLSPLSNRAAQFRISLYADDAAIFINSIRNDVNNLISILKFFGEATGLQVNLHKSSVVSIKCAEQNLSEVLENFNGQRGNFPITYLGLPLTPGRIKRIHLQPVMDKLQSRLAGWKGKLIQQSGRKTLVMSVLSFIPTYFLTALKPPKQFLTDMDKIRKKFLWAGDQEISGGKCKVNWKKVCSPIKMGGLGVLDLDKFARALRLRWLWFEWECPDKPWVGTTPPCDELDEQIFAAATKVTIGNGRKAKFWTSNWIGHQPLKYLAPALFNHSKGKQRLVQDALTNDKWIEDIRHELSMPLIREFFAVFRLIWDNETNLEERVEDTITWRWTNTGKYTAKSAYLAQFAGRKDSRAATLIWKTWAPSKCKNFAWLVLQNRIWTSDRLQV

SEQ ID NO: 6925 - protein, 943 aa, Oryza sativa
  UNSURE (1)..(943): unsure at all Xaa locations
  Clone ID: PAT_MRT4530_69540C.1.pep
  unsure (1)..(943): unsure at all Xaa locations
MAMTITDNLSFIITVVNGPSEDCDKENFLAELVAAKPPTDTPWLVMGDFNIIYEARDKNNQNLNRRLMGRFRLDVALETRTLIAEEHQFRKDLKIRILGLAAVEKARKKQASRVKWLKEGDANTRFFHIKMNARRRKNFIHCLQQDGNTLHTHEDKAAHLHAHFNSILGTRRQRGCTLNWEALRLSTIQDDSMDEPFTEDEIWEAIKNSPKEKAPGPDDFTGAFYKNCWHIIKKEIVDVFASFHNLTGGNFGSINRAMITLLPKKDSPRSMNDFRPISLIHSVAKLISKTLAMRLAARLGDLVSHAQSAFIKKRCIQDNFLYVRNMARSLHMQRKPSLFFKLDITKAFDSVSWEYLVEMLQCRGFSQHWRNWIVLLLSTASSRILLNGIAGEPTTHRRGLRQGDPLSPYLFILAIDPIQRLLNKATQEGLLSPLSNRAARFKISLYADDAAIFINSIRNDVNNLISILKFFGEATSLQVNLHKSSVVPIKCAEQNLSEVLENFNGQRGNFPITYLGLPLTPGHIKRIHLQPVMDKLQSRLAGWKGKLIQQSGRKTLVTSVLSSIPTYFLTALKPPKQFLTDMNKIRKKFLWAGDQEISGGKCKVNWKKVCSPIKMGGLGVLDLDKFARALRLRWLWFEWECPDKPWVGTTPPCDELDEQIFAAATKVTIGNGRKAKFWTSNWIGHQPLKYLAPALFNHSKGKQRLVQDALTNDKWIEDIRHELSMPLIREFFAVFRLIWDNETNLEEGVEDTIIWRWTNXTGKYTAKSAYLAQFAGREDSRAATLIWKTWAPSKCKNFAWLVLQNRIWTSDRLQLRQWPNNYFCQLYYRNLETAQHLLKDCPFTREIWDKIMARMNHNQPFPVHNPDESLVDWWESRTKQQSKCQSKGMQSLHMLLSWEIWCERNMRVFKDKELQIPQLTARIMDEIHTWSACGAKYLARIAP

SEQ ID NO: 6926 - protein, 418 aa, Oryza sativa
  Clone ID: PAT_MRT4530_69798C.1.pep
MAWCAARSRLLPLATAPQLLRRLLLSSAAAPRYAHPHHHHSNSRRRRRPLAPTVYAAAAAAAAEAPLPMPPRIGRATRHPGGAASVARVYADANSQRPKEYWDYESLDIEWGEQDGYEVLRKLGRGKYSEVFEGFRPGGDERCVIKILKPVKKKKIKREIKILQNLYGGPNIVKLLDVVRDDESKTPSLIFEYVNNTDFKVLYPTLLDYDIRYYIYELLKVICPTSLFSNALDYCHSRGIMHRDVKPHNIMIDHEKRQLCLIDWGLAEFYHPKMEYNARVASRSYKGPELLVDLLDYDYSLDLWSLGCMFAAMIFRVDPFFNGQDNYDQLVKITEVLGTEDFYNYLEKYGLELDPQLERLVGRHNRKPWSMFVNSGNRHLASPEAIDFVDRLLRYDHQERPTAKEAMAHPYFNPVRST

SEQ ID NO: 6927 - protein, 1175 aa, Oryza sativa
  Clone ID: PAT_MRT4530_70006C.1.pep
MAEGVVFAALCKIGSVLASSASITLGGRLDANLTIINEIESRIKQIEVELKLMQAFLRQAQKQEGYSEPTEVYLQEVRKAAFEIEDIIDEFLYLSVKHKNRFFNGEFMSYFRKLGKTSWHKIARELKDSQCHLQNLRNLWVQYEIQLPNGNRVSTDVEDHRLPHHLSYPADEMVGVEQERTMMMNWLKTCSTSVITVWGMGGSGKTTLANSIYEDERIKNQFDCHIWITVSQKFNASDIMRKMVRHMLQRCSPNIDSIDGRDLVEILKRTLEHRKILLVLDDVWSTDVWMDLASTVERSNNNGNKVVITTRIKDVASLASEDQVLQLQKLNDADSWCLFCRWAFKNRIDRSCPQELESLGREIMVKCDGLPLAIVVVGNMLSFKKQDMEEWSKCNDQLTWELRDRLRDQELSSVMKILKLSYKNLPSHLKNAFVFCSIFPEDYMITKKRLVRLWVAEGLIKPEKRRTVEEVAEEYLNELIDRCLLQVVERKHFRKVKEFQMHDIVRELAISISEDETFCMTHSKSHPGEPEYRCRRLSIHEHNDRIKSVSDPSRLRSLYHFDVTCSSFPSVGTPRSARYLNVLELQDVPITVLPEELSGLFNLRYLGLRRTKIKQLPQSVDKLFNLQTLDVYLTNVDKLPTGIAKLKRLRHLLAGKLSAPLYCGIVEKSRGVQAPKVVWESMELQTLKGVLANLNLVENLGHMTQLRTLAIEDVGEEHYPKLFASISKMRSLRTLKVLSAEGNQGLNFEALSLPPQNLRKLHLTGRFHHAVMESNFFQTVGAKLEKLYLTGSKTNIDPLISISCLSNLKVLQIGDAYDGASFVFQSGWFPKLHTLIMCNLLHINSMIMEQQTLQNLQWLALVNFPELKEVPHGIELLLSLQNLMLVNMHDEFMERIQGQEDPLGTMSRLMDRCLNDDETVIDAGMCNYGGLGVPNLELMGIALRSRWTWLQRTSSSKPWQGLAIPGSQKERNFVAASTICQLRDGQTILFWEDSWLQEGCIRSFAPNIYDKIPPRVRRCRTVAEALTGRQWIKDIRGALGIQPILEYLKLWSLVQMVDLDPTTPDSIIWKWESSGQYSSKSAYKALFSGRVTFLSTPIWKSLAPPRCCFFLWLVAMNRCWTADRLRSRGLPHPDRCVLCDQYEESIDHILVACLVNEPSFHNWLCESRMKIGERH

SEQ ID NO: 6928 - protein, 530 aa, Oryza sativa
  UNSURE (1)..(530): unsure at all Xaa locations
  Clone ID: PAT_MRT4530_70155C.1.pep
  unsure (1)..(530): unsure at all Xaa locations
MPRGRSTTTTTSSSASNPFHAFASTLPFLPSPSPSPTSASPSPSPPAPHLAVPLILPITSSSSASAAAASPESNRGARMAAAASGGKAGGGGGLGKGGGPAFVGQVFTMLDPSGNGLMAVTTRFELPQFLASRTPMWFKRILSPLKKSENGPVFRFFMDLNDAVSYVKRLNVPSGMVGACRLDVAYEHFKEKPQMFQFVPSEKQVKAANKLLKSLPQRRRRKKLDGVPVFSAQNLNIAVATNDGIRWYTPYFFDKNLLDNILEASMDQHFHSMVQNRHTRRRRDIVDDSLTSEMMEESADSFLEPPEVQELMNEIGPVGIPLNVVTKAAEIQFLDVVDKMLLGNKWLRKATGIQPQFPYVVDSFEERTAAAIDRAATASSSFTASKDADCFQISKQPETLESDVDNSNRGKHENSNNGQSHFPFSNLLPNIWPGHDRSFKAQGRDRAFRRCDASINNDLQANPLLPKITMVGISMGEGGQMSKANLKKXMEDLTKELEQAGEKTIFSDEKDPLFVANVGDYSRITKISST

SEQ ID NO: 6929 - protein, 1081 aa, Oryza sativa
  Clone ID: PAT_MRT4530_70289C.1.pep
LVLENKKRDEDNPHSAHPHPVSTRPGREQGGEAPEPNGGPRPPTVRAGPLPACPTVPGAPDPQDGPGATAGRPRLSPSDPEVVGTEVECAPGGLSDEERPGDAAPGEEDRPRRKVQRPVYFVSEALRDAKTRYPQAQKMLYAILMASRKLRHYFLAHRVSVVTSYPLGQILHNREGTGQVVKWAIKLSEFDLHFEPRHAIKSQALADFVAEWTPAPEPVSVLEASSGPSQLPHTAYWVMQFDGSLSLQGAGAGVTLTSLNGDVLRYLVRLDFRATNNMAEYEGLLAGLRVAAGLGIRRLLVLGDSQLVVNQVCKEYRPPPGAFEERLAQPSARPDPLGETDAPERPPRPVGVQASGPDGSVPSSLRLIAWIAEIQAYLADKTLPEDREGSERVQRISKRYVLALQTIPLSWLFAVWGLDILGPFRRAPGGFEYLYVAVDKFTKWPEAYPVIKIDKHSALKFIRGITARFGVPNRIITDNGTQFTSELFGDYCEDMGIKLCFTSPAHPRSNGQVERANAEILKGLKTKTFNILKKHGDSWIEELPAVLWANRTTPSRATGETPFFLVYGAEAVLPSELTLRSPRATMYCEADQDQLRRDDLDYLEERRRRAALRAARYQQSLRRYHQRHVRARSLCVDDLVLRRVQTRAGLSKLSPMWEGPYRVIGVPRPGSVRLAMGDGTELPNPWNIEHLRRFYPYGTMNRVPTSWGFVYSRVNKVTTLAPAFMLWVLCGYRVPTGSVWAQGSPRGEGSRSLFGAQRAGTRLHWRNGPVAVDRQRVRASGHAGHQPVQQRRFVVVVKRFPTFPVPTKAAFASATTTATRRRRRRRGEEEREGEREAERYEEMVEYMERVARAAGGASGGEELTVEERNLLSVAYKNVIGARRASWRIISSIEQKEEGRGNDAHAATIRSYRGKIEAELARICDGILALLDSHLVPSAGAAESKVFYLKMKGDYHRYLAEFKSGDERKQAAESTMNAYKAAQDIALADLAPTHPIRLGLALNFSVFYYEILNSPDRACNLAKQAFDEAISELDSLGEESYKDSTLIMQLLRDNLTLWTSDANDDGGDEIKEAAAPKEPGDQ

SEQ ID NO: 6930 - protein, 585 aa, Oryza sativa
  Clone ID: PAT_MRT4530_70309C.1.pep
MDDDFEMPPPGADDDLMMGEDGMGDFGGADGPPLKVGEEKEIGKQGLRKKLLKEGEGWETPEVGDEVEVHYTGTLLDGKKFDSSRDRGTPFKFKLGQGQVIKGWDLGIKTMKKGENAVFTIPPDLAYGESGSPPTIPASATLQFDVELLSWTSVKDICQDGGIFKKILKEGEKWENPKDLDEMDLDIVVAKYEARLEDGTVISKSEGAEFTVKDGFFCPALAKAVKTMKKAEKVLLTVKPQYGFGENGRPAAGEEGAVPPNATLLVNLELVSWKTVTEIGDDKKILKKVLTEGTGYERPNEGAVVKVKITGKLQDGTIFTKKGHDEPEPFEFKTDEEEVIDGIDRAVLNMKNGEVALVTIPPEYAFGSTESKQDLAVVPPNSTVIYEVELVSFVKDKESWDLNNTEKIETAGAKKEEGNALFKLGKYVRASKRYEKAAKFIEYDSSFSEDEKKQSKQLKVTCNLNNAACKLKLKDYKQAEKLCTKVLELDSQNVKALYRRAQAYMQLADLELAEVDIKKALEIDPDNRDVKLTYKNLKEKVKEYNKKDAKFYSNMFAKMTKQPAEDGKAGSGAESKQGSEPVTAA

SEQ ID NO: 6931 - protein, 149 aa, Oryza sativa
  Clone ID: PAT_MRT4530_70658C.1.pep
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYEGRYWTMWKLPLFGCTDSAQVLKEVEECKKEY

SEQ ID NO: 6932 - protein, 607 aa, Oryza sativa
  UNSURE (1)..(607): unsure at all Xaa locations
  Clone ID: PAT_MRT4530_70933C.1.pep
  unsure (1)..(607): unsure at all Xaa locations
MATMGSLIGLVNRIQRACTVLGDHGGGGEGGSLWEALPSVAVVGGQSSGTSSVLESIVGRDFLPRGSGXPLVLQPHKTXGGQELAGFLHAPRKRFTDFAAVRKEIADETDRITGKTKAISNIPIHLSIYSPHVVNLTLIDLPGLTKVAVEGQQESIVQDIENMVRSYVDKPNSIILAISPANQDIATSDAIKLARDVDPSGDRTFGVLTKLDLMDKGTNAVDVLEGRQYRLQHPWVGIVNRSQADINRNVDMLAARRKEKEYFESSPDYGHLAHKMGAEYLAKLLSQHLEAVIRAKIPSIIAMINKTIDEIEAELDRLGRPIGGDAGAQLYTILDMCRAFDRVFKEHLDGGRPGGDRIYGVFDHQLPAALKKLPFDKHLSLQNVRKVISEADGYQPHLIAPEQGYRRLIDSSLHYFRGPAEASVDAVHLVLKELVRRSIAATEELKRFPTLQTDIAAAANESLERFREDGRKTVIRLVEMEASYLTVEFFRKLPTEPDKGANNNTPANDRYQDNHLRRIGSNVSSYINMVCETLRNTIPKAVVHCQVKEAKRNLLNRFYAHVGSKEKKQLSAMLDEDPALMEKRDSLVKRLELYKSARNEIDSVAWK

SEQ ID NO: 6933 - protein, 447 aa, Oryza sativa
  Clone ID: PAT_MRT4530_71768C.1.pep
MDEEYDVIVLGTGLKECIISGLLSVDGLKVLHMDRNDYYGGESTSLNLTKLWKRFKGNETAPEHLGVSKEYNVDMVPKFMMANGALVRVLIHTSVTKYLNFKAVDGSFVYNNGKIHKVPATDVEALKSNLMGLFEKRRARKFFIYVQDYEEDDPKSHEGLDLHKVTTREVISKYGLEDDTVDFIGHALALHRDDNYLDEPAIDTVKRMKLYAESLARFQGGSPYIYPLYGLAELPQAFARLSAVYGGTYMLNKAECKVEFDENGKAYGVTSEGETAKCKKVVCDPSYLPDKVKKVGRVARAICIMKHPIPDTKDSHSVQIILPKKQLKRKSDMYVFCCSYAHNVAPKGKFIAFVSTEAEADKPEIELKPGIDLLGPVEETFFDIYDRYEPTNTADEDNCFVTNSYDATTHFETTVKDVLALYSKITGKELDLSVDLNAASAAESEAA

SEQ ID NO: 6934 - protein, 140 aa, Oryza sativa
  Clone ID: PAT_MRT4530_71830C.1.pep
MRKYRVAGLVAALLVLHSLATPSAQAEAHRAGGEGEEKMSSDGGPVLGGVEPVGNENDLHLVDLARFAVTEHNKKANSLLEFEKLVSVKQQVVAGTLYYFTIEVKEGDAKKLYEAKVWEKPWMDFKELQEFKPVDASANA

SEQ ID NO: 6935 - protein, 807 aa, Oryza sativa
  UNSURE (1)..(807): unsure at all Xaa locations
  Clone ID: PAT_MRT4530_71949C.1.pep
  unsure (1)..(807): unsure at all Xaa locations
MAADPSAAAAAAPDPDGPDAVRLTWNAWPRSKVEASRCVVPLAAAISPVRSPESLASPPLPYPPLRCKPPCSALLNPFARVDFAAKIWICPLCFSRNHFPPHYAAISESNVPAELFPQCSTVEYLLAGAAPAAGVPLHQGGPPAPPPPVFLFVIDTCVIEEELEYVKMSMRKAVALLPEHALVGLVTFGTQVHLHELGFSDLSKIYVFRGTKEISKEQILDQLGLAGAGRPGFPKMPQQPGGPQINGMHPPATAGVTRFLLPVSDCECTLSTLLDELQPDQWPVETGNRAIRCTGVALSVAAGLLGACMPGTGARIIALLGGPCTEGPGMIVSKDLSEPVRSHKDLDKDAAPHFQKAVKFYDGLAKQLVSQGHVLDVFASALDQVGLAEMKVAIERTGGLVVLSESFGHSVFKDSFKRIFEGGEQSLDLSFNGTLEINCSKDIKVQGIIGPCTSLEKKGALCADTVVGQGNTTAWKMCGLDRNTSLTVFFDVSPSERSSQPGHQNPDLYIQFVTSYQHPEGQMRIRVTTICRKWVDGSTNTEELVEGFDQETAAVVLARYISLKMEMEEEFDATRWLDGSALMLFSRXGDYRKHDASSYNLHXAMFLFAQLKLKLRRSQVVEVTPGFDILVTADVRVFNNSPDETAYFRMLLNRESITNSVAMIQPSLISFSFDLPPSPVFLDVASIAADRILLLDAYFSVVIFHGMTIAQWRNMGYQNQPEHQQFAQLLQAPHEEAQIIIKGRFPAPRLVVCDQHGSQARFLLAKLNPSATYNSAHDVPPGSDIIFTDDVSFQVFCEHLQRLAVQS

SEQ ID NO: 6936 - protein, 90 aa, Oryza sativa
  Clone ID: PAT_MRT4530_72502C.1.pep
MKKPYIVHKIIAYQALFYGQHSFACADLLWHVKGYAKCKFFLWFAFQQCCWTADLLRKCGIDSHSACPFCAQELETANHILLDCVFARQV

SEQ ID NO: 6937 - protein, 568 aa, Oryza sativa
  Clone ID: PAT_MRT4530_72558C.1.pep
MQDQRAGPAKSKEKKRVSRHKQAKLTTVIIKAVPLTTKELRQKKSELRVERRRVKMGGDERAVAAPLLQQQQDGGGGDGERRRRRWWWGWWDGEEAAGQLAFAAPMVATSMAYYAIPLVSVMYAGRLGELELAGATLGNSWGTVTGIALMPWLNIRGVLAAKGLQKDKLDTGLSGSLETLCGQGYGAKMYHMMGVYLQASIITSAFFSVLVSLLWFYSEPVLIFLRQDPEVTRTATLFLRYSIPAQFAYGFIQCTLRFLQTQSVVTPLVVFALLPLVLHFGITHAFVHYLGFGYAGAGMSTSVSLWLSFLMLAAYVCLSERFKHTWEGFSTEAFRHVLPGLKLAIPSAVMVCFEYWAFEVLVLVAGLMPNSHMSTSIIAMCENTEAISYMITYGFAAAISTRVSNELGAGNVAKAKKALAVTLVLSLLLGVAFLLLLGLGHDLWAGLFSKSDAVISEFASMTPLLIGSVVLDSTQGVLSGVSRGCGWQHLAAWTNLVAFYIVGLPLSILFGFKLGLQTKDQMGKIRADNERQRRRFCLLRLERSELTSLAAAYASLVESNIEVKSFRA

SEQ ID NO: 6938 - protein, 625 aa, Oryza sativa
  Clone ID: PAT_MRT4530_7261C.1.pep
MAVMEEQQEGAAGVMRRRPKTKIVCTLGPASRSVEMIGRLLRAGMCVARFNFSHGSHEYHQETLDNLRAAMESTGILCAVMLDTKARDFVLGVLILATFYFLQDFCAVVFTVGRCSSLILGFSPPDYSAGQKTISVMFCWLKISLDDDKICVVHDQFSERLCSGFLNGIKPILDLLKIQGPEIRTGFLKDGKPVQLKKGQEITVSTDYSIKGDDNMISMSYKKLAVDLKPGSVILCADGTITLTVLHCDKEQGLVRCRCENTAMLGERKNVNLPGVIVDLPTLTEKDKEDILKWGVPNKIDMIALSFVRKGSDLVEVRKVLGKHAKSIMLMSKVENQEGVANFDDILAQSDAFMVARGDLGMEIPIEKIFYAQKVMIFKCNIQGKPVVTATQMLESMIKSPRPTRAEATDVANAVLDGTDCVMLSGETAAGAYPELAVRTMAKICLQAESCVDHAAVFKSITASAPIPMSPLESLASSAVRTANSAKAALILVLTRGGTTARLVAKYRPSMPILSVVVPELKQTDSFDWTCSDEAPARHSLIVRGVIPMLSAATAKAFDNEATEEALGFAISNAKAMGLCNSGAPSVFAVHGLTIETVKFVIATAAYFAASAATSIKLDSRYVIC

SEQ ID NO: 6939 - protein, 399 aa, Oryza sativa
  UNSURE (1)..(399): unsure at all Xaa locations
  Clone ID: PAT_MRT4530_72804C.1.pep
  unsure (1)..(399): unsure at all Xaa locations
ATALRESKPVYLSISCNLPGLPHRTFSRDPVPFFLAPRLSNKMGLEAAVEATVEFLNKAVKPVLVGGPKLRVAKAGKAFVDLVDASGYAYAVMPSAKGLVPETHPHFIGTYWGAVSTAFCAEIVESADAYLFAGPIFNDYSSVGYSFLLKKDKAIIVQPERVIVGNGPAFGCVMMKEFLSELAKRVNKNTTAYENYKRIFVPEGQPLESEPNEPLRVNVLFKHVQKMLNSDSAVIAETGDSWFNCQKLKLPEGCGYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWTSKVKCEEELTEAIGMALGEKDCLCFIEVIAHKXDTSKELLEWGS

SEQ ID NO: 6940 - protein, 379 aa, Oryza sativa
  Clone ID: PAT_MRT4530_72817C.1.pep
MASLASPPLPCRAAATASRSGRPAPRLLGPPPPPASPLLSSASARFPRAPCNAARWSRRDAVRVCSQAGAAGPAPLSKTLSDLKDSCWRFLRPHTIRGTALGSIALVARALIENPQLINWWLVFKAFYGLVALICGNGYIVGINQIYDIRIDKVNKPYLPIAAGDLSVQTAWLLVVLFAAAGFSIVVTNFILFITSLYCLALFLGTIYSVPPFRLKRYRAPACLIIATVRGFLLNFGVYYATRAALGLTFQWSSPVAFITCFVTLFALVIAITKDLPDVEGDRKYQISTLATKLGVRNIAFLGSGLLIANYVAAIAVAFLMPQAFRRTVMVPVHAALAVGIIFQTWVLEQAKYTKDAISQYYRFIWNLFYAEYIFFPLI

SEQ ID NO: 6941 - protein, 115 aa, Oryza sativa
  Clone ID: PAT_MRT4530_73562C.1.pep
MQVGGTAAAAAEVSMSYRETRREEEKRRGTKMKVKILQWHGVASWTWNAQDETCGICRMAFDGCCPDCKFPGDDCPLIWGSCNHAFHLHCILKWVNSQTSTPLCPMCRREWQFKG

SEQ ID NO: 6942 - protein, 83 aa, Oryza sativa
  Clone ID: PAT_MRT4530_73807C.1.pep
QSKVSMPPPPPTASALQPTPPTRILLRRPAPVSAASWPSPTARRTPSAPSPFPAPAPPSPPTSLLPSPPPRLLAGGGRTSARS

SEQ ID NO: 6943 - protein, 116 aa, Oryza sativa
  UNSURE (1)..(116): unsure at all Xaa locations
  Clone ID: PAT_MRT4530_73817C.1.pep
  unsure (1)..(116): unsure at all Xaa locations
MAIGSLIASRLARSTGHALASAASQAPMARHAAASPLLSRLGSVARAFSSKPAAADVIGIDLGTTNSCVSVMEGKAPRVIENAEGARTTPSIVAKNQNGDLLVGITASRQXSDQWP

SEQ ID NO: 6944 - protein, 578 aa, Oryza sativa
  UNSURE (1)..(578): unsure at all Xaa locations
  Clone ID: PAT_MRT4530_74258C.1.pep
  unsure (1)..(578): unsure at all Xaa locations
MSATTSNSRRLCNGRGQVIPGPTLPEAVKMGPHAIRIVVGGLGEGELSTATTVHGPERASSSSAPPEMASAALPEAVAPKKKGNVRFAFACAILASMTSILLGYDIGVMSGASLYIKKDFNISDGKVEVLMGILNLYSLIGSFAAGRTSDWIGRRYTIVFAAVIFFAGAFLMGFAVNYAMLMFGRFVAGIGVGYALMIAPVYTAEVSPASARGFLTSFPEVFINFGILLGYVSNYAFSRLPLNLGWRIMLGIGAAPSVLLALMVLGMPESPRWLVMKGRLADAKVVLEKTSDTAEEAAERLADIKAAAXGIPEELDGDVVTVPKRGSGNEKRVWKELILSPTPAMRRILLSGIGIHFFQQASGIDSVVLYSPRVFKSAGITDDKHLLGTTCAVGVTKTLFILVATFFLDRVGRRPLLLSSTGGMILSLIGLGAGLTVVGQHPDAKIPWAIGLSIASTLAYVAFFSIGLGPITWVYSSEIFPLQVRALGCSLGVAANRVTSGVISMTFLSLSKAITIGGSFFLYSGIAALAWVFFYTYLPETRGRTLEEMSKLFGDTAAASESDEPAKEKKKVEMAATN

SEQ ID NO: 6945 - protein, 228 aa, Oryza sativa
  Clone ID: PAT_MRT4530_7432C.1.pep
MARERREIKRIESAAARQVTFSKRRRGLFKKAEELSVLCDADVALIVFSSTGKLSHFASSSMNEIIDKYNTHSNNLGKAEQPSLDLNLEHSKYAHLNEQLAEASLRLRQMRGEELEGLSIDELQQLEKNLEAGLHRVMLTKDQQFMEQISELQRKSSQLAEENMQLRNQVSQISPAEKQVVDTENFVTEGQSSESVMTALHSGSSQSQDNDDGSDVSLKLGLPCGAWK

SEQ ID NO: 6946 - protein, 424 aa, Oryza sativa
  Clone ID: PAT_MRT4530_74368C.1.pep
MASGDGGDDAGVKRVADRYLKREVLGEGTYGVVFKAVDTKTGNTVAIKKIRLGKYKEGVNFTALREIKLLKELKDSNIIELIDAFPYKGNLHLVFEFMETDLEAVIRDRNIVLSPADTKSYIQMMLKGLAFCHKKWVLHRDMKPNNLLIGADGQLKLADFGLARIFGSPERNFTHQVFARWYRAPELLFGTKQYGSAVDIWAAGCIFAELLLRRPFLQGSSDIDQLGKIFAAFGTPKSSQWPDMVYLPDYVEYQFVSAPPLRSLFPMASDDALDLLSRMFTYDPKARITAQQALEHRYFLSVPAPTKPSQLPRPPPKGDSGNNKIPDLNLQDGPVVLSPPRKLRRVTAHEGMEVHMHRADRTEEHPSGARHMDDMSSQSSRIPMSVDVGAIFGTRPAPRPTLNSADKSRLKRKLDMDPEFGYTE

SEQ ID NO: 6947 - protein, 377 aa, Oryza sativa
  UNSURE (1)..(377): unsure at all Xaa locations
  Clone ID: PAT_MRT4530_74539C.1.pep
  unsure (1)..(377): unsure at all Xaa locations
MAVGEVLTERRRETLTTDLVLIPICRQEPKISSIVPEEAAAGEYLAIISASYVTNRNWTVLPVQTKQVSDLQQQEAKLCKQSYIRVTCITYSETDLSCGPSSMTELTAAAAPAGSGSSAAVAAGSSEKMGRGKIEIKRIENTTNRQVTFCKRRNGLLKKAYELSVLCDAEVALIVFSSRGRLYEYANNSVKSTVERYKKANSDTSNSGTVAEVNAQHYQQESSKLRQQISSLQNANSRTIVGDSINTMSLRDLKQVENRLEKGIAKIRARKNELLYAEVEYMQKREVELQNDNMYLRSKVVENERGQQPLNMMGAASTSEYDHMVNNPYDSRNFLQVNIMQQPQHYAHQLQPTTLQLGXSSRPSISFGVDTVRTHVR

SEQ ID NO: 6948 - protein, 417 aa, Oryza sativa
  Clone ID: PAT_MRT4530_75365C.1.pep
MEHLPVEVIGNILAHLSAARDVMVASGVCRKWRTACRKHLHSLSFNSDDFPRDMTTRQLEIVITQTIFQTMGLQCLSIHIDRTHEFSAAPVIAWLMYTRETLRSLSYNVRTNPNVNILEKCGRQKLEVLDLDHNTITGVEPSYQRFTCLKSLSLRHVSISALDLSLLVAACPKIESLALDFLEVVTSDPQSTMELTSHTLKSLFAKSVGVDKIILDTDNLEVLNLNALNLDLFELIGKGTLKHLKIDDVSVTHMDIGESTDHLEVVDVSNFTIVRPKLYSMISRASNLRMLRFWGVVFDDEDEIVDSETIAVSFPLLRHLSLSYELRDGLLHYSLQGSSPLDNVSVLELGWTVISEHFGPWVFGMIERCPNLKKLVIHGVLSEAKTREERQMLASFTSFIVCLMRKYVHVDVQFEYE

SEQ ID NO: 6949 - protein, 724 aa, Oryza sativa
  Clone ID: PAT_MRT4530_75414C.1.pep
YKHTFLTSPNSTFSCGFYPIGTNAFTFSIWLTNTAGKTVVWSANRRSPVNGHGSKVLLHDDGYLVLIDVNGSTVWTSTMSAGEGSTAALLESGNLVVRDSSGTILWESFTSPTDTLLPAQQLTKDTRLVSGYHSLYFDNDNSLRLVYNGPEFSSIYWPNDDYTMFRDGIKVKNNSRLAVLDDKGGFFSSDALTVQASDFGLGIKRRLTLDYDGNLRIYSLDASDGSWTVTWQAIVEMHYVHGMCGKNGICEYLPELRCSCPPGFEMVDPQNWSKGCRPTFSYNCGKERYKFIEIPQTDFYDFDLGFNQSISFEECQNICLSTCSCIAFSYRLTGTGVCYPKGLLFNGYKSPAFPGTLYLKVPYSTNLQASSTQSALTCSPGTEGGYMMIRNQFRGFTYQELKEATGKFREELGRGSSGIVYRGVLKDKRVIAVKKLIDVTRGEVEFQAEMSVIGKINHMNLVRIWGFCSEGKHKLLVYEYVENESLDRYLFNTMGTERLLVWKDRFNIALGAARALAYLHHDCLEWVFHCDVKPENILLTRDFEAKIADFGLSKLYKREGSSFNFSQMRGTMGYMAPEWATNLPINAKVDVYSYGVVLLEIVAGQRISSHTTREGKVTKLKQFIENVKEALATGDTKCIVDAIRFGMKQPRAADIVRPDSTNDGCNSCSRMPRRPLCWRSSCARSAALGERRTPWPQPLLRGGRAVGRGRAAAGAPLRQRWVME

SEQ ID NO: 6950 - protein, 772 aa, Oryza sativa
  Clone ID: PAT_MRT4530_75416C.1.pep
MAKFLYLIILSFFLSLLVFCTSASPRLTLHTGSSFSVEDYKHTFLTSPNSTFSCGFYPIGTNAFTFSIWLTNTAGKTVVWSANRRSPVNGHGSKVLLHDDGYLVLIDVNGSTVWTSTMSAGEGSTAALLESGNLVVRDSSGTILWESFTSPTDTLLPAQQLTKDTRLVSGYHSLYFDNDNSLRLVYNGPEFSSIYWPNDDYTMFRDGIKVKNNSRLAVLDDKGGFFSSDALTVQASDFGLGIKRRLTLDYDGNLRIYSLDASDGSWTVTWQAIVEMHYVHGMCGKNGICEYLPELRCSCPPGFEMVDPQNWSKGCRPTFSYNCGKERYKFIEIPQTDFYDFDLGFNQSISFEECQNICLSTCSCIAFSYRLTGTGVCYPKGLLFNGYKSPAFPGTLYLKVPYSTNLQASSTQSALTCSPGSQEIATPSDHPRWLYFYIFPGVFGALELIFILTAWWFLSIRNDIQNSAEGGYMMIRNQFRGFTYQELKEATGKFREELGRGSSGIVYRGVLKDKRVIAVKKLIDVTRGEVEFQAEMSVIGKINHMNLVRIWGFCSEGKHKLLVYEYVENESLDRYLFNTMGTERLLVWKDRFNIALGAARALAYLHHDCLEWVFHCDVKPENILLTRDFEAKIADFGLSKLYKREGSSFNFSQMRGTMGYMAPEWATNLPINAKVDVYSYGVVLLEIVAGQRISSHTTREGKVTKLKQFIENVKEALATGDTKCIVDGRLHGQFNSEQAMVMLIVAVSCLEEERSKRPTMHEVVKSLLDCEE

SEQ ID NO: 6951 - protein, 516 aa, Oryza sativa
  Clone ID: PAT_MRT4530_75440C.1.pep
MADIDMANIDMGKILAGLENDDARVPKTKLVCTLGPASRSVPMLEKLLRAGMNVARFNFSHGTHEYHQETLDNLRQAMHNTGVLCAVMLDTKGPEIRTGFLKDGKPIKLTKGQELTVTTDYEIKGDENMITMSYKKLPVDVKPGNVILCADGTISLTVLSCDPKAGTVRCRCENTAMLGERKNCNLPGIVVDLPTLTEKDKEDILGWGVPNDIDMIALSFVRKGSDLVTVRQLLGQHAKRIKLMSKVENQEGVVNFDEILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNEAVFKEMIRSAPLPMSPLESLASSAVRTANKAKAALIVVLTRGGTTAKLVAKYRPRVPILSVVVPVLTTDSFDWTISSEGPARHSLIYRGLVPLLAEGSAKATDSESTEVILDAALKSAVQKQLCKPGDAVVALHRIGVASVIKICIVK

SEQ ID NO: 6952 - protein, 964 aa, Oryza sativa
  Clone ID: PAT_MRT4530_7604C.1.pep
MYFLVVIMVVVDASEFGAEGFDPKRWINAALDARHPSEPLDRFLADAEERLRSAADDAAAALERDSADALRRVPLACRDALRLRDDAVSLRSHLASVLQSLSQVRPRSPASWIWISQFTRAQFYVHVNFEYAVEDIQIQQFSDAHKTMPIVYYNGIPSLISFSSYRYSVPSTFHKFCITDDDDFFNQAEGSSAESITALARIDTVKQRMEAAYATLQDAAGLAQLSQSVEDVFSSGDLPKAAETLATMRHCLSAVGEVAEFANVRKQLEVLEERLDDMVQPRLVDALSNRKPTNFGWKVDAVQDLRGILIRIGRFKSLEVQYTKIHVKPLKKLWEDFDLKQRAKRVEMEKYGGESINSLSFASWLPNFYDETLLYLEQEWKWCLTAFPEEYKSLVPKVLVETMSELNSSFVSRVNLATGDAVPETRSVAKGILDVLSGDLPKSTKLQNKHLGALIDLHNMTGTFARNIQHLFSESDLLVLLNTLKAIYSPYETFKARYGQMERALLSAEMAGIDIRGAIARGVGAQGIELSETVRRMEESIPQIIVLLEAAVERCISLTGGSEADELVLALDDIMLQYISNLQETLKSLRIVCGVDNTAHSDSSKKEAGLEKKEAQRLVDVSEEEEWSIVQGALQILTVADCLTSRTSVFEASLRATLARIGTNFSISGFGSSLDKSTAANGDENAEVPITGRAALDIAAIRLTDLPDKSKKLFTVLEQASYIFLNYLASVTTLELSHVSLICLNSLIANLGGSIKLDYLSKDPRFHALPLTSQRVAAFSDTVNELVYDVLISKVRQRLNEVARLPIWSSVEEPGGLPLPSFSAYPQAYVTSVGEYLLTLPQQLEPLAEGISGGEAGNEEAQFFATEWIFKVAEGATALFMEQLRGIHYITDRGAQQLAADIEYLSNVLSALSMPIPPFLATFHTCISTPRDQVRDLIKSDGGSQLDLPTAHLVCKIRRISSSD

SEQ ID NO: 6953 - protein, 132 aa, Oryza sativa
  Clone ID: PAT_MRT4530_7616C.1.pep
MSEHAVKEDVVRRLKLLSAKGAGRVAINAALLEEISRPTALLKCKPEEEFALSRALRVPEKIGTSKGVLAKEERLVRRTRRVALVTRPTPEKTIPDTRRKLNVEHRIPNKKKLGDDRDNEGAADVRNPGVVC

SEQ ID NO: 6954 - protein, 497 aa, Oryza sativa
  Clone ID: PAT_MRT4530_76302C.1.pep
MVLSHASSGRDDAVRCTFATRYACETLPRFRMPEQSIPREAAYQIINDELMLDGNPRLNLASFVTTWMEPECDKLIMDSVNKNYVDMDEYPVTTELQNRCVNMIAHLFNAPIKEDETAIGVGTVGSSEAIMLAGLAFKRKWQNKRKEQGKPCDKPNIVTGANVQVCWEKFARYFEVELKEVKLSEGYYVMDPVKAVEMVDENTICVAAILGSTLTGEFEDVKLLNNLLTEKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYKNIMQNCMENTAILREGIEATGRFEILSKEAGVPLVAFSLKDSGRYTVFDISEHLRRFGWIVPAYTMPANAEHVAVLRVVIREDFSRSLAERLVSDIVKILHELDAHSAQVLKISSAIAKQQSGDDGVVTKKSVLETEREIFAYWRDQVKKKQTGIC

SEQ ID NO: 6955 - protein, 811 aa, Oryza sativa
  Clone ID: PAT_MRT4530_76315C.1.pep
MRKWALSSALLLLLLLTTLPDPAKKLQVNADDSTDELVDPPKVEEKIGGVPHGLSTDSEVVQREAESISRKTLRSSAEKFEFQAEVSRLMDIIINSLYSNKDIFLRELISNASDALDKIRFLALTDKEVLGEGDTAKLEIQIKLDKEKKILSIRDRGIGMTKEDLIKNLGTIAKSGTSAFVEKMQTGGDLNLIGQFGVGFYSVYLVADYVEVISKHNDDKQHVWESKADGSFAISEDTWNEPLGRGTEIRLHLRDEAKEYVEEDKLKDLVKKYSEFINFPIYLWATKEVDVEVPADEDESSESSEEEESSPESTEEEETEESEEKKPKTKTVKETTTEWELLNDVKAIWLRSPKEVTEEEYTKFYHSLAKDFGDDKPLSWSHFTAEGDVEFKALLFVPPKAPHDLYESYYNSNKSNLKLYVRRVFISDEFDELLPKYLSFLKGLVDSDTLPLNVSREMLQQHSSLKTIKKKLIRKALDMIRKLAEEDPDEYSNKDKTDEEKSAMEEKKGQYAKFWNEFGKSVKLGIIEDATNRNRLAKLLRFESTKSEGKLASLDEYISRMKPGQKDIFYITGSSKEQLEKSPFLERLTKKNYEVIYFTDPVDEYLMQYLMDYEDKKFQNVSKEGLKLGKDSKLKDLKESFKELTDWWKKALDTESVDSVKISNRLSDTPCVVVTSKYGWSANMEKIMQSQTLSDASKQAYMRGKRVLEINPRHPIIKELRDKVAQDSESESLKQTAKLVYQTALMESGFNLPDPKDFASSIYRSVQKSLDLSPDAAVEEEEEVEEAEVEEKESSNIKEEAEPSSYDKDEL

SEQ ID NO: 6956 - protein, 232 aa, Oryza sativa
  Clone ID: PAT_MRT4530_76352C.1.pep
MAPSLLGGFTKSLAMTVLSEIGDKTFFAAAILAMRYPRKLVLAGCLTSLTVMTALSVSLGWVAPNLISRKWTHHVTTLLFFVFGILSLWEGFKEDGDSEELAEVEAELDANFKSNKAESKSKSKANDDKKKQQRPFVLQFFSPIFIKAFSITFFGEWGDKSQIATIGLAADENPFGVVLGGVLAQALCTTAAVMGGKSLASQISEKMVGLSSGVLFLLFGIMSYLSGPEGEL

SEQ ID NO: 6957 - protein, 194 aa, Oryza sativa
  Clone ID: PAT_MRT4530_76521C.1.pep
MGRGKIEIKRIENSTNRQVTFSKRRSGILKKAREISVLCDAEVGVVIFSSAGKLYDYCSPKTSLSRILEKYQTNSGKILWDEKHKSLSAEIDRIKKENDNMQIELRHLKGEDLNSLQPKELIMIEEALDNGIVNVNDKLMDHWERHVRTHQQDIALSGSMRDLELGYHPDRDFAAQMPITFRVQPSHPNLQENN

SEQ ID NO: 6958 - protein, 209 aa, Oryza sativa
  Clone ID: PAT_MRT4530_76522C.1.pep
MGRGKIEIKRIENSTNRQVTFSKRRSGILKKAREISVLCDAEVGVVIFSSAGKLYDYCSPKTSLSRILEKYQTNSGKILWDEKHKSLSAEIDRIKKENDNMQIELRHLKGEDLNSLQPKELIMIEEALDNGIVNVNDKLMDHWERHVRTDKMLEDENKLLAFKLHQQDIALSGSMRDLELGYHPDRDFAAQMPITFRVQPSHPNLQENN

SEQ ID NO: 6959 - protein, 608 aa, Oryza sativa
  Clone ID: PAT_MRT4530_76548C.1.pep
MDTTIGSVPTASDAAAPAPAANSAPREATLGRHLARRLAEVGARDVFTVPGDFNLTLLDELEAEAGAGHGGVRLVGCCNELNAAYAADGYARARGGGVGACAVTFTVGGLSAINAVAGAFSENLPVVCIVGGPNSNDYGSNRILHHTIGLPDFTQELRCFQTVTCYQAVVNNLEDAHEQIDAAISTAIKESKPVYISISCNLPSIPHPTFSRHPVPFFLSPRLSNQMNLEAAVETAAAFLNKAVKPVLVGGPKMRVAKACKSFVELADACGYPVAVMPSAKGLVPEHHPRFIGTYWGAVSTPFCAEIVESADAYLFAGPIFNDYSSVGYSLLLKKEKAIIVQPDRVVIGHGPAFGCVLMKDFLHALSARLKKNTAAYENYRRIYVPPGEPPLSEPGEPLRVNVLFQHIQKMLSANSAVIAETGDSWFNCQKLKLPEGCGYEFQMQYGSIGWSVGATLGYAKAAKDKRVIACIGDGSFQVTAQEVSTMLRWGQKSIIFLINNGGYTIEVEIHDGPYNVIKNWNYTGVVEAFHNGEGKCYTAKVRTEEELKEAIEEAQGPKKDCLCFIEVIVHKDDTSKELLEWGSRVSAANSRPPNPQVSTSDIRLAMF

SEQ ID NO: 6960 - protein, 581 aa, Oryza sativa
  Clone ID: PAT_MRT4530_77185C.1.pep
MTICSCEETINEFEMLTRDAARVQKDTLKKILEINASAEYLQNFGLGGRTDAESYKSCIPLCVHNDIEPYIQRIVDGDTSPVVTGEPITNLSLSSGTTHGKPKFIPFNDELLETTLQIYRTSYAFRNREYPIGQGKALQFVYGSKQVITKGGILATTATTNLYRRQRYKEGMKDIQSQCCSPDEVIFGPDFHQSLYCHLLCGLIYSEEVHSVFSTFAHSLVHAFQTFEEVWEDLCTDIRDGVLSKKVTAPSIREAVSKILKPNPELADSIYKKCIGLSNWYGVIPALWPNAKYVYGIMTGSMEPYLKKLRHYAGNLPLISADYGASEGWVGSNIDPTVPPEQVTYAVLPQVGYFEFIPLEKPIGEETENSASIHYIESDPVGLTEVEVGKIYEVVITNFAGLYRYRLGDVVKIARFHNSTPELQFICRRSLVLSINIDKNTEKDLQLAVEEASKFLEGEKLEVMDFTSFVERSSDPGRYVIFWELSGDASDEVLSSCANALDLAFIDAGYTGSRKIKTIGPLELRILRKGTFKEILDHFLSLGGAVSQFKTPRFVNPSNSKVLQILSRNVTQSYFSTAYGF

SEQ ID NO: 6961 - protein, 302 aa, Oryza sativa
  Clone ID: PAT_MRT4530_77608C.1.pep
MSTCDSMKSPDFEYIDNGDSSSVLGSLQRRANENLRISEDRDVEETKWKKDAPSPMEIDQICDVDNNYEDPQLCATLASDIYMHLREAETRKHPSTDFMETLQKDVNPSMRAILIDWLVEVAEEYRLVPDTLYLTVNYIDRYLSGNEINRQRLQLLGVACMLIAAKYKEICAPQVEEFCYITDNTYFRDEDPALHLEFLANYVAELSLLEYNLLSYPPSLVAASAIFLAKFILQPAKHPWNSTLAHYTQYKSSELSDCVKALHRLFCVGPGSNLPAIREKYTQHKIYAADVIDLNMMIQRDS

SEQ ID NO: 6962 - protein, 497 aa, Oryza sativa
  Clone ID: PAT_MRT4530_77611C.1.pep
MSSNLAASRRSSSSSSVAAAAAAKRPAVGEGGGGGGGKAAAGAAAAKKRVALSNISNVAAGGGAPGKAGNAKLNLAASAAPVKKGSLASGRNVGTNRASAVKSASAKPAPAISRHESATQKESVLPPKVPSIVPTAALAPVTVPCSSFVSPMHSGDSVSVDETMSTCDSMKSPEFEYIDNGDSSSVLGSLQRRANENLRISEDRDVEETKWKKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDECWNESNSNNSLIAYNRRFVRVAQVSDELFIVQDPALHLEFLANYVAELSLLEYNLLSYPPSLVAASAIFLAKFILQPTKHPWNSTLAHYTQYKSSELSDCVKALHRLFSVGPGSNLPAIREKYTQHKIYAADVIDLNMMIQRDS

SEQ ID NO: 6963 - protein, 518 aa, Oryza sativa
  Clone ID: PAT_MRT4530_77613C.1.pep
SPPAAAALATLAAAAGGGGFRWWLPSADVEQPSLPPLVVVAAAKRPAAGEGGGKAAAGAAAAKKRVALGNISNVAAAANNAKFNSATWAAPVKKGSLASGRNVGMNRVSAVKSASAKPAPAISRHESAPQKESVLPPKVPSIVPTAALAPVTVPCSSFVSPMHSGDSVSVDETMSTCDSMKSPEFEYIDNGDSSSVLGSLQRRANENLRISEDRDVEETKWKKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEVTAPTAKCFLRRFVRVAQVSDEDPALHLEFLANYVAELSLLEYNLLSYPPSLVAASAIFLAKFILQPTKHPWNSTLAHYTQYKSSELSDCVKALHRLFSVGPGSNLPAIREKYTQHKYKFVAKKPCPPSIPTEFFRDATC

SEQ ID NO: 6964 - protein, 296 aa, Oryza sativa
  Clone ID: PAT_MRT4530_77697C.1.pep
MPVVAASGHGLRRTMYSLYSKGSFLLLLGRRCIGGGGAPPGEGMGMRCSGDDEDHLIPRKYHLIRGRAQCTLRGPNVSVVAVHQQNTPRVRESAAAATSNRDVYRSVTTCARASERMSAAEERGDRQERDDGEGGEEERRERGGVGGLVDRAKGFVAEKIAKIPKPDATLDRVSFKGVSRECITLHSHLDVNNPYSHRIPICELTYTFKSGDKVIASGTMPDPGWIAASGTTNLELPVKVPYDFIVSLIKDVSGDWDIDYVLEVGITIDLPVVGSFTIPLATEGEMKLPTFRDLLF

SEQ ID NO: 6965 - protein, 164 aa, Oryza sativa
  UNSURE (1)..(164): unsure at all Xaa locations
  Clone ID: PAT_MRT4530_77850C.1.pep
  unsure (1)..(164): unsure at all Xaa locations
WIPGLQARSALSLCFDSIRFDLLHLVAAAAADKDWLRGSIFLIIATLAWASLFILQAATLKRYDAPLSLTTLICFVGTLQAIVVTFAMEHSMSVWKIGFDMNLLAAAYAGIVTSSIAYYVQGLVMQSRGPVFASAXSPLMMIIVAIMGSFILAENIYLGGIIGS

SEQ ID NO: 6966 - protein, 456 aa, Oryza sativa
  Clone ID: PAT_MRT4530_77859C.1.pep
MGPSAAALRAAAVVGLVVAVGLALPPLAAALRPLRERVASAGAASSSGSWGDEHAFFKRDENEISPYSWNITGTYKGSWNFAGSTNGSSRFLEFTKLKGDAVLELLSTPTKISGVHYVQGSVTFHDVLDNAHDRGVAQISGADGEPLQEEDYFLSNPYHLNMSVQFGPLAFHNLKDSSFEVVYIILQGAAKVSILMIGQQAIMDAYLCLLHLTAGILVESLFNAFATAAFFKFVVFSIFEMRYLLAIWKASRPLNSGEGWEVMRRELSVLYSRFYGILLGGILLMYELHNFLRPLLFLMYSFWVPQIVTNVIRDTRKPLHPQYILGMTITRLAIPLYIFGCPSNFMRIEPDKTWCIAVTIFMGIQAAVLLLQHYFGSRCFIPHQILPEKYCYHRKVEDNTNQPIDCVICMTTIDLTQRTSEYMVAPCEHIFHSGCLQRWMDIKMECPTCRRSLPPA

SEQ ID NO: 6967 - protein, 532 aa, Oryza sativa
  UNSURE (1)..(532): unsure at all Xaa locations
  Clone ID: PAT_MRT4530_77861C.1.pep
  unsure (1)..(532): unsure at all Xaa locations
ERVASAGAASSSGSWGDEHAFFKRDENEISPYSWNITGTYKGSWNFAGSTNGSSRFLEFTKLKGDAVLELLSTPTKISGVHYVQGSVTFHDVLDNAHDRGVAQIRLEGVYIWPFRQLRMVANSGADGEPLQEEDYFLSNPYHLLRIFSSQVFQETSEEKNRRKNSLTYDMEKHCSVEIAAKVVRVSSNLNEGEHEKYRLEGLMESTAVDDDGECFSPILLNATSLNVEVYYNKAVNYTLMVTFISFLQVLLLIRQMEHSNTQSGAAKVSILMIGQQAIMDAYLCLLHLTAGILVESLFNAFATAAFFKFVVFSIFEMRYLLAIWKASRPLNSGEGWEVMRRELSVLYSRFYGILLGGILLMYELHNFLRPLLFLMYSFWVPQIVTNVIRDTRKPLHPQYILGMTITRLAIPLYIFGCPSNFMRIEPDKTWCIAVTIFMGIQAAVLLLQHYFGSRCFIPHQILPEKYCYHRKVEDNTNQPIDCVICMTTIDLTQRTSEYMXAPCEHIFHSGCLQRWMDIKMECPTCRRSLPPA

SEQ ID NO: 6968 - protein, 487 aa, Oryza sativa
  Clone ID: PAT_MRT4530_77880C.1.pep
MVSQVVAEEKPQLLSKKAGCNSHGQDSSYFLGWQEYEKNPFDPVSNPSGIIQMGLAENQLSFDLLEEWLEKNPHALGLRREGGGASVFRELALFQDYHGLPAFKNALARFMSEQRGYKVVFDPSNIVLNAGATSANEALMFCLADHGDAFFIPTPYYPGFDRDLKWRTGAEIVPVHCASANGFRVTRAALDDAYRRAQKRRLRVKGVLITNPSNPLGTASPRADLETIVDFVAAKGIHLISDEIYAGTAFAEPPAGFVSALEVVAGRDGGGAGVSDRVHVVYSLSKDLGLPGFRVGAIYSANAAVVSAATKMSSFGLVSSQTQYLLAALLGDRDFTRSYVAENKRRIKERHDQLVDGLREIGIGCLPSNAGLFCWVDMSHLMRSRSFAGEMELWKKVVFEVGLNISPGSSCHCREPGWFRVCFANMSAKTLDVAMQRLRSFVDSATGGGDNAALRRAAVPVRSVSCPLAIKWALRLTPSIADRKAER

SEQ ID NO: 6969 - protein, 233 aa, Oryza sativa
  Clone ID: PAT_MRT4530_77902C.1.pep
MAAKIFCFLMLLGLSASVATATIFPQCSQAPIASLLPPYLSPAVSSMCENPIVQPYRIQQAIATGILPLSPLFLQQPSALLQQLPLVHLVAQNIRAQQLQQLVLANLAAYSQQHQFLPFNQLAALNSAAYLQQQLPFSQLVAAYPQQFLPFNQLAALNSAAYLQQQQLLPFSQLADVSPAAFLTQQQLLPFYLHAMPNAGTLLQLQQLLPFNQLALTNSTVFYQQPIIGGALF

SEQ ID NO: 6970 - protein, 99 aa, Oryza sativa
  UNSURE (1)..(99): unsure at all Xaa locations
  Clone ID: PAT_MRT4530_77952C.1.pep
  unsure (1)..(99): unsure at all Xaa locations
MAAEKHHHHLLHHKKDVVPATCVDSDREGVYTSETVTTEVVASRQHXCERYKKEEKXQHKHKQHXSLGLCPRRSAFGLVEKHXAKNDPENAHRHKITEE

SEQ ID NO: 6971 - protein, 645 aa, Oryza sativa
  Clone ID: PAT_MRT4530_78529C.1.pep
MAPALSRSLGASSVAALRPTPSRGRGPTLRSAVAVQGRGAAAVAARGVRWEAGRRKGKGRMVGVRCEAAVTEKPAGEEEAAGEQFEYQAEVSRLLDLIVHSLYSHKEVFLRELVSNASDALDKLRFLSVTDSSVLSDGGELEIRIKPDPEAGTITITDTGIGMTKDELKDCLGTIAQSGTSKFLKALKENKDLGADNGLIGQFGVGFYSAFLVAEKVVVSTKSPKADKQYVWEAMADSSSYVIKAETWAEKMLTRGTQITLFLRDDDKYEFADPGRIQGLVKNYSQFVSFPIYTWQEKSRTVEVEEEEPKEGEEATEGEKKKKKKTITEKYWDWELANETKPIWMRNPKEVEKTEYNEFYKKAFNEFLDPLAYTHFTTEGEVEFRSVLYIPGMAPLSNEEIMNPKTKNIRLYVKRVFISDDFDGELFPRYLSFVKGVVDSNDLPLNVSREILQESRIVRIMRKRLVRKTFDMIQEIAERDDEEDYKKFWESFGKFVKLGCIEDTGNHKRLSPLLRFYSSKNETDLISLDQYVENMPENQKAIYYIATDSLQSAKTAPFLEKLVQKDIEVLYLIEPIDEVAIQNLQTYKEKKFVDISKEDLELGDEDEDKENESKQEYTLLCDWIKQQLGDKVAKVQISKRLSSSP

SEQ ID NO: 6972 - protein, 242 aa, Oryza sativa
  Clone ID: PAT_MRT4530_78867C.1.pep
MRKAYKDSLKVLEADIQHANTLASEFPREYDGACLQMRLSYSPAAHIFLFLVQWTDCSLAGALGLLRILVYKVYVDGTTTMSTHERKASIKEFYAVIFPSLLQLQRGITDTEDKKQKAVCMERYRRRDEDERNILSEIDAEREEECGICMEMNSKVVLPNCTHNMCLRCYQDWNSRSQSCPFCRDNLKKTDPGDLWIYVEDQDVVDLETVSRENLRRLFMYINKLPLIVPDVIFSIYDSHIK

SEQ ID NO: 6973 - protein, 336 aa, Oryza sativa
  Clone ID: PAT_MRT4530_79066C.1.pep
MAPLGDGAAAAAAAEPNLVVSFGEMLIDFVPDVAGVSLAESGGFVKAPGGAPANVACAISKLGGSSAFVGKFGDDEFGHMLVDILKKNGVNAEGCLFDEHARTALAFVTLKSNGEREFMFYRNPSADMLLTEAELNLDLIRRAKIFHYGSISLITEPCRSAHVAAMRAAKSAGILCSYDPNVRLPLWPSEDAARAGILSIWKEADFIKVSDDEVAFLTQGDANDEKNVLSLWFDGLKLLIVTDGEKGCRYFTKDFKGSVPGFSVNTVDTTGAGDAFVGSLLVNVAKDDSIFHNEEKLREALKFSNACGAICTTKKGAIPALPTVAVAQELISKAAN

SEQ ID NO: 6974 - protein, 91 aa, Oryza sativa
  Clone ID: PAT_MRT4530_79068C.1.pep
MSGRGKGGKGLGKGGAKRHRKVLRDNIQGITKPAIRRLIYEETRGVLKIFLENVIRDAVTYTEHARRKTVTAMDVVYALKRQGRTLYGFGG

SEQ ID NO: 6975 - protein, 174 aa, Oryza sativa
  UNSURE (1)..(174): unsure at all Xaa locations
  Clone ID: PAT_MRT4530_79070C.1.pep
  unsure (1)..(174): unsure at all Xaa locations
EERVEGWMREXIAEIVRHIGEAPFLVHLFNDDDGGSGRGGAGRVTVRRETASAESWPDVRRRWGPGGMRRPDGIILVEQIAAAVEEGGASAGAGAAEAARQVWGLVVXARGMECASCYVLDTCRVRSPAGLCTHFCLARAQCFGDPRQXLAPQRLAQPPFPSLVVTAAAAAAAY

SEQ ID NO: 6976 - protein, 237 aa, Oryza sativa
  Clone ID: PAT_MRT4530_79072C.1.pep
MSGRGKGGKGLGKGGAKRHRKGLRDNIQGITKPAIQRLARRGGVKRISGLIYEETRGVLKILVASHPRESPPTGQQQSRGEGKKKKKKRRRRRPWRGVRTPPGATPITTTSSPIPLAFLSLSCVEPPESSSSAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6977 - protein, 223 aa, Oryza sativa
  Clone ID: PAT_MRT4530_79077C.1.pep
MRGLGNRARLPEPRNFQSLPTPQNAKFSTAPARGLHSTENPAKRARSAPPPLTRGSLPDPTAGAAPPHHSRGSLPDPTAAHSPPNSIYIHPSQTNRPPHPNLATKKIPNSAVVFVAVAARMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6978 - protein, 103 aa, Oryza sativa; identical to SEQ ID NO: 3555
  Clone ID: PAT_MRT4530_79079C.1.pep

SEQ ID NO: 6979 - protein, 103 aa, Oryza sativa; identical to SEQ ID NO: 3555
  Clone ID: PAT_MRT4530_79080C.1.pep

SEQ ID NO: 6980 - protein, 133 aa, Oryza sativa
  Clone ID: PAT_MRT4530_79083C.1.pep
VRPGRPGSKPKKSPNLKSSSVSKLSSSSSDMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6981 - protein, 103 aa, Oryza sativa; identical to SEQ ID NO: 3555
  Clone ID: PAT_MRT4530_79084C.1.pep

SEQ ID NO: 6982 - protein, 844 aa, Oryza sativa
  Clone ID: PAT_MRT4530_79184C.1.pep
MNNTRLNGGLQHRSMGCSPRLSLRRMADLQEPLVRPKRKKVLVDYLVKFRWILVIFVVLPISALIYFNIYLGDVWSAMKSEKRRQKEHDDNVQKVVKRLKQRNPKKDGLVCTARKPWIAVGMRNVDYKRARHFEVDLSAFRNILEIDRERMVAKVEPLVNMGQITRATCPMNLALAVVAELDDLTVGGLINGYGIEGSSHLYGLFSDTVVAVEVVLADGRVVRATKDNEYSDLFYGIPWSQGTLGFLVSAEIKLIPIKEYMRLTYTPVKGSLKEIAQGYCDSFAPRDGDPAKVPDFVEGMVYTENEGVMMTGVYASKEEAKKKGNKINCVGWWFKPWFYQHAQTALKKGEFVEYIPTREYYHRHTRCLYWEGKLILPFGDQFWFRFLLGWLMPPKVSLLKATQGESIRNYYHDNHVIQDMLVPLYKVGDALEFVHKEMEVYPLWLCPHRLYKLPVKTMVYPEPGFEHHHRQGDTSYAQMFTDVGVYYAPGAVLRGEEFNGALAVHRLEQWLIENHSYQPQYAVSELNEKDFWRMFDASHYEHCRQKYGAVGTFMSVYYKSKKGRKTEKEVQEAEAAILEPAYADEADRGGALPPPAASTHPVLAGGAKPPVTIPDPIAALLSSTPIPSSSDASARPPPYPYQPESAADPTRQAFTAEQINETTYVDIHGNKSVFDSLRNNPKVHYDGRRFSYKSKHDLKGKDQLLVLVRKYPEGLAVVEVKDAYPTVMEDLQALKAAGEVWLLSNMDSQEDIVYPNDPKAKIKVDDDLKQLFREMELPRDMVDIEKELQKNGIKPMTNTAKRRAAAQINGVQPKAKPKKKQREITRRTKLTNAHLPELFQNLNT

SEQ ID NO: 6983 - protein, 561 aa, Oryza sativa
  Clone ID: PAT_MRT4530_79187C.1.pep
MADLQEPLVRPKRKKVLVDYLVKFRWILVIFVVLPISALIYFNIYLGDVWSAMKSEKRRQKEHDDNVQKVVKRLKQRNPKKDGLVCTARKPWIAVGMRNVDYKRARHFEVDLSAFRNILEIDRERMVAKVEPLVNMGQITRATCPMNLALAVVAELDDLTVGGLINGYGIEGSSHLYGLFSDTVVAVEVVLADGRVVRATKDNEYSDLFYGIPWSQGTLGFLVSAEIKLIPIKEYMRLTYTPVKGSLKEIAQGYCDSFAPRDGDPAKVPDFVEGMVYTENEGVMMTGVYASKEEAKKKGNKINCVGWWFKPWFYQHAQTALKKGEFVEYIPTREYYHRHTRCLYWEGKLILPFGDQFWFRFLLGWLMPPKVSLLKATQGESIRNYYHDNHVIQDMLVPLYKVGDALEFVHKEMEVYPLWLCPHRLYKLPVKTMVYPEPGFEHHHRQGDTSYAQMFTDVGVYYAPGAVLRGEEFNGALAVHRLEQWLIENHSYQPQYAVSELNEKDFWRMFDASHYEHCRQKYGAVGTFMSVYYKSKKGRKTEKEVQEAEAAILEPAYADEA

SEQ ID NO: 6984 - protein, 429 aa, Oryza sativa
  Clone ID: PAT_MRT4530_79269C.1.pep
MTSSGAPPPAAMAVDDAEDDQLASMSTEDIVRASRLLDNEIRVLKDELQRTNLELESFKEKIKENQEKIKLNKQLPYLVGNIVEILEMNPEDEAEEDGANIDLDSQRKGKCVVLKTSTRQTIFLPVVGLVDPDKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYA

SEQ ID NO: 6985 - protein, 533 aa, Oryza sativa
  Clone ID: PAT_MRT4530_79285C.1.pep
MAGGGAAPPPKQEELQPHQVKDQLPSVSYCITSPPPWPEAVILGFQHYIVMLGTSVIIPSALVPQMGGGNEEKARVIQTLLFVAGINTLCQSFFGTRLPAVMGGSYTIVAPTISIILAGRYSNEADPHEKFLRTMRGTQGALIIASTIQIILGFSGLWRNVVRLLSPLSAVPLISLAGFGLYELGFPGVAKCVEIGLPEIILLLVFSQYLPHVIHVAKPVFDRFAVIFTIAIVWLYAYILTASGAYKNARPKTQVHCRVDRSGIISGAPWIRVPFPFQWGAPTFDAGESFAMMMASFVALVESTGTFIAVSRYASATMIPPSVLGRGIGWQGIGTLIGAFFGTANGTAVSVENAGLLALTHVGSRRVVQISAGFMIFFSILGKFGAIFASIPLPIFAALYCIFFAYIGACGLSFLQFCNLNSFRTKFIVGFSFFMGLSVPQYFNEYTSVAGYGPVHTGARWFNDMINVPFASKPFVAGLIAYFLDNTIQRRDNGVRRDRGYHWWDKFRSFKTDTRSEEFYSLPFNLNKFFPSV

SEQ ID NO: 6986 - protein, 487 aa, Oryza sativa
  Clone ID: PAT_MRT4530_79466C.1.pep
MGMERPQEKVATTTTAAFNLAESGYADRPDLDDDGREKRTGTLVTASAHIITAVIGSGVLSLAWAIAQLGWVIGPAVLVAFSVITWFCSSLLADCYRSPDPVHGKRNYTYGQAVRANLGVAKYRLCSVAQYVNLVGVTIGYTITTAISMGAIKRSNWFHRNGHDAACLASDTTNMIIFAGIQILLSQLPNFHKIWWLSIVAAVMSLAYSTIGLGLSIAKIAGGAHPEATLTGVTVGVDVSASEKIWRTFQSLGDIAFAYSYSNVLIEIQDTLRSSPAENEVMKKASFIGVSTTTTFYMLCGVLGYAAFGNRAPGNFLTGFGFYEPFWLVDVGNVCIVVHLVGAYQVFCQPIYQFAEAWARSRWPDSAFVNGERVLRLPLGAGDFPVSALRLVWRTAYVVLTAVAAMAFPFFNDFLGLIGAVSFWPLTVYFPVQMYMSQAKVRRFSPTWTWMNVLSLACLVVSLLAAAGSIQGLIKSVAHYKPFSVSS

SEQ ID NO: 6987 - protein, 502 aa, Oryza sativa
  Clone ID: PAT_MRT4530_79467C.1.pep
MGMERPQEKVATTTTAAFNLAESGYADRPDLDDDGREKRTGTLVTASAHIITAVIGSGVLSLAWAIAQLGWVIGPAVLVAFSVITWFCSSLLADCYRSPDPVHGKRNYTYGQAVRANLGVAKYRLCSVAQYVNLVGVTIGYTITTAISMGYLLSTMTNYSSKFGHAIKRSNWFHRNGHDAACLASDTTNMIIFAGIQILLSQLPNFHKIWWLSIVAAVMSLAYSTIGLGLSIAKIAGGAHPEATLTGVTVGVDVSASEKIWRTFQSLGDIAFAYSYSNVLIEIQDTLRSSPAENEVMKKASFIGVSTTTTFYMLCGVLGYAAFGNRAPGNFLTGFGFYEPFWLVDVGNVCIVVHLVGAYQVFCQPIYQFAEAWARSRWPDSAFVNGERVLRLPLGAGDFPVSALRLVWRTAYVVLTAVAAMAFPFFNDFLGLIGAVSFWPLTVYFPVQMYMSQAKVRRFSPTWTWMNVLSLACLVVSLLAAAGSIQGLIKSVAHYKPFSVSS

SEQ ID NO: 6988 - protein, 800 aa, Oryza sativa
  UNSURE (1)..(800): unsure at all Xaa locations
  Clone ID: PAT_MRT4530_79494C.1.pep
  unsure (1)..(800): unsure at all Xaa locations
QQPAMATLQSAVVFADAADTVAADRPLSGSQRLLVSSRGKFALGFFQPENSIHWYIGIWYNQISKHTPVWVANRGSPISNPDTSQLTIATDGNMVLLDNSRTAIWSTNISKIASNSTVGVILDTGNLVLADASNTSIIHWQSFDHFGNTWLPGGKLGRNKLAGVSTGLVAWKARNDPAPGVFSLELDPNGTSQYLLEWNSTQQXWTSGNWTGRIFTGVPEMTPTGIYPNSLYTFDYVNGENGSYFVYDLKDDSVLTRFVLGEMGQIQFLTWMNGANDWMLFWSQPKAQCDVYSLCGPFSVCTENAMAPCSCLRGFGEQNVGEWLQGDHTSGCRRNVELQCSSNGSVVGRSTDRFYTMGNVRLPSDAESVVATSTDQCEQACLRSCSCTAYSYNGSCSLWHGDLINLQDVSAIGSQGSNAVLIRLAASELSSQKQKHAKKLITIAIVATIVAALMVAALVVILRRRMVKGTTQVEGSLISFTYRDLKSMTKNFSEKLGGGAFGSVFKGSLPDATMVAVKKLEGFHQGEKQFRAEVSTIGNIQHVNLIRLLGFCSEKSRRLLVYEYMPNGSLDKQLFDGRKHVLSWDTRYQIALGIARGLDYLHEKCRDCIIHCDIKPENILLDGSFAPKVADFGLAKLMGRDISRVLTTARGTVGYIEPEWLAGTAVTAKADVFSYGMTLLEIVSGRRNVERREDGTADILPLLAASRLVGGVGDGRREELVSAVVDGRLGGDADMGEAERACRVAFWCIQDDENARPAMATVVQVLEGLVEIGVPPIPRSLQLLADESNYLQFSDLLPSK

SEQ ID NO: 6989 - protein, 329 aa, Oryza sativa
  Clone ID: PAT_MRT4530_80152C.1.pep
MVRLLVISVELKDIKIKKQKKSTGGCGTGVVDRASLGGFVKTQKTNAYHKRFQVKFKRRRQGKTDYRARIRLTNQDKNKYNTPKYRFVVRFTNKDITAQIVYATIAGDIVMAAAYSHELPRYGLEVGLTNYAAAYCTGLLLARRVLKLRGLDQEYEGNIEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMEALYKKVHAAIRADPYHGQINQEGTGDPQEIQPQEANLRTEEGQSCRKIECSQLLCWC

SEQ ID NO: 6990 - protein, 358 aa, Oryza sativa
  Clone ID: PAT_MRT4530_80157C.1.pep
MCAIRRKKKKKKNRPGNPNHSFSPTRQIDQHLLPSPRSSPSAAAAAEQQQQASDMGGFVKTQKTHAYFKRFQVKFKRRRQGKTDYRARIRLTNQDKNKYNTPKYRFVVRFTNKDITAQIVYATIAGDIVMAAAYSHELPRYGLEVGLTNYAAAYCTGLLLARRVLTLRGLDQEYEGNVEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMESLYKKVHAAIRADPTMAKSTKKEPATHKRYNLKKLTYEQRKASLVERLNALNSSAGADDDDEEEDDE

SEQ ID NO: 6991 - protein, 57 aa, Oryza sativa
  Clone ID: PAT_MRT4530_80270C.1.pep
IYKFYRVVGPHHPGSLTRVHPDRTTHFSRTFIKRSSWFLGLGEAPSDVRKNIGPINT

SEQ ID NO: 6992 - protein, 504 aa, Oryza sativa
  Clone ID: PAT_MRT4530_804C.1.pep
MQPPILLPLLLLLLLLAAASPRPVLSRRHASPPLATETLDVAASLSRARAAVSAEAVPLHQSAAAAVSTEVVGEEHEEGRLALRLHSRDFLPEEQGRQRHASYRSLVLARLRRDSARAAAVSARAAMAADGVSRFDLVPANVTAFEASAAEIQGPVVSGVGLGSGEYFSRVGVGSPARQLYMVLDTGSDVTWVQCQPCADCYQQSDPVFDPSLSTSYASVACDNPRCHDLDAAACRNSTGACLYEVAYGDGSYTVGDFATETLTLGDSAPVSSVAIGCGHDNEGLFVGAAGLLALGGGPLSFPSQISATTFSYCLVDRDSPSSSTLQFGDAADAEVTAPLIRSPRTSTFYYVGLSGLSVGGQILSIPPSAFAMDSTGAGGVIVDSGTAVTRLQSSAYAALRDAFVRGTQSLPRTSGVSLFDTCYDLSDRTSVEVPAVSLRFAGGGELRLPAKNYLIPVDGAGTYCLAFAPTNAAVSIIGNVQQQGTRVSFDTAKSTVGFTTNKC

SEQ ID NO: 6993 - protein, 954 aa, Oryza sativa
  Clone ID: PAT_MRT4530_81538C.1.pep
MVSGNLFHCRRNSWPAEEYVGRTALQLLDFDGGSPPEQAWRRRLNSHANLLKEFSVTFMEAMRMMSLGLRLWSYVREEASHGRKAPIDPFTKEKCKPSASQGVPLGGMGSGSISRGFRGEFKNWHIIPGLCETSPIFVSRDGGNKKYSSVLSPGHHEGLKKCNDSGISSWDWNLSGQHSTYHALFPRAWTVYDGEPDPDLKISCRQISPFIPHDYKDSSLPTSVFVYTLVNTGKDRAKVSLLMTWANSIGGFSHHSGGHFNEPFITAKDNPPVTFAIAACETQNVNVTVLPVFGLSGEGHDSAKQMWDRMKQNGHFDRENFEAGTSMPSSSGETLCAAVSASTWVEPHGRCTVVFGLAWSSPKIKFQKGCTYNRRYTEFYGTSERSAVNLVHDALTKYRIWEEEIEKWQNPILKNEKLPEWYKFTLFNELYFLVAGGTVWTDGQPPVIDEKPSPGSNQQKSSKRGTRDTKQESVKDNHVKLTAEQVTNGGDLANGEEQSVSKYAAVHGPQMAKATNGLGSQEPIPYLLSKNGPENVGKFLYLEGVEYIMWCTYDVHFYASFALLDLFPKIELSIQRDFANAVLYEDRRRMKFLADGTSGIRKVKGAVPHDLGTHDPWHEMNAYNIHDTSKWKDLNPKFVLQVYRDFAATGDMSFGRDVWPAVCAVMDYMNQFDRDGDGLIENDGFPDQTYDAWTVHGISAYCGGLWLAALQAAATMAHRLGDRPFAEKYKLKFIQAKAVYEAKLWNGSYFNYDSGTSSNSRSIQADQLAGQWYAASSGLPPLFDENKIRSALQKIFEFNVMKVKGGRLGAVNGMTPNGKVDETCMQSREIWTGVTYGVAANMLLHGMEHQGFTTAEGIFIAGWSEEGYGYWFQTPEGWTIDGHYRSLIYMRPLAIWAMQWARSPPKAILDAPKVNLMDRIHLSPQMIRAMNEINVRKIAPDNRCFPSSAFRCEC

SEQ ID NO: 6994 - protein, 448 aa, Oryza sativa
  Clone ID: PAT_MRT4530_81540C.1.pep
YRIWEEEIEKWQNPILKNEKLPEWYKFTLFNELYFLVAGGTVWTDGQPPVIDEKPSPGSNQQKSSKRGTRDTKQESVKDNHVKLTAEQVTNGGDLANGEEQSVSKYAAVHGPQMAKATNGLGSQEPIPYLLSKNGPENVGKFLYLEGVEYIMWCTYDVHFYASFALLDLFPKIELSIQRDFANAVLYEDRRRMKFLADGTSGIRKAAATMAHRLGDRPFAEKYKLKFIQAKAVYEAKLWNGSYFNYDSGTSSNSRSIQADQLAGQWYAASSGLPPLFDENKIRSALQKIFEFNVMKVKGGRLGAVNGMTPNGKVDETCMQSREIWTGVTYGVAANMLLHGMEHQGFTTAEGIFIAGWSEEGYGYWFQTPEGWTIDGHYRSLIYMRPLAIWAMQWARSPPKAILDAPKVNLMDRIHLSPQMIRAMNEINVRKIAPDNRCFPSSAFRCEC

SEQ ID NO: 6995 - protein, 98 aa, Oryza sativa
  Clone ID: PAT_MRT4530_81543C.1.pep
MSLGLRLWSYVREEASHGRKAPIDPFTKEKCKPSASQGVPLGGMGSGSISRGFRGEFKNWHIIPGLCETSPVMENQFSVMLSSSFCCCWLINLVYGDA

SEQ ID NO: 6996 - protein, 463 aa, Oryza sativa
  Clone ID: PAT_MRT4530_81921C.1.pep
MARKQHIAIFTTASLPWMTGTAVNPLFRAAYLAKAGDWEVTLVVPWLSKGDQLLVYPNKMKFSVPGEQEGYVRRWLEERIGLLPKFEIKFYPGKFSTEKRSILPAGDITQTVSDDKADIAVLEEPEHLTWYHHGRRWKNKFRKVIGVVHTNYLEYVKRERNGYIHAFLLKHINSWVTDIYCHKVIRLSAATQEVPRSIVCNVHGVNPKFIEIGKLKHQQISQREQAFFKGAYYIGKMVWSKGYTELLQLLQKHQKELSGLKMELYGSGEDSDEVKASAEKLNLDVRVYPGRDHGDSIFHDYKVFINPSTTDVVCTTTAEALAMGKIVICANHPSNEFFKRFPNCHMYNTEKEFVRLTMKALAEEPIPLSEELRHELSWEAATERFVRVADIAPIMSIKQHSPSPQYFMYISPDELKKNMEEASAFFHNAISGFETARCVFGAIPNTLQPDEQQCKELGWRLQE

SEQ ID NO: 6997 - protein, 426 aa, Oryza sativa
  Clone ID: PAT_MRT4530_82365C.1.pep
MFADFSAAAMELGEVLGLQGLTVPSTKEGDLSLIKRAAAGSFTQAAAASYPSPFLDEQKMLRFAKAAHTLPSGLDFGRENEQRFLLSRTKRPFTPSQWMELEHQALIYKYLNAKAPIPSSLLISISKSFRSSANRMSWRPLYQGFPNADSDPEPGRCRRTDGKKWRCSKEAMADHKYCERHINRNRHRSRKPVENQSRKTVKETPCAGSLPSSVGQGSFKKAKVNEMKPRSISYWTDSLNRTMANKEKGNKAAEENNGPLLNLTNQQPTLSLFSQLKQQNKPEKFNTAGDSESISSNTMLKPWESSNQQNNKSIPFTKMHDRGCLQSVLQNFSLPKDEKMEFQKSKDSNVMTVPSTFYSSPEDPRVSCHAPNMAQMQEDSISSSWEMPQGGPLGEILTNSKNPDDSIMKPEARPYGWLLNLEDHAM

SEQ ID NO: 6998 - protein, 671 aa, Oryza sativa
  UNSURE (1)..(671): unsure at all Xaa locations
  Clone ID: PAT_MRT4530_82807C.1.pep
  unsure (1)..(671): unsure at all Xaa locations
MALTTFSISRGGFVGALPQEGHFAPAAAELSLHKLQSRPHKARRRSSSSISASLSTEREAAEYHSQRPPTPLLDTVNYPIHMKNLSLKELQQLADELRSDVIFHVSKTGGHLGSSLGVVELTVALHYVFNTPQDKILWDVGHQSYPHKILTGRRDKMPTMRQTNGXLSGFTKRSESEYDSFGTGHSSTTISAALGMAVGRDLKGGKNNVVAVIGDGAMTAGQAYEAMNNAGYLDSDMIVILNDNKQVSLPTATLDGPAPPVGALSSALSKLQSSRPLRELREVAKGVTKQIGGSVHELAAKVDEYARGMISGSGSTLFEELGLYYIGPVDGHNIDDLITILREVKSTKTTGPVLIHVVTEKGRGYPYAERAADKYHGVAKFDPATGKQFKSPAKTLSYTNYFAEALIAEAEQDNRVVAIHAAMGGGTGLNYFLRRFPNRCFDVGIAEQHAVTFAAGLACEGLKPFCAIYSSFLQRGYDQVVHDVDLQKLPVRFAMDRAGLVGADGPTHCGAFDVTYMACLPNMVVMAPSDEAELCHMVATAAAIDDRPSCFRYPRGNGIGVPLPPNYKGVPLEVGKGRVLLEGERVALLGYGSAVQYCLAAASLVERHGLKVTVADARFCKPLDQTLIRRLASSHEVLLTVEEGSIGGFGSHVAQFMALDGLLDGKLKWRP

SEQ ID NO: 6999 - protein, 485 aa, Oryza sativa
  UNSURE (1)..(485): unsure at all Xaa locations
  Clone ID: PAT_MRT4530_83072C.1.pep
  unsure (1)..(485): unsure at all Xaa locations
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILIAIGEAVAYVLSGMYGSVSQLGTGNAILIILQLFFAGIIVICLDELLQKGYGXGSGISLFIATNISSSLYFSFSLLAYIIWKAFSPTTINSGRGAEFEGAVIALFHLLITRTDKVRALREAFYRQNLPNVTNLLATVLVFLIVIYFQGFRVVLPVRSKNASGQQGSYPIKLFYTSNMPIILHSALITNLYFISQLLYRRYSGNFLVNLLGKWKESEYSGHSVPVGGLAYYVTAPSSLADVLANPFHALFYVVFMLSACALFSKTWIEVSGSSAKDVAKQLKEQQMVMPGHRESNLQKELNRYIPTAAAFGGVCIGALTVLADFMGAIGSGTGILLAVTIIYQYFETFEKERATELGFFGF

SEQ ID NO: 7000 - protein, 485 aa, Oryza sativa
  Clone ID: PAT_MRT4530_83074C.1.pep
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILIAIGEAVAYVLSGMYGSVSQLGTGNAILIILQLFFAGIIVICLDELLQKGYGLGSGISLFIATNICLLLVNLLLHSENIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILHSALITNLYFISQLLYRRYSGNFLVNLLGKWKESEYSGHSVPVGGLAYYVTAPSSLADVLANPFHALFYVVFMLSACALFSKTWIEVSGSSAKDVAKQLKEQQMVMPGHRESNLQKELNRYIPTAAAFGGVCIGALTVLADFMGAIGSGTGILLAVTIIYQYFETFEKERATELGFFGF

SEQ ID NO: 7001 - protein, 538 aa, Oryza sativa
  Clone ID: PAT_MRT4530_83242C.1.pep
TMAVFGAAVLVALAVTCGLIWSRSRRLSKEMRDIPGTMGWPVVGETFSFISGFSSPAGILSFMRDRQKRFGKVFKTYVLGRMTVFMTGREAAKILLSGKDGVVSLNLFYTGKQVLGPTSLLTTNGDEHKKLRRLIGEPLSIDALKKHFDFINDLAVQTLDTWLDRRVLVLEEASSVIIKLFTLKVIANMLISLEPEGEEQEKFRANFKIISSSFASLPLKIPGTAFHRGLKKARNRMYAMLDSVIARRRDGGEVRNDFLQTLLRKHAKDGTAADEDDGGGGGDRDADKLTDAQLKDNILTLLVAGHDTTTAGLTWLIKFLGENPEALQKLRVMNETLRRATILPWFSRKAAQDFSIDGYEIKKGTSVNLDVVSIHHDPSVFADPYKFDPNRFDGTLKPYSFLGFGSGPRMCPGMSLARLEICVFIHHLVCRYSTPAGSQEIKQQELLRGKVTRNSYFSGKCDKEQQPRSIAQIFRSLKHDHSRAVTRNGTIQEATQQQQLRKGQGQWNNNQVAKPIRVTKKHYARQQWPSHAKPHMID

SEQ ID NO: 7002 - protein, 576 aa, Oryza sativa
  Clone ID: PAT_MRT4530_8325C.1.pep
MEVPIAAMTFAHPANVMTLASRQPKSKRSHISPATTAHRNLQTRLAHHHHATPASLPMAICNTVDKVINRFIDLPEQRPTVDPRRVLSGNFAPVDELPPTSCHVIRGSIPSCLAGGVYIRNGPNPQHRLPQRTHHLFDGDGMLHSLLIPSASSTLLSEPVLCSRYVHTYKYLLERETGGPVLPNFFAGFHGVAGLARAVVMIARVLAGQINLNKGFGLANTSITLFADCLYALCESDLPYSMHINPANGEVTTLGRCDFGGDLSFRMTAHPKKDPVTMELFAFRYNVFQPFITYFWFDRAGSKVADVPILSLQKPSVMHDFAITERYAIFPESQLIVNPMDMVMRGSSLVGLDRTMVPRIGVLPRYAKDESDMRWFEVPRFNMLHTTNGWEEADGEEIVLVAPNILSIEHMLGNMELMRARVDMVRINLCTGDVSCTALSPESLEFGVIHQGYVGRKNRYGYFGVSGPLPKIKGIRKLDFDLVGSGDCTVGRRDFGLGCFAGEPFFVPDNIDGYGNEDSGYVVCYTHEEDTGESWFVVMDAKSPELDIVAEVQLPSRIPYGFHGIFVKQAELLAQQ

SEQ ID NO: 7003 - protein, 139 aa, Oryza sativa
  Clone ID: PAT_MRT4530_83609C.1.pep
MAGKGGKGLLAAKTTAAKAAADKDKDRKKAPVSRSSRAGIQFPVGRIHRQLKGRVSANGRVGATAAVYTAAILEYLTAEVLELAGNASKDLKVKRITPRHLQLAIRGDEELDTLIKGTIAGGGVIPHIHKSLINKTAKE

SEQ ID NO: 7004 - protein, 323 aa, Oryza sativa
  Clone ID: PAT_MRT4530_83782C.1.pep
MAGRSELVVSFGEMLIDFVPTVAGVSLAEAPAFVKAPGGAPANVAIAVARLGGGAAFVGKLGDDEFGRMLAAILRDNGVDDGGVVFDAGARTALAFVTLRADGEREFMFYRNPSADMLLTHAELNVELIKRAAVFHYGSISLIAEPCRSAHLRAMEIAKEAGALLSYDPNLREALWPSREEARTKILSIWDQADIVKVSEVELEFLTGIDSVEDDVVMKLWRPTMKLLLVTLGDQGCKYYARDFRGAVPSYKVQQVDTTGAGDAFVGALLRRIVQDPSSLQDQKKLEEAIKFANACGAITATKKGAIPSLPTEVEVLKLMESA

SEQ ID NO: 7005 - protein, 744 aa, Oryza sativa
  Clone ID: PAT_MRT4530_84339C.1.pep
MAGQERRTIDLEEGWAFMQKGITKLKNILEGKPEPQFSSEDYMMLYTTIYNMCTQKPPHDYSQQLYDKYRESFEEYITSMVLPSLRDKHDEFMLRELVKRWSNHKIMVRWLSRFFFYLDRYFISRRSLIPLEQVGLTCFRDLIYQEIKGQVKGAVIALIDKEREGEQIDRALLKNVLGIFVEIGLGSMECYENDFEDFLLKDTTDYYSLKAQSWILEDSCPDYMIKAEECLKKEKERVGHYLHISSEQKLLEKVQNELLAQYATPLLEKEHSGCFALLRDDKEEDLSRMYRLFSKINRGLEPIANMFKTHVTNEGTALVKQAEDSASNKKPEKKDMVGMQEQVFVWKIIELHDKYVAYVTECFQGHTLFHKALKEAFEVFCNKGVSGSSSAELLATFCDNILKKGCSEKLSDEAIEDALEKVVRLLAYISDKDLFAEFYRKKLARRLLFDKSANDEHERSILTKLKQQCGGQFTSKMEGMVTDLTVARDHQTKFEEFVAAHQELNPGIDLAVTVLTTGFWPSYKTFDINLPAEMVKCVEVFKEFYQTRTKHRKLTWIYSLGTCNINAKFEAKTIELIVTTYQAALLLLFNGSDRLTYSEIVTQLNLSDDDVVRLLHSLSCAKYKILNKEPANRSISPNDVFEFNSKFTDRMRRIKIPLPPVDEKKKVVEDVDKDRRYAIDASIVRIMKSRKVMGHQQLVAECVEQLSRMFKPDFKAIKKRIEDLITRDYLEREKDNANVYRYLA

SEQ ID NO: 7006 - protein, 196 aa, Oryza sativa
  Clone ID: PAT_MRT4530_85095C.1.pep
MGRGRSEIKRIENPTQRQSTFYKRRDGLFKKARELAVLCDADLLLLLFSASGKLYHFLSPTVPSVREFVERYEATTHTKVWADIRQERRAELEKVGSMCDLLEKQLRFMTVDDGEEYTVPSLEALEHNLEAAMRKVRSEKDRKIGGEICYLQNIIRGRQEERYGLCDKIAHAQTLKDVECGSTSLSNGLDLKLGFN

SEQ ID NO: 7007 - protein, 89 aa, Oryza sativa
  Clone ID: PAT_MRT4530_85350C.1.pep
MVNPGRTARALCLLCLALLLLGQDTHSRKLLLQEKHSHGVGNGTTTTQEPSRENGGSTGSNNNGQLQFDSAKWEEFHTDYIYTQDVKKP

SEQ ID NO: 7008 - protein, 383 aa, Oryza sativa
  Clone ID: PAT_MRT4530_85425C.1.pep
REERRGEGAGQGRGGKMSSTAPLLTPYKMGRFDLSHRVVLAPLTRQRSYGNVPQPHAILYYQQRTTKGGLLIAEATGISDTAQGYKDTPGIWTKEQVEAWKPIVDGVHAKGGIFFCQIWHVGRVSNNTFQPNGQAPISSTNKSLKPAVRANGIDVATFSTPRRLETDEIPFVVNDYRVAARNAIEAGFDGVEIHGAHGYLIDQFLKDQVNDRSDKYGGSLENRCRFALEVVQAVTDEIGADKVGIRLSPFASYSEAADSNPEALGLYMANALNKFGILYCHMVEPRMVKLGEKFETPHSLRPIRDAFKGTFIAAGGYNKEDGNKAVSTGYTDLVAYGRLFLSNPDLPERFEIDAPLNKYNRETFYISDPVIGYTDYPFLPSDV

SEQ ID NO: 7009 - protein, 814 aa, Oryza sativa
  Clone ID: PAT_MRT4530_85672C.1.pep
MAGLVIGCLAVQLSLASLLLCSSASTAQHTLGTGSSLSVADRSRPFLVSPDGTFSCGFIQAGDDGDNAFSFSVWFTAARDGAVVWTANPDAPVNGRGSTISFRHDGELALADTNGTTVWASRTGGGGRGLTVSLRDTGNLVIEDPSTGRAVWQSFDWPTDTLLPSQRFTKDTKLVAGYFSLYYDNDNVLRMLYDGPEIASIYWPLPGVSIFDFGRTNYNSSRIAILDDAGVFRSSDRLQAQASDMGVGVKRRLTIEQDGNLRIYSLNASTGGWAVTWAALSQPCQAHGLCGKNGLCVYLPSLRCSCPPGYEMIDRRDWRKGCQPMFSVGNCSQPAAPERFKSVVVPQTDFYGYDLMFNGSSITFELCRNQCLSDCQCVAFSYRFDGVGRCFTKGRLFNGYTSANFPGNIYLKVSIDFDESSPLVSARSAAGLTCNPNVSIVTVPAAVYGMAPRNSGKWTYLFVFAGVLGVLDLLFIATGWWFLSSKQSIPSSLEAGYRRVMTSQFRRFTYRELKDVTANFKEELGRGGSGVVYRGVLDGGKVVAVKRLAVDVTMQGDEEFWAEMTVLGRINHMNLVRIWGFCSERKHKLLVYEYVENQSLDRHLFDTAEGGGGMSTTTLAWKDRYKIALGTARGLAYLHHECLEWVIHCDMKPENILLTRDFDAKIADFGLAKLSKRDRGAGVELTHMRGTSGYMAPEWALNVPINAKVDVYSFGIVLLEIVVGSRVADQRTEAGERLQLPQIAQALRHVLDSGDVRSLVDARLQGQFNPRQAMEMVRISLACMEDRNSRPTMDDIAKALTAFDDEDEHPAYRS

SEQ ID NO: 7010 - protein, 499 aa, Oryza sativa
  Clone ID: PAT_MRT4530_85748C.1.pep
MTKIVGTLGPKSRAVDTISSCLKAGMSVARFDFSWGDAEYHQETLENLKLAIKSTKKLCAVMLDTVGPELQVVNKSEAAISLEANGTVVLTPDQGQEASSELLPINFSGLAKALKPGATIFVGQYLFTGSETTSVWLEVSEVKGDDVVCVIKNSATLAGSLFTLHCSQIHIDLPTLSDEDKEVIRRWGAPNKIDFLSLSYTRHAEDVRQAREFLSKLGDLSQTQIFAKIENVEGLNHFDEILQEADGIILSRGNLGIDLPPEKVFLFQKSALHKCNMAGKPAVVTRVVDSMTDNLRPTRAEATDVANAVLDGSDAILLGAETLRGLYPVETISIVGKICAEAEKVFNQDLYFKRTVKYVGEPMTHLESIASSAVRAAIKVKASVIICFTSSGRAARLIAKYRPTMPVLSVVIPRLKTNQLRWSFTGAFEARQSLIVRGLFPMLADPRHPAESTSATNESVLKVALDHGKASGVIKSHDRVVVCQKVGDSSVVKIIELDD

SEQ ID NO: 7011 - protein, 86 aa, Oryza sativa
  UNSURE (1)..(86): unsure at all Xaa locations
  Clone ID: PAT_MRT4530_85868C.1.pep
  unsure (1)..(86): unsure at all Xaa locations
RMSLDLAQWIKHVPLMNILWSHFAEKVLNEDFXLVLGQQEGMINGANVWKWPVLYDKLGIRYRLWRDAIERGVDRLPFSKKSESGP

SEQ ID NO: 7012 - protein, 445 aa, Oryza sativa
  Clone ID: PAT_MRT4530_85925C.1.pep
MAVTIQSVKARQIFDSRGNPTVEVDVGLSDGSFARGAVPSGASTGIYEALELRDGGSDYLGKGVLKAVSNVNTIIGPALIGKDPTEQVDIDNFMVQQLDGTSNNWGWCKQKLGANAILAVSLAVCKAGAMVKKIPLYQHIANLAGNKTLVLPVPAFNVINGGSHAGNKLAMQEFMILPTGASSFKEAMKMGVEVYHHLKSIIKKKYGQDATNVGDEGGFAPNIQENKEGLELLKAAIAKAGYTGKVVIGMDVAASEFYSEKDKTYDLNFKEDNNDGSHKISGDSLKDVYKSFVSEYPIVSIEDPFDQDDWATYAKLTDEIGQQVQIVGDDLLVTNPTRVAKAISEKTCNALLLKVNQIGSVTESIEAVRMSKRAGWGVMASHRSGETEDTFIADLSVGLSTGQIKTGAPCRSERLAKYNQLLRIEEELGDAAVYAGEKFRAPVKP

SEQ ID NO: 7013 - protein, 585 aa, Oryza sativa
  UNSURE (1)..(585): unsure at all Xaa locations
  Clone ID: PAT_MRT4530_86446C.1.pep
  unsure (1)..(585): unsure at all Xaa locations
MDSSYQHDKPLLDEENSSQVTLEYTGDGSVCIRGHPALRKHTGNWKGSSLAIVFSFCSYLAFTSIVKNLVSYLTKVLHETNVAAARDVATWSGTSYLAPLVGAFLADSYLGKYCTILIFCTIFIIGLMMLLLSAAVPLISTGPHSWIIWTDPVSSQNIIFFVGLYMVALGYGAQCPCISSFGADQFDDTDENERTKKSSFFNWTYFVANAGSLISGTVIVWVQDHKGWIWGFTISALFVYLGFGTFIFGSSMYXDFRNLEEAPLARICQVVVAAIHKRDKDLPCDSSVLYEFLGQSSAIEGSRKLEHTTGLKFFDRAAMVTPSDFESDGLLNTWKICTVTQVEELKILIRMFPVWATMILFAAVLDNMFSTFIEQGMVMEKHIGSFEIPAASFQSIDVIAVLILVPVYERVLVPVFRKFTGRANGITPLQRMGIGLFFSMLSMVSAALVESNRLRIAQDEGLVHRKVAVPMSILWQGPQYFLIGVGEVFSNIGLTEFFYQESPDAMRSLCLAFSLANVSAGSYLSSFIVSLVPVFTAREGSPGWIPDNLNEGHLDRFFWMMAGLCFLNMLAFVFCAMRYKCKKAS

SEQ ID NO: 7014 - protein, 165 aa, Oryza sativa
  Clone ID: PAT_MRT4530_86520C.1.pep
MPVPLAPYPTPPVPFTPPNGAQSQLVCSGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGEHWDPGDWYNLSDCHPKLMSAWQQLAVMACDAF
